United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 31

SEQ ID NO: 177906 - protein, 330 aa, Glycine max
  Coding DNA Sequence Number=SeqID_86221
  Homolog annotation: Hit_ID=Q2HW90; Match level="QueryCoverage=79%, HitCoverage=66%, E-value=3e-19, Identity=28%"; Hit description =Putative uncharacterized protein
MDQLQRQAFRKTMEKIWDLTMIKVFVEAIASLAQYYNQPLRCFTFGDFQLVPTVEEFEGILGCPLEGRKLYLFSGLYPSMARVAKHLEEKAKALANQGECNSFIDVLALLVFGVVLFPNVDGLVDLAAIDTFLAYHHNKESSVVAVLVDAYDTFDWRCEKSSTRIVCCTPALYVWLEGGAGVLCSCERFPNVPLMGTRGCINYNLVLAIRQLGYPMRGVPSEDSIASFIARGFSDPNAKMLQRVRKAWNTVQRKDKELRGSNNGVIGRYHKWLKARMQGITWLPKLKSSGGEEADVPEESEEVQALKAELERTQVVKEKFKTIDIRVRKD

SEQ ID NO: 177907 - protein, 316 aa, Glycine max
  Coding DNA Sequence Number=SeqID_86222
MASKKHKSIGSRPTTQYDTRRFHSLDAWNQYTDNVLGRNILPEKKVELYHTKLDDFKTELKRRNFHKRLTNLVDGSKDLALVKEFYANLYSSEGPSPKQAIVRGHLVKIDVDSLNTFLETPVVLAEGETLPIYSRYCSLPTDYREIEATLCIPGRRFILNTEGHPGRILRKDLTTLAQVWSALSYSNMPPTSHTSDLTVDRARLIFGLVSRMDMNKGALISGQMTSIAQSNTSRLGFPTLITALCRARGVVSHSLTFERLNPVINLAYIRNNCWNPEDLTISIRGARRARARPAALPSTSVAPTPTSTSVAPFVPP

SEQ ID NO: 177908 - protein, 690 aa, Glycine max
  Coding DNA Sequence Number=SeqID_86223
  Gene Ontology: Mol. function=transferase activity; Cellular component= membrane; Biological process=metabolic process
  Homolog annotation: Hit_ID=A7P576; Match level="QueryCoverage=93%, HitCoverage=98%, E-value=0.0, Identity=55%"; Hit description =Chromosome chr4 scaffold_6, whole genome shotgun sequence
  Pfam annotation: Domain name=Exostosin; Domain location=364-653; Score=292.6; E_value=7.8e-85; Accession=PF03016.6; Description =Exostosin family
MGILSERGSFSYVMFTLELDRDIIGSRFMVYKMQNSKPVNARALKERPTWESVSHLETKRLLWLIGITFAVILTFQYLEFPYGTVLLSLFSAEKIPTPGSSTFKASDAPSISELVNNVTLFNPANSTGDHAFEIANKTKSGENDTIPRIGLVLEPGSTPNNSLGLDGSDQSSKTKSINRSENVAETPQGGDPGPISFNNTIDLSFSANQFQEDNISSTEQKSGSQYASSTNVSTNIVTAVLSNDSSISLFQKDNTTNSIKEESIRSSQNDAKVSVPNEKKDSHTPIPEVTTVSEMNKLLLQSHNSYRSMRPSWFSAVDQELLQARSEIENAPIVKKDPNFYAHIYHNVSMFKRSYELMEQTLKVYVYREGARPIMHSPFFTGLYASEGWFMKQMEANKRFLTRDPNKAHLFYLPFSSRMLEETLYVQNSHNHKNLVQYLHNYVEMIAGKYTFWNRTGGADHFLVGCHDWAPGETKVDMANCIRSLCNADVKEGFVFGKDASLPETYVRDAKIPTKDLSGNSASKRTTLAFFAGSMHGYVRPILLQHWENKDPDMKIFGRLPKSKGNRNYIQYMKSSKYCICAKGYEVNSPRVVEAIFYECVPVIISDNFVPPFLEVLNWESFAVIVLEKDIPNLKNILLSIPEKQYLRLQMRVKKVQQHFLWHKNPVKYDIFHMILHSVWYNRVFSAPAR

SEQ ID NO: 177909 - protein, 231 aa, Glycine max
  Coding DNA Sequence Number=SeqID_86224
  Homolog annotation: Hit_ID=Q6WAY4; Match level="QueryCoverage=86%, HitCoverage=35%, E-value=1e-22, Identity=33%"; Hit description =Putative uncharacterized protein
MVTNQTGKRFYQVKVKGLDVTSIKELGQLMGPLQMQAFRKTYGKILDLTIAEVSIEAIASLTQYYDQPLRCFTFRDFQLVPTIEEFEEILGCPLGGRKPYLFSGFLPSLSRIATVVKGSARGLDRVKQTRNGIVGLPRKYLEDKARDMANHEEWVPFMDVLALLIFGVVLFPNVDGLVDLAAIDAFLAYHHSKESPVVAVLADLFDTFDRSKTRGIHVRSEAIARVLKREE

SEQ ID NO: 177910 - protein, 245 aa, Glycine max
  Coding DNA Sequence Number=SeqID_86225
MRGAPTEGSLSPFLAKDLGTQGLKVIQRIHKAWRNWLSKLKVIDEENFEAPEEDEEVRALKLELGKARLAKEKFKSAATHIRKECTELQEEKAATARALEQETKRACKEEYGQEKFQGALWGSNNELKLRREERDRSRVHGMILKEELVACTRSKRSFPSPLGSHRPPPMLAIIGQYKEELNQSVAHEQKLVEDFAQVYAEKEARGRVIDALHQEATMWMDRFALTLNGSQDLPRLLAKAKAMAE

SEQ ID NO: 177911 - protein, 307 aa, Glycine max
  Coding DNA Sequence Number=SeqID_86226
  Homolog annotation: Hit_ID=A5AZG1; Match level="QueryCoverage=30%, HitCoverage=30%, E-value=4e-09, Identity=37%"; Hit description =Putative uncharacterized protein
  Pfam annotation: Domain name=zf-CCHC; Domain location=132-149; Score =22.6; E_value=0.00058; Accession=PF00098.14; Description=Zinc knuckle
MKREKHAFYSSHNSCKSLSEELRDYYEGRHRSHLRPHSHRRENERKPQEANINLPYFHGKDNVEAYLDWEIRVEQKLKRKSTLKYYGSHSYPKKDQGLGILGAVPSKPKYDKGKTIEKQPLKASMQEKTSSIKCFKCLGRGHITSQCPTKKTMIMRNQDIYSSQYEAITSSSSSESEEAKGEESSEEIYPQEKGQPLMFKEDCKEVSVSSKSLAKKERHIEIKTNIKEISPFRQPPHFLLCKRPLVSIATPLGLEFIPQVKELLDEGLVRKSLNPCVLLVPKIGIINMKIKKKMLRKESMSFKNLWI

SEQ ID NO: 177912 - protein, 139 aa, Glycine max
  Coding DNA Sequence Number=SeqID_86227
  Homolog annotation: Hit_ID=A7P574; Match level="QueryCoverage=80%, HitCoverage=58%, E-value=5e-17, Identity=42%"; Hit description =Chromosome chr4 scaffold_6, whole genome shotgun sequence
  Subcellular localization annotation: CTP_CleavageSite=77; ConfidenceScore=5.49e-01
MATETIRSSVKLKSSAPDGSSKGKIDSSAVRKKVESSSKLPADSKMKSVSTVTKSEVKSKSTSSSSKTVTKTTTKVREKKVYSLPGQKHDPPEQKEPLRVFYESLSKQIPTSEMAEFWLVSFQSYSCLPTIFTPMNEHW

SEQ ID NO: 177913 - protein, 182 aa, Glycine max
  Coding DNA Sequence Number=SeqID_86228
  Homolog annotation: Hit_ID=A2Q4S5; Match level="QueryCoverage=32%, HitCoverage=9%, E-value=4e-07, Identity=43%"; Hit description=IMP dehydrogenase/GMP reductase, putative
MRRVVTPDVCWMPYGDHQGVRVFDLISCFQGELRWGSIMVTHRPERVVRQFGYIQTIPPPPISATLSFEDMDNRWMHYSDHLAADPPRHPPVPQHETYVELDISEVPVAPEAGSSQAADQPKHVVDACEAIVERLKHMLNLRMVTAGTELHDIMEDCQRIARGVTSDGNVYVRARQRWRTDQ

SEQ ID NO: 177914 - protein, 412 aa, Glycine max
  Coding DNA Sequence Number=SeqID_86229
  Homolog annotation: Hit_ID=Q6WAY4; Match level="QueryCoverage=58%, HitCoverage=41%, E-value=3e-24, Identity=32%"; Hit description =Putative uncharacterized protein
MSYFVSYPNFVPRQLFVDMRIFSSHIELLKANCRVIRKESSGGSKSSPRRACCFKLKPPARLGELSMPWGSRKACITFLNAYMGHRAAKCCRLRELGQLMGQLQHQAFCKAYGKIWDLATVEVFVEAIASLTKYYDQPLRCFTFRDFQLVPTMEEFEEILGCSLGERKPYLFLGFYPFMERVAKVVKISVQELDRVKQNRNGVVGIPRKHLEGKAKALADQGEWVPFINTFALLIFGVVLFPNMEGLVNLAAIDAFLAYHHSKESPAIAILADHYDTFIRRCKKSSTRIVCCIPALYVWLISHLFRQESRPICPLQGFNDPNARVLQGVRKAWDAAQKKDKELRGSSNGVISGYHKWLRVRTQGLDWPPKLKAAREEEAEAPEESEEVQALKVELEKARAVKEKFKSTTIKV

SEQ ID NO: 177915 - protein, 223 aa, Glycine max
  Coding DNA Sequence Number=SeqID_86230
  Homolog annotation: Hit_ID=Q6WAY4; Match level="QueryCoverage=86%, HitCoverage=52%, E-value=2e-13, Identity=39%"; Hit description =Putative uncharacterized protein
LKELGRLMGPLQRQAFRKVYGNILDLTTTEVFTEAIVSLAQYYDQPLRCFTFEDFQIVLTVEEFGEILGCPLGERKPYLFSGFLPSLSKIAAVVGDSAKELDHMKQTRNGVVGLSRKYLEGKARDMANQEEWVPFADILALLIFAEGKEGVLFSCGDYPNVPLIGTRGCINYNPALAIRQLGYPMRGAPMEESLSPFLVRDFGSKFQDCTKSPQGVGKPVEER

SEQ ID NO: 177916 - protein, 33 aa, Glycine max
  Coding DNA Sequence Number=SeqID_86231
MSEIGRFGGLGMEERRKEEGAAQGILKMPSVLV

SEQ ID NO: 177917 - protein, 118 aa, Glycine max
  Coding DNA Sequence Number=SeqID_86232
YILCGTSRAYIYFGCNTENKRGYISCGSVQVEGTSTWLFKENKEGYIPCGSLLAKDFTRLLEISRIGGCLGTGRSHGLWPNQVLKAKSWRNNEEKNNLQQGPTQHRAQHVTRAKRTEN

SEQ ID NO: 177918 - protein, 285 aa, Glycine max
  Coding DNA Sequence Number=SeqID_86233
MRGAPLEEELAPVISRGFNKTNGETLQKVHKAWEVVQKKDKELRGSNNGPIGGYRRWLKAHIQGLDWLPSLRTAKREEVEAPEEDEEVQALRAELEQAQTVKERFKLAALKIQNENAELRDTNIATTKALEQETKRARREEHDRNKFRGALWGSNSELKLWREERDQSRVHGMVLKEELTSCSRSKKILAQHLEATEQSMLAIIGQYKEGLNQSLTHEQKLVEDFAQAYVEKEARGRVIDALHREATMWMDRFALTLNGSQDLPRLLAKARAMAEVCSAPEEFTG

SEQ ID NO: 177919 - protein, 161 aa, Glycine max
  Coding DNA Sequence Number=SeqID_86234
MKREKHASYSSHNSCKSLSEELRNYYEGRHRSHLRPHSHRREKERKPQESNINLSYFHGKDNVEANLDWEIRVEQQLKKKSHFKILWFSLLSKERPRTHYFSCPTTKTMIMKGQNIYGSQDEATTSLSSSESEEAKGEKSSEEIYPQEEEQPLVVKEKFKE

SEQ ID NO: 177920 - protein, 118 aa, Glycine max
  Coding DNA Sequence Number=SeqID_86235
  Subcellular localization annotation: CTP_CleavageSite=47; ConfidenceScore=5.95e-01
MGSPPASTPPPPPPPPPPPHPSSSPPPPPPSPSDASASLSAVKRTPKASRLRSLSTRPPGAKRPVVHVDPATGKADGPHRKKLRTYLGIVARDKVDVTYENWKEVPTAQKDLIWEDIQ

SEQ ID NO: 177921 - protein, 102 aa, Glycine max
  Coding DNA Sequence Number=SeqID_86236
  Homolog annotation: Hit_ID=A6FJQ2; Match level="QueryCoverage=37%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFANNELMIEAGATKGIGETIWGGSFVGRVALFSAEGEKKGLVSNLL

SEQ ID NO: 177922 - protein, 177 aa, Glycine max
  Coding DNA Sequence Number=SeqID_86237
MDENWFQLLTPFISQWNNRAEFRVDIYPRQEGLLSFNSDYMVWYRQKTKMFVDQNNAKTATLDEGAETLQYMVSPQGRNTWTVDDLVSYVEKLTILSEEQERITEPVAHGPASERSFPPQQFHMLPSSVETRGFDRRREIVQAEDFSQQMEQRGHGMYYSPPTFSQYPSQMYQYPFE

SEQ ID NO: 177923 - protein, 58 aa, Glycine max
  Coding DNA Sequence Number=SeqID_86238
MQPKVLNLDPSNPQLGCLASHTRNPNANETESTEQLLLTQEGGSLLLFLAPRNHSNTL

SEQ ID NO: 177924 - protein, 180 aa, Glycine max
  Coding DNA Sequence Number=SeqID_86239
MSVHVAQLIADAIYLFAGMPPTRHPLNPDKSNRALGFPALIMGLCQSFGVPVTPSKVIRPPITQTFIEKYCTPRQAQGDAPQAADTPPPPYQADPAGSLGMERYLQHLVRQQAANHQGQGFVPFVCPTLDQFRAEVAWPGDWPEAQAREAPTEALGDAEEARKDEEMMDLLDFLGGSGAT

SEQ ID NO: 177925 - protein, 48 aa, Glycine max
  Coding DNA Sequence Number=SeqID_86240
MAVWSPDHGCGHLTMAMVASPWLSVRFQQTFTMTMAGHRYSEDVYVMM

SEQ ID NO: 177926 - protein, 150 aa, Glycine max
  Coding DNA Sequence Number=SeqID_86241
  Homolog annotation: Hit_ID=Q84VH5; Match level="QueryCoverage=50%, HitCoverage=10%, E-value=6e-34, Identity=93%"; Hit description =Envelope-like protein
MSIRKCLSEENVLVSPAVINKYLGRPTEGVVDIAVSEHQIAKEITAKQVQHWPKKGKLSAGKLSVKYAILHRIGTANWVPTNHTSTHRLWTMAQKKSTPITPTTSRWSKVAIPSKKRKEISSSDSDDDVEPDVPDIRGPRHQGRTCLEMS

SEQ ID NO: 177927 - protein, 77 aa, Glycine max
  Coding DNA Sequence Number=SeqID_86242
MAESGLEESEWAQARYDQLNLIEGAESSQVAVRSQDKLTAEINQGTWGRMQMGIGSRPTDRCPFPALNKQRTSLKAA

SEQ ID NO: 177928 - protein, 157 aa, Glycine max
  Coding DNA Sequence Number=SeqID_86243
  Gene Ontology: Cellular component=cell projection; Biological process= cell adhesion
  Homolog annotation: Hit_ID=A8GL27; Match level="QueryCoverage=97%, HitCoverage=84%, E-value=4e-53, Identity=65%"; Hit description =Fimbrial protein precursor
  Pfam annotation: Domain name=Fimbrial; Domain location=17-157; Score =46.5; E_value=9.6e-11; Accession=PF00419.11; Description=Fimbrial protein
MLVIPATQAAPKVQGWGRVNMQGAIIDTACAIAAGSRDQTIDMDVLPLGNIARDGQGNTRPFTIELINCTFERPKPNLPNWKQFQVVFDGDADGELFGVRGDAKGVALQISDGQGNIAAPGVPLPRGDISPGSTSLNYSIKLVANKQPLHAGSYFYA

SEQ ID NO: 177929 - protein, 77 aa, Glycine max
  Coding DNA Sequence Number=SeqID_86244
MAVEWRRRRVERKRHFKEKMSLEEAHHHRRPWIRAWRKKKMNEGRGREEPKIWCSKGALKSEPTNPRSSPRFSTKCA

SEQ ID NO: 177930 - protein, 131 aa, Glycine max
  Coding DNA Sequence Number=SeqID_86245
MHGVATNVYLWKTSEKTKETGHKEYSKFGSCIYVGGRRENGLNDRLKFVKNGRKETEIERNKNESQETRNELKVSDLETYPLKNEERMKNGLWEFYGSITGVLEAPKAHFLTKRGRWLPPSSPRRARLLPP

SEQ ID NO: 177931 - protein, 83 aa, Glycine max
  Coding DNA Sequence Number=SeqID_86246
MDPYIVIKKDLMGTGEDDKGGTCTNVQSVYAREYYSLRSPKVKKEIKNFNEFNHRLIMNFWHGSRDHHLQHVTRLYDFGPLYL

SEQ ID NO: 177932 - protein, 637 aa, Glycine max
  Coding DNA Sequence Number=SeqID_86247
  Gene Ontology: Mol. function=indole-3-acetic acid amido synthetase; Cellular component=cytoplasm; Biological process=response to auxin stimulus
  Homolog annotation: Hit_ID=A7P139; Match level="QueryCoverage=99%, HitCoverage=99%, E-value=0.0, Identity=70%"; Hit description =Chromosome chr19 scaffold_4, whole genome shotgun sequence
  Pfam annotation: Domain name=GH3; Domain location=35-609; Score =1168.6; E_value=0; Accession=PF03321.4; Description=GH3 auxin -responsive promoter
MPEAPSQYLCNKPNGKLDDGGATNTSIIIEHNNKKALKYIEDVTSNADEIQKRVLAEILSCSAHVEYLQRHGLEGRTDRETFKKIMPVVTYEDLKPDIDRIANGDASPILCSKPISEFLTSSGTSGGERKLMPTIEDELERRSLLYSLLMPVMDQFVPGLDKGKGMYFLFIKSESKTPGGLLARPVLTSYYKSSHFKNKTHGLNFDPYTNYTSPIETILCQDSYQSMYSQMLCGLSQNEHVLRVGSVFASGFIRALKFLEKHWESLCHDIRNGTIDHEITDSTVREAIMKILKPNPKLADFIEGECKKGLWKGIITRLWPNTKYVDVIVTGTMAQYIPMLDYYSNGLPLVCTMYASSECYFGLNLNPLCDPSEVSYTLVPTMAYFEFLPLNKMKGHANSISHTEQELLVDLVDVELDQEYELVVTTYAASNNYVIMHNPHTGLYRYRVGDILRVAGFKNNAPQFNFVCRKNVVLSIDSDKTDEVELQNAVKNGAKHLATLGASLTEYTSCADTSTIPGHYVLYWEINMNNNDQTPIPSSVFEECCFAVEGSLNSVYRQGRVSESIGPLEIKIVENGTFDKLMDFALSQGASINQYKTPRCVKYAPIVELLDSKTVSNYFSPKCPQWVPGHKKWCMYP

SEQ ID NO: 177933 - protein, 141 aa, Glycine max
  Coding DNA Sequence Number=SeqID_86248
  Subcellular localization annotation: CTP_CleavageSite=38; ConfidenceScore=5.42e-01
SATTLRSCRLLRPPPTSPPPCRFSFLRKLVIGNTNGFRGATESHRQPIELPSFLPPLPPPRMIWLQSVGNLRSCEVGQRVPNDGGVIDAIAAATVVDLVLTDVAVEILFSGRKTMKGIPAAAKYPENATEVAVVVVEDAVS

SEQ ID NO: 177934 - protein, 137 aa, Glycine max
  Coding DNA Sequence Number=SeqID_86249
MEGMCILIQMWAWERCTTLAPKRTPPVIENKSLGHRDQLAICNGYSKLNSPVLLATPTTAQFASSTGGFNLIKVVFPATLPATLHCVNSNPSSTRQSNCDNQYRVASAFVKMGNVAMIVVDVAGMVVVVEGLVFGGD

SEQ ID NO: 177935 - protein, 183 aa, Glycine max
  Coding DNA Sequence Number=SeqID_86250
  Pfam annotation: Domain name=Transposase_23; Domain location=37-107; Score=4.0; E_value=0.00043; Accession=PF03017.5; Description =TNP1ENSPM transposase
MQSQGLALPPEPEVVPSSARVSTKESCVDPLGNDPDTGDLDKCGLYIEEHPPRLVALGRVYEGSTIVHNIPLLHDQVKVSVEDVRDADAPIPVPTEEVNLVGNALNTFLAWSTHLVKRFSEHDATVFGVFNEDFPLYIKHEDLSKIAHGDQCLNIFVIQLWILHMTKASMQAGNSDVYGFLEP

SEQ ID NO: 177936 - protein, 125 aa, Glycine max
  Coding DNA Sequence Number=SeqID_86251
MKENIIDIKLSDKPLIRSSECQQKSNYSNFGYWRKGFSIRLRLNISRDIKNKAVIMGRELIIGNHRGNMMFGAWMIGDSGWCETGLIVIEFDGSGSNSVSLTKGMFRGGGFSIWLVNRYRFRLRR

SEQ ID NO: 177937 - protein, 68 aa, Glycine max
  Coding DNA Sequence Number=SeqID_86252
MGIPRSCGSACHRTPGSRISFLNNHIVETLGPIKIGENHSKCISLTHCVARKSLAHRILSAIKERGPL

SEQ ID NO: 177938 - protein, 164 aa, Glycine max
  Coding DNA Sequence Number=SeqID_86253
LRTAKREEDEAPEEDEEVQALRTELKQAQTIKERFKSAALKIQKENAELRDINIATTKALEQETKRARREEHGRNKFQGALWGSNNELKLRREERDQSRVDRMSERLARETNMLVIISKYQEELSLATAHEHRVADEYAQVYAEKETRGRVIDSLHQEATMWMD

SEQ ID NO: 177939 - protein, 46 aa, Glycine max
  Coding DNA Sequence Number=SeqID_86254
MDTSKPYTGAMRGTVHEPQVRRHKVMTKDNNRYLKALHWGNEGHRA

SEQ ID NO: 177940 - protein, 120 aa, Glycine max
  Coding DNA Sequence Number=SeqID_86255
MAAQVAPPMMERELIAMIVDMLSVSYYEKMVGYMPSSFADLVFAGERIEVGLRRGKFDCLALTSKKPGANRENEKGEGTRVLTASPTWPNFLPTQQCHYSANIIPFHYPPPNHPRRSSLN

SEQ ID NO: 177941 - protein, 34 aa, Glycine max
  Coding DNA Sequence Number=SeqID_86256
VKGRSPEYQEPQDLRSNPFQGGGNDAILLRKGMG

SEQ ID NO: 177942 - protein, 197 aa, Glycine max
  Coding DNA Sequence Number=SeqID_86257
MASMMEAMLGMKQLMGEKHGHCPSAVSSAAEADPTLLATAHHPPSNIVGRGRDTLGHDGNPHMGYNRAAYPYGLLPNYSPPVLQDDAGHIASPVLEREPPQQPDEVHKDPQDYARRDVEFYPPIPEGPAPSTLPQPNITTQPIVLSTEEPPPATEERRKLDLLEERLRAVEGFGDYPFADMTDLCLVPDVVIPPKFK

SEQ ID NO: 177943 - protein, 126 aa, Glycine max
  Coding DNA Sequence Number=SeqID_86258
MSMTLYEKKYDISKEKVDPNFCQTCRDPSWEDSLEEQASQGSFVAHGRQDVMTVAIGRPEHPGRVRAARVGVTIKQYFGPTPRTSCTSSSMAPKDLEQQMQKIRDQLEESITEKVTQQLMLSFSQM

SEQ ID NO: 177944 - protein, 147 aa, Glycine max
  Coding DNA Sequence Number=SeqID_86259
  Gene Ontology: Mol. function=helicase activity; Biological process =protein amino acid phosphorylation
  Homolog annotation: Hit_ID=A2Q378; Match level="QueryCoverage=100%, HitCoverage=9%, E-value=2e-38, Identity=50%"; Hit description =Putative uncharacterized protein
  Pfam annotation: Domain name=DUF889; Domain location=2-147; Score =93.5; E_value=6.7e-25; Accession=PF05970.5; Description=Eukaryotic protein of unknown function (DUF889)
MVFGGDFRQILPVIPRGSRSDIVNATINSSYLWNHCHVLTLSKNMHLEANIDATDREETSASAQWILDIGDGIVGQQNDGYGSIEIPKDLLITKYDDPLYAIVNSTFPNLSHHHNNHEYFQSTAILASTNEIVQQVNDYILSLIPGE

SEQ ID NO: 177945 - protein, 95 aa, Glycine max
  Coding DNA Sequence Number=SeqID_86260
MDEDQWRYDFAMSQEVHMDYDYDNQEECGVNERHVDCSNAFNTSQGCVVVIMRSDTETGSRGRSSFVLIGCERSGFVGNQCVEGKLDGEVDLWDS

SEQ ID NO: 177946 - protein, 77 aa, Glycine max
  Coding DNA Sequence Number=SeqID_86261
MRIDEFCALCHSDFANWVINAHRRILRPLSFRDNKLGGKRAETNYAPFIIQEQNNKLGGKRAETDSAPFVIQISQVE

SEQ ID NO: 177947 - protein, 119 aa, Glycine max
  Coding DNA Sequence Number=SeqID_86262
  Subcellular localization annotation: CTP_CleavageSite=32; ConfidenceScore=5.21e-01
MGIAPTKTPSGPEEVQQGPGVSSSGYGPLSVLQGARTPPSKVMPSRHRDRARKTSSGLEEVQQGLGVVKALITGLYQFKGVPVAPSRVIRPPTDRAFIKKYCVPRQAQGETPQQHWDGR

SEQ ID NO: 177948 - protein, 110 aa, Glycine max
  Coding DNA Sequence Number=SeqID_86263
TRAFIEKYCTPRQAQGDDAPQAADDPPPPHQADPAGSLGMERYLQHLGQGFAPFACPTSEQFRAEVAWPEDWPEAQAGEVPAGSPGDVEEARMDEEMTNFLGFLGGSGAT

SEQ ID NO: 177949 - protein, 160 aa, Glycine max
  Coding DNA Sequence Number=SeqID_86264
SKHDSTQRLTSSSAPFVIQKAAGPMTCEEPFEAAGLMTCGYPHARKLVINAVALDESLRPLSFRTSELSDFSSWVINAQRQILRPLSFGDKTNYGHSVSRRPGSIVSNKMQRQIMVILRLVSTKRNKFDSSTGREVHWPNGPETCQKPKEKRCSTIREVQ

SEQ ID NO: 177950 - protein, 118 aa, Glycine max
  Coding DNA Sequence Number=SeqID_86265
MEKRFLAEGMEINLLIKNTLEASLKSFNDYVLFNVNMFMQQRLPPTIQPPPPPPTTIFASTSNKNLIHLLAKPISRLSEPSAERTTLAAERTTPAAEREEESRRRMSWTHALSKGSSR

SEQ ID NO: 177951 - protein, 308 aa, Glycine max
  Coding DNA Sequence Number=SeqID_86266
  Pfam annotation: Domain name=RVT_2; Domain location=55-172; Score= -174.6; E_value=0.0033; Accession=PF07727.5; Description=Reverse transcriptase (RNA-dependent DNA pol
MEEAIHVRFNDNKLDITMSELDESFAEMKIENIVKSAAVSNQDKHAFKSLDKVQIRNSLKHTTLLLEIKPKHIEFLKGKYVGAKWVFKNKLEKTGKVMGNNARLVAKGYSQQDAYVGRVQNEYDGRIEVLPWTLNQASGRRNMHTSNHVVKKLLKKFKVDDAKHMKTPMHPTIVLGLDDESTKNPTQTIQVELDFKNNPPSASFDEGEALQIARPAPVTIIVVEVSLKDKEPNVHIEHFFDIESLENDGYMINAHLMLCGIHHFFEDPKLSIDTITQTIGCEHKGTKFMNSWGNEIEEHIGHSLWGPN

SEQ ID NO: 177952 - protein, 144 aa, Glycine max
  Coding DNA Sequence Number=SeqID_86267
  Pfam annotation: Domain name=G-patch; Domain location=26-70; Score =30.9; E_value=4.5e-06; Accession=PF01585.14; Description=G-patch domain
MAFQSFEVVSNALVESLPMRPCMSDATMMVAHVMLGHGYKPGMSLGRNNDGMANLVEIKENRRRFGLGYRPTHADVRISALERSRGMGQQQRPQVKEAHPCHISKSFVSASWRCEEQVSMIHDEAPQDHSNWEQLCLPDFQLGN

SEQ ID NO: 177953 - protein, 75 aa, Glycine max
  Coding DNA Sequence Number=SeqID_86268
MADEPRRVTLEDYSSTFVPQFFTSIVWPKVQAQNITYPYSLIQLIQNNLFHGLPNEDPNAHLATYIEICNTIRIA

SEQ ID NO: 177954 - protein, 356 aa, Glycine max
  Coding DNA Sequence Number=SeqID_86269
  Gene Ontology: Mol. function=hydrolase activity, hydrolyzing O -glycosyl compounds; Cellular component=extracellular region; Biological process=polysaccharide catabolic process
  Homolog annotation: Hit_ID=P29024; Match level="QueryCoverage=76%, HitCoverage=90%, E-value=1e-122, Identity=75%"; Hit description =Acidic endochitinase precursor
  Pfam annotation: Domain name=Glyco_hydro_18; Domain location=28-285; Score=216.8; E_value=5.2e-62; Accession=PF00704.19; Description =Glycosyl hydrolases family 18
MASLKQVSPLLLLFPLLLISLFKSSHAAGIAIYWGQNGNEGSLADACNTGNYQFVNIAFLSTFGNGQTPQLNLAGHCEPSTNGCTKFSDEIKACQGKGIKVLLSLGGASGSYSLGSAEEATQLATFLWNNFLGGQSSSRPLGDAVLDGIDFDIEAGGGNHWDELARALNGFSSQKKVYLAAAPQCPIPDAHLDSAIKTGLFDYVWVQFYNNPPCQYSSGSTNNLINSWNQWTSSQAKQVFLGLPASTAAAGSGFVPADVLTSQVLPAIKGSAKYGGVMLWDRFNDGQNKYSDAIKGSMDTTITQLSPSCNTAVEPPRRSPPEPIEKNEIEDERDEDYSNTENHKKRKRPKAKTAPG

SEQ ID NO: 177955 - protein, 185 aa, Glycine max
  Coding DNA Sequence Number=SeqID_86270
GKIKRKTPEEATELIENMSASDQAILRDRVHQPTKKSLLELSSQDAVVPYVVVLMNPAFAFLLKIKCNRLAAWGINKGKDTIKVDSQGGPSNRPPQQGPNIFQRTTKLEETLTQFMQVTMSNHKSTESTLKNLEIQGLRDRGSLVVKKSKHKGRVVLVWFRTCKGLLQDSGTLKRVAWGLDVGTR

SEQ ID NO: 177956 - protein, 92 aa, Glycine max
  Coding DNA Sequence Number=SeqID_86271
MVIDYTFEKPFSEIFGLLVINYYLLIGRGKKENQQPLSLTSLTNLHLECDCFESETASSVGVVALGDLVTAATLVAVDVVELLIDGGGEDPV

SEQ ID NO: 177957 - protein, 189 aa, Glycine max
  Coding DNA Sequence Number=SeqID_86272
  Gene Ontology: Mol. function=RNA-directed DNA polymerase activity; Biological process=RNA-dependent DNA replication
  Homolog annotation: Hit_ID=Q0ZCD0; Match level="QueryCoverage=95%, HitCoverage=16%, E-value=2e-10, Identity=27%"; Hit description =Integrase
MDRSMIDAASGGALGDMTPVEARNMIEKMASNSQQFSARNDAIVLRGVHEVAMDSSSSAENKKLEGKLDALVNLVTQLAINQKSAPVARVCGLCSSADHHTDLCLSLQQSGVNEQLEAYAANIYNRLPQQQNQQQQNNYDLSSNRYNPGWRNHPNLRWTSPPQQHQSIPRFHNATGLSKPYVPPPMQQQ

SEQ ID NO: 177958 - protein, 307 aa, Glycine max
  Coding DNA Sequence Number=SeqID_86273
MASRKRKSIGARPIAQYDTGQFHSLDAWNRYTYNVLGRSILPERKVEIYHTEFDDFKTELERRNLHKRLTNLADGTIDVALDPSPKQARVRGHLVKIDADSLNTFLETPVVLEEGETLPTYSRYCRILMKDLTTLAQVWSVLSYSNLASTSHTSDLTVDRARLIFGLVSHMDMNIGALISRQMTSIAQSNSCRLRFPTLITALCRARGVVSDSLTFERLSPAINLAYIRNNYWNPFIWFKAIYPKFGGVNRDSALALGNTGRLYFSKDMQQKVCVVPTLSLHSSGLVLSAKAIRQQLVGISQRIEAL

SEQ ID NO: 177959 - protein, 108 aa, Glycine max
  Coding DNA Sequence Number=SeqID_86274
MTRDNPSDLEPLDPEIDRTFHRLVRHHFIPFEHPEHFIGDFEHPDFEYYNVEHSENMAQPPPRERTLREMDAPDFTYESLCIQYPDEDVPYVLKTGLIHLLPKFHGLA

SEQ ID NO: 177960 - protein, 118 aa, Glycine max
  Coding DNA Sequence Number=SeqID_86275
MENNDATRKQRLKCLNKRCSRERKLIAHYRHLLKDPNGQIMEKRLVKLQTKFREDPTVNEGWEAFLPRQLHVVFSRSFIKRLLEHSKYLLKDPNGQIMDKCLVKFQIKFREDPTFNEG

SEQ ID NO: 177961 - protein, 680 aa, Glycine max
  Coding DNA Sequence Number=SeqID_86276
MGSNQTPLLKKRFYQGKIKSLEVASLRELGQLMGQLQRQAFRKTYRNIWDLAMVEVSVEAIASLAQYYDHPLRCFTFGDFQLEESHISLEEKAKALADKGEWASFIEILALLIFVVVLFPNVEGLVDLAAIDAFHAYHHSKESPVIAILVDVYDTFDRRCEKSHRLCTKKGKEKWEQLLASVVGASINWFPRWKEGRTGLGYPMEGAPSEESITPFIAQGFSDPNARVLQGVRMAWGAVQSKDKELRGSSNGIVGGYHKWLRVRTQELDWLPKLKAAREEEAETSKESEEVQTLNAELERAQVVKEKFKSTAIKVRKEYNELRDINMTTTEALERETKRSRKGSVAGRRHDLERRVKGLPKVEKKLVQAYKEKLSLAATHEQRLEDEYAKVSVLQAEREARERVIDSLHREAMMWMDRFTFTLNGSQELPRLLAEVKAMADVYSAPEETRIMGDVDEVQEQMKADMVALKDQMASMMEVMLSMKRLIESNAVTAATAEIDPTHLSAMNQILGSTGGPHLGYNRNVYPYGLPPNFTPPTMHENVDHAIPITFEGQLPQPIGGTREKPQERAQVDVDSYPPFTVEGLTFHAMPQPNTAEASQPCSIQPLHFFVEGPPLVAEGKGKLDLIEERLRAVKGSGGYLFANMTDLYLVSDVVILPNSRDEKLLMHFFQDSLVGAANT

SEQ ID NO: 177962 - protein, 264 aa, Glycine max
  Coding DNA Sequence Number=SeqID_86277
  Homolog annotation: Hit_ID=Q2HW90; Match level="QueryCoverage=91%, HitCoverage=52%, E-value=8e-23, Identity=28%"; Hit description =Putative uncharacterized protein
MVEVSTEAIASLAQYYDQPLRCFNFGDFQLTPTVEEFEEILGCPLGGRKPYLFSGFYPFLARISKIVKISAQELDRGKQVKNGVVGVPRKCLDAKARVLASQVIDAFLAFYNRKESPIVAILADLYDTFDRRCEKSNARIIFCTPTLYVWLVSHFFRQEMRHVCLLEGHRSCTEKKEANLDRLLASKEGVSVNWFPRWKEGRTGILISCGKFPNVPLMGTRGCINYNPVLAIRQLGYPMRGVPSEEGLIPFITRGFNSTNVGVL

SEQ ID NO: 177963 - protein, 167 aa, Glycine max
  Coding DNA Sequence Number=SeqID_86278
ASAGGKIKLKTPEEAMELIENMAASDLAILRDRTHEPGQYTIQHDPSQEINYMGNPNRHGFQGYNQGNPSGYNNGPPGFNQGRNFNQGSGWRNQGNQYKEPRNQPPYQHPSQGPSQQEKSSLSIEEMLLSFIQETRASTEETKAFIQETRSHQKSTDAAIRNLGDTT

SEQ ID NO: 177964 - protein, 120 aa, Glycine max
  Coding DNA Sequence Number=SeqID_86279
MAAQLIRDRVEMECLEGAWETLEGNTRCRFRGTIRFTATSWCIQMNLHGRFSALWRLEELPPEPAVDALDFLEGDEDPLLEVDSPEEVMSASEADSTEDSRPEGDGDQRRLFVLVDSFLD

SEQ ID NO: 177965 - protein, 188 aa, Glycine max
  Coding DNA Sequence Number=SeqID_86280
  Subcellular localization annotation: CTP_CleavageSite=38; ConfidenceScore=5.28e-01
MAGGQAGAGAEPTPGTAAGAAGGRRRQRRHRLPRRRRRAGGAVHQPDAAPGHSAPRLGYPLRALSAAFSHSPAHRRRAANPRLAVTPADRTPHRPAEDPRPAGYRRAPSASGRAAQPDAGRRALCHAYRHSADATRRKGGAARSAGRTAGAAAGSTGHEPSGSGALRGGAGLPARFDPGDRPDRQRQD

SEQ ID NO: 177966 - protein, 119 aa, Glycine max
  Coding DNA Sequence Number=SeqID_86281
  Gene Ontology: Cellular component=cell outer membrane
  Homolog annotation: Hit_ID=A2XXY5; Match level="QueryCoverage=100%, HitCoverage=52%, E-value=5e-60, Identity=89%"; Hit description =Putative uncharacterized protein
  Pfam annotation: Domain name=MipA; Domain location=4-119; Score= -55.8; E_value=0.018; Accession=PF06629.3; Description=MltA -interacting protein MipA
MAGDFSLGAGAVFNESPYKGYNENTTAVPLISYEGDRFYVRQTTGGWILWKDAKNEFSLTASWMPLHFDPEDNDDHQMKKLDERKASAFLGGAYYRHESWGSLKVAVAGDAMDESARIL

SEQ ID NO: 177967 - protein, 186 aa, Glycine max
  Coding DNA Sequence Number=SeqID_86282
  Pfam annotation: Domain name=Transposase_23; Domain location=47-117; Score=-1.4; E_value=0.0017; Accession=PF03017.5; Description =TNP1ENSPM transposase
  Subcellular localization annotation: CTP_CleavageSite=30; ConfidenceScore=5.20e-01
MASFGQMQSQMQSQGLPLPPEPLVGPSGPRVSTKGSCVDPSGNYPETGDSDRCSLYIEADSACLVALGRVNEGSTVVHNTPLLSDQVKVGVEEVTDADDLVPVPTHEVSLVGQAMHTFLAWPTHLVKSLSQQTAVSPAKPPQKSDLEVDDPLYLMTLAIPELFLKPYQVTWDATVFGVFNQTSRST

SEQ ID NO: 177968 - protein, 167 aa, Glycine max
  Coding DNA Sequence Number=SeqID_86283
MSIHVAQLIADVIYLLQSFGVPVAPSKVIRPPITRAFIDKYCTQRQAQGDAPQAADAPPPHQAGPAGSFDTEQYLRHLVRQQAANHRANVQTHDCLYQLSLSLQSQGFTSFPCPTPDQFRAEVAWPGDWPEAWAGEAPAEAPDEADEAREDEEMTDLLDFLGGSGAT

SEQ ID NO: 177969 - protein, 226 aa, Glycine max
  Coding DNA Sequence Number=SeqID_86284
KDHGQGILGVTSSKPKDDKGKAIEKQAPKTSMQEKTSSIKSFKCLGRGHITSQCPTTKTMIMRGQDIYSSQDEATTSPSSSESEEAKGEEFSEEIYPQEDGQPLVVKEKCKETLASIATPLGLEFIPQVKKLLDEGLVRKSLNPCALLVPKIGVPMNPKRIKVIPEWPIPPTPLIELVRNHVLSWEDAQEMGVEGKSPEYEEPRDLRSNPFQGGGNDAILLRKGIG

SEQ ID NO: 177970 - protein, 49 aa, Glycine max
  Coding DNA Sequence Number=SeqID_86285
MEVEEPWLGLWLPLHYRADKGASLVVDLGVAFADDWAFLTGRVVGNEKD

SEQ ID NO: 177971 - protein, 176 aa, Glycine max
  Coding DNA Sequence Number=SeqID_86286
  Gene Ontology: Mol. function=endonuclease activity
  Homolog annotation: Hit_ID=Q9AY32; Match level="QueryCoverage=35%, HitCoverage=95%, E-value=1e-26, Identity=96%"; Hit description=RRNA intron-encoded homing endonuclease
MVVTGDGELGWTLGWVDRSASGVHRSARPFCRRCAPVLNWPGRASGAVYFEEIRVLKASLRSVYISMGITPQDSDPIVLAFGIGVMINRDNEQLRKAFAKDVFINQERKLGARRRSDTVLVSTINDADQGSADVAFRTPLAPYEKSKSLGSGGSMVARLKLKGIDGRAPPGVEPAA

SEQ ID NO: 177972 - protein, 46 aa, Glycine max
  Coding DNA Sequence Number=SeqID_86287
NGIREKVTSLWRAEWKVFGSKFECVRMKNEDDNNGVQVRLKNEGLE

SEQ ID NO: 177973 - protein, 167 aa, Glycine max
  Coding DNA Sequence Number=SeqID_86288
MGEVEEVQEQMKADMDAMKEQMATMMEAMMSMKKIMEANAVAVSATSVVAKVNPTPPSGLNQMNHPTSNMVGKELGEQEVGGIPLQNTLEGPQYHPQPHPLHSTASKNPYAMAEMGKLDHLEERLRAIEGGEDYAFANLEELFLESNIITPPKFQVPNFDSTRDYLP

SEQ ID NO: 177974 - protein, 111 aa, Glycine max
  Coding DNA Sequence Number=SeqID_86289
IRRSKSPAFVNHPTFCYRDPRVRWHAETPDGNPHTPFAIQQPESPIACGDTLRLSAPCHLETPSLIDKQRPMWSSAPFPKMSASSGRDYFSLTPLSQELRWSEFLIAIEDT

SEQ ID NO: 177975 - protein, 53 aa, Glycine max
  Coding DNA Sequence Number=SeqID_86290
MARTRGLGCAIGRLVGRDRHDDHDAADVPERRRPTTSAHRQRVHQMAAEGRDM

SEQ ID NO: 177976 - protein, 115 aa, Glycine max
  Coding DNA Sequence Number=SeqID_86291
MSLPSAVHVFSIIKREVSDDWETRYSVVFRIGSFVKFVRKKEGVETRVVITERAGRTKSLSYLCFPLISDERGGANSNKVHLGPPEDSSRRLLLLEEATLLAWASWAASFSPILL

SEQ ID NO: 177977 - protein, 88 aa, Glycine max
  Coding DNA Sequence Number=SeqID_86292
MYDTNFAPLGDESRGDHEISACNDFVVPGEQKNDQTWSLRAIGTQLCLPSKGVQITVRYLRVSCVQNDQTWSLRAIGHNCVCLAKGCR

SEQ ID NO: 177978 - protein, 120 aa, Glycine max
  Coding DNA Sequence Number=SeqID_86293
MVKGTRYMKNCHSLYLLTSTAEFFSSNERELLGAPNNIAGAPSNLLKGQFCPSFKNIKNFIPLSEAFCLLSSAKKLFSSLLSSAKKHSVFFSSSPRGFSGFIFSARLVFHLHFEVGGLSS

SEQ ID NO: 177979 - protein, 66 aa, Glycine max
  Coding DNA Sequence Number=SeqID_86294
MDLIENMAASDIAILRDRAHIPTKKSLLELTSQDALLAENKLLSKQLETLTETLRCTLDGGAHESG

SEQ ID NO: 177980 - protein, 199 aa, Glycine max
  Coding DNA Sequence Number=SeqID_86295
  Gene Ontology: Mol. function=structural constituent of ribosome; Cellular component=intracellular; Biological process=translation
  Homolog annotation: Hit_ID=A7QF16; Match level="QueryCoverage=100%, HitCoverage=100%, E-value=1e-59, Identity=55%"; Hit description =Chromosome chr16 scaffold_86, whole genome shotgun sequence
  Pfam annotation: Domain name=Ribosomal_L9_N; Domain location=27-63; Score=28.6; E_value=2.4e-05; Accession=PF01281.10; Description =Ribosomal protein L9, N-terminal domain
MGYLQFGRHGVRQVLRFRDASCDNVVDIDKLGKAGDTVKVAPGYFRNHLMPKLLAFPNIDKFAYLLNEQRKIYQPTEEEKQEDVTLVKESKEDMMKEYEKAALRLDKAQLVLRRLINVQKAKSRESKEDPLELRYPVTKDTLVAEVARQLCVNVAPDNLHLPSPLSTLGEYEVPLRIPRSIPLPEGKVNWSLKVKVRSK

SEQ ID NO: 177981 - protein, 67 aa, Glycine max
  Coding DNA Sequence Number=SeqID_86296
MTFHREQGKQKYSVVRSRLLKVNTMHYLMQSYPARALDRRLQVDWVRDAREGPRVLMSLRVDFGPMG

SEQ ID NO: 177982 - protein, 78 aa, Glycine max
  Coding DNA Sequence Number=SeqID_86297
MKKGEIVEAMSSKRVHLLGDCYTENKKGYISCGSIQVEGTSTWVFKENKGGYIPCGSLACKGFYKVERNLKNRRLLGD

SEQ ID NO: 177983 - protein, 186 aa, Glycine max
  Coding DNA Sequence Number=SeqID_86298
LQFVPSVVRLMKQANVFPLKNTLKKFTIWEINRDKDILKEDFQASSRVLLMNKDNGDHTLPIQQGPNIFQRTTKLEETLTQFMQVTMSNHKSTESALKNLEVQAKDKDNVESKKKVAEKKSTDEKKDDAREKKREKAMNEGAEVPYPVVPSRKEKDRHLARFLDIFQKLEITMPFREALQQMPLYS

SEQ ID NO: 177984 - protein, 75 aa, Glycine max
  Coding DNA Sequence Number=SeqID_86299
  Subcellular localization annotation: CTP_CleavageSite=40; ConfidenceScore=5.74e-01
MSFPIAVHVSSTFESGAPRMSLPSAVHASSTQTPSMSLPSVVHVSSTFESGAPRMSLPSAVRQFSILHFFSEPHE

SEQ ID NO: 177985 - protein, 223 aa, Glycine max
  Coding DNA Sequence Number=SeqID_86300
  Homolog annotation: Hit_ID=Q5NRP4; Match level="QueryCoverage=40%, HitCoverage=5%, E-value=2e-07, Identity=35%"; Hit description =Putative gag-pol polyprotein, identical
MELLFLRAELRVEERTSIARFLSGLNMEVRGKVKLLPYRELDELVQFCIRGEQQLKRKPSSKSYEFHSYRRKDQAQGILGAAPSKPKEDKEVTLPLIAPTKKTMIMRGQDIYSSQEETTSCPSFSGSEDEVRGEESSEEAYPHEEGDLLMVRRLLGGGQRSLTMKDKRDQEEKLENQKKRKDSKALSSKAKGKEKEEKDSSKKIVKKENHFATKCDIKKSTPS

SEQ ID NO: 177986 - protein, 84 aa, Glycine max
  Coding DNA Sequence Number=SeqID_86301
  Pfam annotation: Domain name=ubiquitin; Domain location=8-75; Score =7.4; E_value=0.048; Accession=PF00240.14; Description=Ubiquitin family
MKVKFEVTGIRDAVTIDVCSSDKVIDLKEKVRYCTLIPINKKKLIFNGQVLEDIYDVGNILIFEGESIKVHAGPQMCIQSQILK

SEQ ID NO: 177987 - protein, 41 aa, Glycine max
  Coding DNA Sequence Number=SeqID_86302
CRKVVFYAIFITKHFKIVMSYPNFVRGPLLDDMRLLFGPCK

SEQ ID NO: 177988 - protein, 60 aa, Glycine max
  Coding DNA Sequence Number=SeqID_86303
GQLSYPNFVRGPLLDDVRPFFGPREKAVASGGKQPLLALGRAELAWVAGAASILPYFAIK

SEQ ID NO: 177989 - protein, 67 aa, Glycine max
  Coding DNA Sequence Number=SeqID_86304
MPEESEEVQALKAELEKTRVAKEKLKVAVTRVRKECYELKDINMIADEALEQEMKKVRKEEWSRKKF

SEQ ID NO: 177990 - protein, 69 aa, Glycine max
  Coding DNA Sequence Number=SeqID_86305
  Subcellular localization annotation: CTP_CleavageSite=63; ConfidenceScore=5.47e-01
MGVQIATGPTWAFQKIPPEGGCFWRKQPRSPGRAGKSKPRRFRNVSVGDFAKVFNRSLMFFIRSSVFNR

SEQ ID NO: 177991 - protein, 109 aa, Glycine max
  Coding DNA Sequence Number=SeqID_86306
MLKVAVPPYTILNTVNAKDQIYGEVSMSFAVRWKDLLDCFWLFIVKDENFHTVVYNQDLDKPAIVAGWTTLRDFYHLTGDHQGSLTYYGRSVFFLTLFKSSSLPKSFPR

SEQ ID NO: 177992 - protein, 183 aa, Glycine max
  Coding DNA Sequence Number=SeqID_86307
MASKKIKEPATPSQVWERYTETIVPRKLLPERNVVIYHIEFDEFKEELERRKWDEELTSFDEGSIDVAIVKEFYANLYDPKDKSPKQVRVRGHLVKFDEDTLNTFLKTPVIIEEGETLAAYSRFALLRPDPQELAANLCIPGRGFELNVDGQPLKILKKNMTTLDGHESGLPHLSPDFYHCPA

SEQ ID NO: 177993 - protein, 138 aa, Glycine max
  Coding DNA Sequence Number=SeqID_86308
MAVKYLEAVKQRLHATKQWSPDEIRRNLSFRKKRKGIRSVNKLQCLESDKVGQPRHFPMPLRKSVYTDNHLGISACPLTSRVSIERNCLCGELLVYLRTSPNFTGQDNRKCGAVDKSEALAPTYPQFVTRNTDLRSSG

SEQ ID NO: 177994 - protein, 277 aa, Glycine max
  Coding DNA Sequence Number=SeqID_86309
AIGQLLGYPLVLEEGQECEYGQRRNRSDGFDEEAIAQLLCIPGQDFARIAAGRRVRIMRTNMTTLTQIWMTLLLSNILPSDHNSDLPLPKCQLVYAILTRMSVHVAQLIADAIYIFAGMAPTRHPLDPDKSNMALGFPTLITGLCQSFGVPVAPTKVIRPPITRAFIEKYCTQRQAQGDAPQAAGTPPPPHQAGQAGSFDMEQYLRHLMSLSMQSQGFASFSCPTPDQFRAEVAWPGDWPEAQAGEAPPEAPGDGEEAHEDEEMADLLDFLGGSGDT

SEQ ID NO: 177995 - protein, 80 aa, Glycine max
  Coding DNA Sequence Number=SeqID_86310
MAILIANTSTTFHRDEKLGNTHAMHGKCRQKRGALAPTYPPSKRKSDLRNSFLRVNQVILFTWKVVILRRWTLKMILFTW

SEQ ID NO: 177996 - protein, 85 aa, Glycine max
  Coding DNA Sequence Number=SeqID_86311
MVQPKPSTGLKGKSLQHALTFIPPHIQKSKAWVPIPKSCANTIEAFHRALGGRTFGYQQQGDKGNVACPSISKHNLGLRPSPTTP

SEQ ID NO: 177997 - protein, 103 aa, Glycine max
  Coding DNA Sequence Number=SeqID_86312
MGLIQRDCPYPKKKQNGGGLNDQTGHPKATGKVFTHNGVEASKSKDLIELSKDMMFISANQVVTSLKEDAQVYMIMSNLETKISMCDLPVVREFPEVFPEDMM

SEQ ID NO: 177998 - protein, 181 aa, Glycine max
  Coding DNA Sequence Number=SeqID_86313
  Homolog annotation: Hit_ID=A1IW39; Match level="QueryCoverage=38%, HitCoverage=98%, E-value=2e-17, Identity=69%"; Hit description =Putative uncharacterized protein ophh-69
MEDKLHRREGNSPDHQLRPLNDRSVIKEPPERVRNSSLIERSAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGLRKVVRPCMGADACPVPEGQG

SEQ ID NO: 177999 - protein, 178 aa, Glycine max
  Coding DNA Sequence Number=SeqID_86314
  Homolog annotation: Hit_ID=A5B939; Match level="QueryCoverage=41%, HitCoverage=53%, E-value=6e-23, Identity=69%"; Hit description =Putative uncharacterized protein
MSRGRASLQTQGASRASVVGADLGGSSKYSNENFEGRRGESLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 178000 - protein, 424 aa, Glycine max
  Coding DNA Sequence Number=SeqID_86315
MASRKHKSIDAWNRYTDNVLGRNILPERKVELYHTELDDFKTELERRNFHKRLTNLVDRSIDLALVKELYANLYSSEDPSPKQARVKGHLVKIDADSLNTFLEIPMVLAEGETLPTYSRYSRLPTDYKEIEAALCISGQGFILNAEGHSGRILRKDLNTLTQVWSVLSYSNLAPTSHTSDLTVDRARLIFGLVSRMDMNIRALISGQMTSIAQSNTSRLGFPALIIALCRARGVVSNMLTFECLSPIINLAYIRKNYWNPEDLTVYIRGARRARPVELPSTSTTPTPASTSVAPSVLAQILERVAWPGTQPSLHREDEGPKAQVPQHVEDESFEATIPEPFTIEEEAGEAQDRQEATATPERSREVTSDPPTPMVDLSSPQHAADPSIPILEIPEDPATPVLTLNTSPPATPVLHLTDEEDVQT

SEQ ID NO: 178001 - protein, 196 aa, Glycine max
  Coding DNA Sequence Number=SeqID_86316
MELEQLDVKTFFLHGRLENNILMQQLEGFEKEMSQKHENGGVSSIGPIWAHLEDYGHFVASGGSNPGKLHQEATSSASWAGLSTLGIQNSLKISEKKKKEKIKAEELSYRFRDVSVINFVDVLHRSSFILHPSSIFNQLAFDFEALNSFYAPFGFHSCFVCLHLYSSTLVQLRILRSKSPTFVDPKMGEIVKGPTP

SEQ ID NO: 178002 - protein, 88 aa, Glycine max
  Coding DNA Sequence Number=SeqID_86317
MRRMMYVAPYPTKGGQGEMDKPKRSSPREKTSGVATIVYSRKTLEKPKRDLQILKIRVRELFTHEEGSTRGLPLLLRILRCDEEFRPT

SEQ ID NO: 178003 - protein, 129 aa, Glycine max
  Coding DNA Sequence Number=SeqID_86318
MSSIIYAFKRRQCLHLHFEDNNVFGHLCFQKATMPSFTFQMTTMSSTIYAFKDDNVEKNAENTQKGGQKGHFHTFSDLWLTQASLWLTWATKITSWGSVIGLKERGYKVQRSRIEKKEEKRRRKKIKRS

SEQ ID NO: 178004 - protein, 83 aa, Glycine max
  Coding DNA Sequence Number=SeqID_86319
MAPKKLLSKRARKDAAGEGSSVAPQADIEFDGHRFRSEEHQQCFEAIKGWSFLKERRVQLREGEYTKFHEEVAVEASFMMNQD

SEQ ID NO: 178005 - protein, 274 aa, Glycine max
  Coding DNA Sequence Number=SeqID_86320
MAKYDSEVVMEFYANAWPTEEGVRDKCSWVWGQWVPYDEDAINQFLGHPLVLEEEQDCEFSERRVQASGFDQEAIGPMAKYDPEVVMEFYANAWPTEEGVRDKCSWVWGQWVPYDEDAINQFLGHPLVLEEEQDCEFRGHRPAAVHFGIGLCKKHDRKADLDDAAPQQHPSSDHNSDLPLPKWITPPRHPVDPEKSNKALGFPPLITGLCQFYGVSVTPTKPIRPPINRSFIEKYCMPRQAQQPGQDQQQQLAADAPLPPLQQPLSLESISSHI

SEQ ID NO: 178006 - protein, 92 aa, Glycine max
  Coding DNA Sequence Number=SeqID_86321
MPMIARNKSVEVICLCKISIDSLSASDSLSEHSVTFEFFRIQTCALSGTDLLSPIQKLENPRRFWAQRTGARLASYAALIGLQVLLSGTWLA

SEQ ID NO: 178007 - protein, 142 aa, Glycine max
  Coding DNA Sequence Number=SeqID_86322
MASRKKSSTSRPQEPYDTTRFVSDVSWERYEQNVHSKNILPKRNVDLYVTQYDEFRKELERRRWHKALTRQSNGHIDVALVQEFYANLFDLEDKYPRQVRVWGKLIKFDAETLNTFMETPMVLEPGERYSTYSRFCHAHPDP

SEQ ID NO: 178008 - protein, 420 aa, Glycine max
  Coding DNA Sequence Number=SeqID_86323
  Gene Ontology: Mol. function=adenosylmethionine-8-amino-7 -oxononanoate transaminase activity; Cellular component=cytoplasm; Biological process=biotin biosynthetic process
  Homolog annotation: Hit_ID=A6T6L4; Match level="QueryCoverage=89%, HitCoverage=87%, E-value=1e-143, Identity=67%"; Hit description =Adenosylmethionine--8-amino-7-oxononanoate transaminase
  Pfam annotation: Domain name=Aminotran_3; Domain location=9-353; Score=490.4; E_value=2.3e-144; Accession=PF00202.12; Description =Aminotransferase class-III
MRDPLPCYPVVAAHGCTLQLADGRELVDGMSSWWAAIHGYNHPRLNQALQQQMAQMSHVMFGGITHPPAVELSRQLIAMTPEALECVFLADSGSIAVEVSMKMALQYWLGRGETRQKFLTLQRGYHGDTFAAMSVCDPENSMHSLWRGYLPEHLFARAPQCGFDDDWDDNDIADFARLAEQHHRSIAAVILEPIVQGAGGMRFYHPRYLQQVRALCDRYGLLLIADEIATCFGRSGKLFACEHAGITPDILCLGKALTGGTLTLSATLTTRDVADAISRSAAGCFMHGPTFMGNPLACAVAVESLKLINEGHWPVQVAAIEQQLRTELLPLRDHPMVADARVLGAIGVIETHQPVNMAALQQFFVERGVWIRPFADAADGGVERCTGGGRPLSALTPLALAAIFHHHGKQYTTEKERSCA

SEQ ID NO: 178009 - protein, 328 aa, Glycine max
  Coding DNA Sequence Number=SeqID_86324
  Homolog annotation: Hit_ID=Q652R5; Match level="QueryCoverage=28%, HitCoverage=38%, E-value=4e-21, Identity=58%"; Hit description =Putative uncharacterized protein P0603C10.50
  Subcellular localization annotation: CTP_CleavageSite=47; ConfidenceScore=5.58e-01
VSSGFAPLRHSSPSFGSRQVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNYRPIGAAFPNNPTRRQRLVGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHT

SEQ ID NO: 178010 - protein, 97 aa, Glycine max
  Coding DNA Sequence Number=SeqID_86325
  Homolog annotation: Hit_ID=Q6WAY6; Match level="QueryCoverage=67%, HitCoverage=11%, E-value=1e-08, Identity=40%"; Hit description =Putative uncharacterized protein
MEDAPVSPRVEGLVCPLQGHRMCAKKLKENWEELLVGMVGASVNWFPRWKEGGAGVLCSYEGFPNVPLMGTMSCINYNPILAIRQLGYPMRGAPIGR

SEQ ID NO: 178011 - protein, 228 aa, Glycine max
  Coding DNA Sequence Number=SeqID_86326
  Homolog annotation: Hit_ID=UPI0000384089; Match level="QueryCoverage =38%, HitCoverage=28%, E-value=8e-07, Identity=43%"; Hit description =COG0201: Preprotein translocase subunit SecY
PPRVPGARPGGLPFGYTHPRSGYQPGRAGGPVPPEPGRDPGPVQHVLGRGALALLDFCPGDHAVHFGIHHHAVDVGGGAVAGSAQERGRGRSSEDYPIHPLRHGRAGADHGTRSRQRDFHPDLRRYRGGSARGAGCTVGPGPHQRDVRAVGTVHRGSGGAGYRFCGVRGTRTAQDHGELRQASGRQQGLRWSELAPAAEAEHGRGDSADLRVVDHPVPGNDHELVLQQ

SEQ ID NO: 178012 - protein, 56 aa, Glycine max
  Coding DNA Sequence Number=SeqID_86327
MWTTTGTLADYIIIPFLTYGMLRNLTNCATMLPFKFRYVTELRKLPDDGCQVPPNG

SEQ ID NO: 178013 - protein, 178 aa, Glycine max
  Coding DNA Sequence Number=SeqID_86328
MVLGHFMCLPHGLRDMYMMRLLALNEYGSGVIDILIRNACHIGWCIVGRQAIWREGMLILNCHIMGPSIRWGHRVHLSNSAGSGNFNHIDFHNLLHAHHGLPIVGSQFHGSSGASFLTSSIHITLALALGVGVSRTKRSIYLLYAHNGAIQSLWSFSLSRPPCRPSFALAPPLLHPLL

SEQ ID NO: 178014 - protein, 54 aa, Glycine max
  Coding DNA Sequence Number=SeqID_86329
MAKNLHGITHRNVSDALQKRLGKWGRSLPPSSPRRARLLPLEATAFWRNILEGP

SEQ ID NO: 178015 - protein, 197 aa, Glycine max
  Coding DNA Sequence Number=SeqID_86330
  Gene Ontology: Mol. function=chitin binding; Cellular component =extracellular region; Biological process=chitin metabolic process
  Homolog annotation: Hit_ID=UPI00006A17C9; Match level="QueryCoverage =70%, HitCoverage=100%, E-value=4e-11, Identity=30%"; Hit description= UPI00006A17C9 related cluster
MNRWMTMKNLMLEDTGTPRSDRMGRGCHMIRTLLFAAAQVKSCPGMHSSCVIASLSYVLAQLGHRTLNSLKVWLWSPLKVRTRSSLKLVTCHPLKARASSPLKEGVCSPLKARTCNPLKVRTCSPLKVRACSPLKARTCSPLKVRTCSPQKVMVCSPLKVRTCSPLKVRTCSPLKVRACTQGSTLMRKQEIDSSRGP

SEQ ID NO: 178016 - protein, 174 aa, Glycine max
  Coding DNA Sequence Number=SeqID_86331
GLALPPKPKVGPSGARVSTKESCVDPSGNDPQTGDSDKCGLYIEENPSRLVALGRLYEGSTTVHNIPLLHGQVKVGVKEVKDSKAPIPVPTAEAAVSSAKPPERPDPEVDDPLYLMTLTIPQLFLKPLRVMWDATVFGVFNQNFLLHMTETSMQAGNSDVYGFLEPESIQRAGQ

SEQ ID NO: 178017 - protein, 54 aa, Glycine max
  Coding DNA Sequence Number=SeqID_86332
MGKTAYYGLKELHCGEVLFSVPVVQSLMLSWIWDFAGCGNYVWLLHLCRHCFSQ

SEQ ID NO: 178018 - protein, 223 aa, Glycine max
  Coding DNA Sequence Number=SeqID_86333
  Gene Ontology: Biological process=transposition, DNA-mediated
  Homolog annotation: Hit_ID=Q1J7G7; Match level="QueryCoverage=17%, HitCoverage=67%, E-value=2e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLNSMMEFRSCCPGWSAMARAWLTATSTSQTGFLHVEAGLELLTSGDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 178019 - protein, 295 aa, Glycine max
  Coding DNA Sequence Number=SeqID_86334
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDIREQLCGLGHVYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 178020 - protein, 202 aa, Glycine max
  Coding DNA Sequence Number=SeqID_86335
MCCIPPCWPAFLEARHRETRHEACHRQGRPPGGAGPGALPGAGRHGVRQLQAGHASRAAGAGLAAVVLPFPGGQGLGHLRGAGRPGPGAGHALAGAGHGAPLDAAPRAVPAGGRWHEPGDLSGRHHSLLRGLLRAGHRLAAGRRKGAAGRHGGRGHAVRLGLAAAGLQPGLGLGQPVLPGPVGAGRLCAQPAVQRLPSGAAV

SEQ ID NO: 178021 - protein, 76 aa, Glycine max
  Coding DNA Sequence Number=SeqID_86336
MGVLYEVTGWADMSCPSNLWPPSTALLATLSPVNFELGVIMVIAVSSLAECILAYYVGTDEGVSEVLHVAGEKGCT

SEQ ID NO: 178022 - protein, 652 aa, Glycine max
  Coding DNA Sequence Number=SeqID_86337
  Gene Ontology: Mol. function=carboxy-lyase activity; Cellular component=acetyl-CoA carboxylase complex; Biological process=sodium ion transport
  Homolog annotation: Hit_ID=A1FV67; Match level="QueryCoverage=57%, HitCoverage=68%, E-value=0.0, Identity=98%"; Hit description=Alpha subunit of malonate decarboxylase
EATAFGGGIVIAQVNEIVDTLPRVDIPADWVNFVVQAPKPNHIEPLFTRDPAQISEIQVLMAMMAIKGIYAEYGVNRLNHGIGFDTAAIELLLPTYAESLGLKEKICQHWALNPHPALIPAIESGFVKSVHSFGSELGMEKYIAARGDVFFTGADGSMRSNRAFSQTAGLYACDMFIGSTLQVDLQGNSSTATRDRIAGFGGAPNMGSDARGRRHASDAWIKAGQQAARPGEIPRGRKLVVQMVETFREHMAPAFVDRLDAWDLAERAQMPLPPVMIYGDDVSHVLTEEGIANLLLCRTPEEREQAIRGVAGYTAVGLGRDRAMVENLRDRGVIRRPDDLGISVRDASRDLLAARSVKDLVRWSGGLYDPPKRFRNWTHCGAVSARCGAGRRTGLGQPGNPAGAGGAGRRDDGAHHHRRTGLRQRVASGDQRLRRASSAARSCDWTRPWKPCSVEMHDEPDAAPQLLRSRCARAHRRVDRRGFVQRIPRPGAADDEPPPGAARSACGLDDGIVVGEATLQGRRVLLAAQQGEFMGGGVGEVHGAKLTGLLRRAAATRPDGVLLLLDTGGVRLHEANAGLIAISEIMRATLAARAAGVPVIALIGSGNGAFGGMGIVARCCSTVIMSEEGRLSLSGPEVIETVRGVEEFEGIL

SEQ ID NO: 178023 - protein, 163 aa, Glycine max
  Coding DNA Sequence Number=SeqID_86338
LFEVALERSAPICASSSSTSVVYKSKGERKDIELVEEEHARIGADPSSETSNKSENYKDEARKKSQKHKPKRVESVNTDAEAFAEAVEHTNKRDTGHQNVALDNKTGDSTMLKMGDSAKVVIKQDMKGRRHKYGFNNNEREKAQKKRVVDDETADNHQLDEVL

SEQ ID NO: 178024 - protein, 241 aa, Glycine max
  Coding DNA Sequence Number=SeqID_86339
  Pfam annotation: Domain name=Transposase_23; Domain location=58-128; Score=6.4; E_value=0.00024; Accession=PF03017.5; Description =TNP1ENSPM transposase
MSITEKVTRQVMASFIQLQSQMQSQGLAVPLEPLVDPSGPRVSTKGSCVDPSGNDPQTGDSDRCGLYIEIDHVRLVAMGRVYEGSTIVHNTPLLPGQVKVSVEEVTDADALVPVPTDEVSLVGQAFHTFLAWPTHLVKSLSQQILIFLTIYTHFRFHCSRHWQMVVILPKEHLVVWFCSLYNRPDNYLKGIINSAIKGLDDAPQPKSKASARQKGSTECGYYVMHWMSTIILGTFRNNWEA

SEQ ID NO: 178025 - protein, 269 aa, Glycine max
  Coding DNA Sequence Number=SeqID_86340
  Homolog annotation: Hit_ID=A8AMR2; Match level="QueryCoverage=87%, HitCoverage=52%, E-value=6e-31, Identity=37%"; Hit description =Putative uncharacterized protein
MTTASQSDIFSPLIGSNGHYTLKADWLEGEFIARRKTGAAAPVGALQHDAAEQEAEYHGENHAHGAGNEERMVEHEAADTRGAGIVHLHRGDQRRVGRQDEQAGDGGEGGDGGQRRHVQRQRHRHQRLGGSGLRVQQRRAEEENHRQQPRVRLNDAAGRLFDPVDVGLHEGIAQPGDAEDTDTGAHAGLKGAGVQHHVGVDAAQQGGQRGDAQHDDQDGVGGVHQRLGHQAKTRAVDDGVSHYAQHAQQEQQHRGFGARFDLQRVVAAQ

SEQ ID NO: 178026 - protein, 88 aa, Glycine max
  Coding DNA Sequence Number=SeqID_86341
MAGAGDGGGDYHQLDGSQHLLLGAGDGGGDYHQMSFSLGSLLNQSQTYQGNPCDVYPDLSFFTGSGVIQISVACIKRSAPSQDHITIL

SEQ ID NO: 178027 - protein, 89 aa, Glycine max
  Coding DNA Sequence Number=SeqID_86342
  Subcellular localization annotation: CTP_CleavageSite=57; ConfidenceScore=5.14e-01
MACRKREVKPGTDPGSDDEAAKTGSGSFRRWHGGAVGSRFSRRSEPWSRRRKPPEMTAAVGGGRRTARRRTADGGRRDGGRRQPALMPS

SEQ ID NO: 178028 - protein, 98 aa, Glycine max
  Coding DNA Sequence Number=SeqID_86343
  Homolog annotation: Hit_ID=A7P5V4; Match level="QueryCoverage=78%, HitCoverage=17%, E-value=5e-13, Identity=42%"; Hit description =Chromosome chr4 scaffold_6, whole genome shotgun sequence
  Subcellular localization annotation: CTP_CleavageSite=84; ConfidenceScore=5.18e-01
MAPASARASHRSSAASGSEGLEVVAHVRKLSNESVGSNGSSIRGSDMSNFGIPNSSGNSSHDLPGSAMRRLGTAKTDMEDLIVRLNQEIAAKDFLATK

SEQ ID NO: 178029 - protein, 232 aa, Glycine max
  Coding DNA Sequence Number=SeqID_86344
  Subcellular localization annotation: CTP_CleavageSite=99; ConfidenceScore=5.14e-01
MEKDNGGKCVFLKLKFIATSETLRTPTTTPSPATPLLDFLATSFDLLRAWRISNRTLNPPCASNSKASTTATRTRCLKRRLWAFWFWDGIVEWVLTEVEVSTVVSSARIFSSTVGWFMMSQKNQLIAIDNVSLPARRKFSAICRSAATLSGFLAPSRFFMKERMVALEGEYNAREWIEMKPNWESQGTKVRPGEKLEEDVLAKNVGEGSWGEVVVEGVVGVGDGENGEGGAV

SEQ ID NO: 178030 - protein, 159 aa, Glycine max
  Coding DNA Sequence Number=SeqID_86345
MASRKRKAPSTPTQARFDRSRFTSQEAWERYTGVVVPCKLLPERNVVVYYTEFDEFKEELERCHWDEELTDFVDDNINVAIVRVRGHLIKFNEDTLNTFLKTPVVMEEEETLCAYSRFALLRPDPQELVAKLCILGRGFELNSDGQPLKILRKNMTMLA

SEQ ID NO: 178031 - protein, 161 aa, Glycine max
  Coding DNA Sequence Number=SeqID_86346
  Homolog annotation: Hit_ID=A7NX31; Match level="QueryCoverage=42%, HitCoverage=6%, E-value=2e-09, Identity=48%"; Hit description =Chromosome chr5 scaffold_2, whole genome shotgun sequence
  Subcellular localization annotation: CTP_CleavageSite=29; ConfidenceScore=5.17e-01
MSGSRKKLLLNTVSVKLGCSTCRRPNLCRIFHPKPKPKNLNNTYRKHKHSSSSSSSGQWGGEDKCDSTSTTPTPTPTNTTFSNPITASSQFSRGKNQVKASCNVGSWTTEMDSQPSDSAADVVDVNESGSSKLGGSEPEGDVLCLHDRLKWLDQQVIRKVV

SEQ ID NO: 178032 - protein, 120 aa, Glycine max
  Coding DNA Sequence Number=SeqID_86347
MICASLGRNYYQALDVVIFNAALFDFDGGFDVFAFADEEVPTKNLGEIVHHVVELLVLHAHQHAHREPELAGWNVGVTSDGAIAYSRRGGREGAAGGRTVHGSHLNRLAVNASRSLRVGK

SEQ ID NO: 178033 - protein, 621 aa, Glycine max
  Coding DNA Sequence Number=SeqID_86348
MGEVSIQSLGRLSVGRKRMRGKVVDYVNQQGGWDIDRIYYFLPPFALYPCLSYASFVERLEKRLHWVRCFIWMVLQDGLKMNVKREECGRFRLGLFNLYHFDMIAFFFVGLFDQVKVNLTKDPGDWRTLVNDIINRAIFTSMQTDQAMQVFVHKHPSLEGRLVAWQPPIEGCFKYNMDASIIQGGERGAYCGVLHNANSRTKRLRVSVVVIGPTDVDRGHKKTKASVVVTEPTEVGQGGTQPSSLECMSTKRLRAVWATEDFPRNETLGLETLCVGGEGGVVSRKGRNWGRVVWEGFEIEEELLLTTNGDDDMVIVLRFPLTAFKKWVLRKLNVALAIDGQGILTLYTTSYKNLKGRFFKALSVIDPEDIEFKKQLTLFATMFKYSCIIELEYRSVNLRVFIKKSSKKSMAPSRKAAAVTATAETTLVQGILEDSFTVAVEKPWSLEKSAILYVVKDRGRDLMKAKEALNVQKSRLAAEVKRLRKKAMDAKAKHIIFYQAKVNLEKEKQLLTEKENEILGSLAVVKKENEGMEVKVNPWKWNPRLLLMREKTSGVATNVYSRKTLEKPKRGVDKGVALAPIYPQAKGHLGAVAAHPGELKPNPEAVSLPRRAGARPSKLVT

SEQ ID NO: 178034 - protein, 234 aa, Glycine max
  Coding DNA Sequence Number=SeqID_86349
  Gene Ontology: Mol. function=phosphoprotein phosphatase activity
  Homolog annotation: Hit_ID=A5B5G3; Match level="QueryCoverage=24%, HitCoverage=3%, E-value=8e-12, Identity=61%"; Hit description =Putative uncharacterized protein
  Pfam annotation: Domain name=DUF1723; Domain location=27-72; Score =54.1; E_value=4.8e-13; Accession=PF08330.1; Description=Protein of unknown function (DUF1723)
MPSPDPIIEPLLVQAEFSDVAKLGQVKIDNALVIALVERWRPASHTFHLPVGECTITLKDVDLQLANSKIFLTQFATYPNVGATSRSTPNMETEQHPPQQSSSMAASMHDEGLPPHAQSYEFTPQFMPQPHHHQQDYKYNLKFFSANGEDFMSNLMGTDLRTLESLVEEQLVIPSLASFHQSMTNSSSTNDFVQEEPVVVPSEQVEPQQHGRVHRQSTRNRQPPRCGSGGPKRY

SEQ ID NO: 178035 - protein, 107 aa, Glycine max
  Coding DNA Sequence Number=SeqID_86350
  Subcellular localization annotation: CTP_CleavageSite=42; ConfidenceScore=5.21e-01
MSKEESNKVASKDKHGFKINTRLLQQTKPCFKINSSSSLALKQSAFKTFKALTYQGNPCGVCPDLSSFTGSGVYPDLSSFTGSGVIQNSTACIKRSAPTQVHIRSSL

SEQ ID NO: 178036 - protein, 53 aa, Glycine max
  Coding DNA Sequence Number=SeqID_86351
MYGKSRWLGLESVVRLLPQDVRWLFVWYCGLAWWLAETGQNWIVVDCGSEVVP

SEQ ID NO: 178037 - protein, 102 aa, Glycine max
  Coding DNA Sequence Number=SeqID_86352
  Gene Ontology: Mol. function=metal ion binding
  Homolog annotation: Hit_ID=A7R324; Match level="QueryCoverage=52%, HitCoverage=8%, E-value=5e-15, Identity=61%"; Hit description =Chromosome chr7 scaffold_476, whole genome shotgun sequence
  Pfam annotation: Domain name=zf-C3HC4; Domain location=30-79; Score =19.0; E_value=0.00063; Accession=PF00097.16; Description=Zinc finger, C3HC4 type (RING finger)
MQELPLPPNAIPPCRFINPLPLPQTHPQPSLFSNPPYAYPNVKTGEGKAIFTAECSHVFHFPCLAGHVKKHRMVTCPVCNANWKQLQQNADENKGNAELKTT

SEQ ID NO: 178038 - protein, 235 aa, Glycine max
  Coding DNA Sequence Number=SeqID_86353
MNSTSFQGLENQNTSESFWYKEEEEVQRDSRLVKDSFCSSHLSSSFVVIIVIIKTPLNHIHHEALLLQLALESRILHYLIVHILLSRSSNLAFEEDLIVMWTFQTYPHLVTLFLQHFNIPLDSEPYVPIKRSFLIVAAVVASFGYRKECDGSWVKKGAQPNDDEGHLLVEGDSSLLRSILDRFDGLQTYGCERFDSLERQEDTRFEEMNSRIAKVEEDVTIIHDCFDLPPPPPSV

SEQ ID NO: 178039 - protein, 299 aa, Glycine max
  Coding DNA Sequence Number=SeqID_86354
  Subcellular localization annotation: CTP_CleavageSite=41; ConfidenceScore=5.65e-01
MAESSKKRKGSFFTTTTTGHRRQGTSGNPPAPVPPSLSSLRSSTLFSLDDQRQRYYSQFCNRVILDPKYLDLEFFDEETFDCYQDGILYSEGTLVDDWKFDYSSHDARRIVCNDRHITYWDLILVWAFQTGRQIEWVHLVRYQMHKALRANAPLPYPHLVTLFLHHFNVPLDDEPFLKVKRSFSIGAGAVTSFGYRKDVDGQWVRKHDLPPPIPDERTPSPPPQQGDSTSLLTKVLTELRGLRAFVGERFNAMDTRFDAMDTHFDGIDTRITQLKDDKSFISTLIKLALDVYYSVLLYV

SEQ ID NO: 178040 - protein, 149 aa, Glycine max
  Coding DNA Sequence Number=SeqID_86355
MHTGHQILWAHLVHYRMDKALRANAPLPYPHLVTQLLQHFKVCLTNEPFVKIKHSVAIGVAVVASFGYKKDLDGQWVCKQDHQANAPEERTPSPPSRDPSPTLLNDVLNEIRDLRAFVGERFDSMDSRITRLEDDMGFIRRCFDPPTDP

SEQ ID NO: 178041 - protein, 224 aa, Glycine max
  Coding DNA Sequence Number=SeqID_86356
  Gene Ontology: Mol. function=tRNA dihydrouridine synthase activity; Cellular component=endoplasmic reticulum; Biological process =metabolic process
  Homolog annotation: Hit_ID=A7R326; Match level="QueryCoverage=100%, HitCoverage=68%, E-value=1e-101, Identity=82%"; Hit description =Chromosome chr7 scaffold_476, whole genome shotgun sequence
  Pfam annotation: Domain name=Dus; Domain location=8-224; Score=16.7; E_value=2.7e-10; Accession=PF01207.8; Description=Dihydrouridine synthase (Dus)
MEYRNKLVLAPMVRVGTLPFRLLAAQYGADITYCEEIIDHKMLKCERRINELIGSTDFVEKGTNNVVFRTCDEEKDRVVFQIGTSDAVRALTTAQLVCNDVAAVDINMGCPKSFSVSGGMGAALLSKPELIHDILTTLKRNLNTPVTCKIRLLKSPHDTVELARRIEKTGVSALAVHGRKVPDRPRDPAKWNEIADVVSALSIPVIENGDVFENDDVERIKSAT

SEQ ID NO: 178042 - protein, 271 aa, Glycine max
  Coding DNA Sequence Number=SeqID_86357
MSRKENLISELHPRKGTWKIAVCIIDMWDVKKHNVRQAIDMVLIDQTEVERPEIHANVHVITEIADIISGIAPRHTLVDKYPLSVLNIKNGSKLYVNSNDIAEIRKFRDSLCVPYYVGGVTKKGSGSQSQYTSNSQRSDRDKFLHNAQMVSLGDISRLREDCFCLIVAMVDEVLIDTPWSYVSYPNCTTTFDPLKIMGVCRSCQNQVSHTVPRYKLVLKWNTMGRKLTFIFGMQRVSKCSGGDEIKVFPECVDDLVGKTLALRFKYRVNMR

SEQ ID NO: 178043 - protein, 283 aa, Glycine max
  Coding DNA Sequence Number=SeqID_86358
  Gene Ontology: Mol. function=phosphoenolpyruvate carboxykinase (ATP) activity; Cellular component=cytoplasm; Biological process =gluconeogenesis
  Homolog annotation: Hit_ID=A7R2X4; Match level="QueryCoverage=57%, HitCoverage=50%, E-value=2e-48, Identity=66%"; Hit description =Chromosome undetermined scaffold_461, whole genome shotgun sequence
MPTSDYDGNGNGLTKIEVGDDEEGHPTVKAQTIDELHSLQKKKSAPSTPKGTFPASNSVFTEERNKQQLESISASLASLTRESGPKVVKGDPAARKFEGSRVEHVPHQILTPTIAVSDSALKFTHVLYNLSPAELYEQAIKYEKGSFITSTGALATLSGAKTGRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 178044 - protein, 91 aa, Glycine max
  Coding DNA Sequence Number=SeqID_86359
MEEEHPSEIKIKKTIAGIKEIKQMLQFMIKKKGIVLEFEKEDKQPMQTVPTLQLGMMAINPLLKYRLSSNPSNQSDVILTRSGSLDTGYKI

SEQ ID NO: 178045 - protein, 80 aa, Glycine max
  Coding DNA Sequence Number=SeqID_86360
MSYKKEPMKHRHGHWTRHRHMDTCNVQNIECSTGVVSVSDTDTDACRTPDTGLGMESREGKSISDLYEEICHKFRDFMTE

SEQ ID NO: 178046 - protein, 179 aa, Glycine max
  Coding DNA Sequence Number=SeqID_86361
  Gene Ontology: Mol. function=structural constituent of ribosome; Cellular component=ribonucleoprotein complex; Biological process =translation
  Homolog annotation: Hit_ID=Q9FUL4; Match level="QueryCoverage=41%, HitCoverage=37%, E-value=3e-22, Identity=72%"; Hit description=60S ribosomal protein L24
  Pfam annotation: Domain name=Ribosomal_L24e; Domain location=77-134; Score=62.1; E_value=1.9e-15; Accession=PF01246.11; Description =Ribosomal protein L24e
MRSFNGDFSPWRCSGRQRRREEGRRHPLGNKPWKKELHHQDEPWIRSLEGCFNGGKERGRERERGEHEIEGIKEGENPIYLESSSQCPCGVFLFANSKCKRYFHNRLKPSKLTWTVVYRKQHKKDIAQEVVKKRRRAAKKPYSRSIVGATLEVFLFANSKIEIKERIKKTKNEKKAKKA

SEQ ID NO: 178047 - protein, 292 aa, Glycine max
  Coding DNA Sequence Number=SeqID_86362
  Homolog annotation: Hit_ID=A7PC90; Match level="QueryCoverage=53%, HitCoverage=57%, E-value=3e-18, Identity=41%"; Hit description =Chromosome chr2 scaffold_11, whole genome shotgun sequence
  Pfam annotation: Domain name=VQ; Domain location=47-77; Score=42.3; E_ value=1.8e-09; Accession=PF05678.5; Description=VQ motif
MDESKNRHNDNLGVNKMGKNIRKSPLHQPNYGNNNNSSMNGGRQQQQQPQPQVYNISKNDFRDIVQQLTGSPSQSQDHPQSKPPQNQNNSPKPQSMRLQKIRPPPLPYVRPPLHTTLPAARPAHFRQQPSPNPNNIAESPISAYMRYLEHSITDPTSRGAQFQPHHHPASSALLPNPPMLPLNATNPLPPPPAIAAVPSPQPNGPPILPLPSPTSQFLLPSPNGYMSFLSPQYGYPPLLSPGFQFPSPFSPNFPFSPFAQSGILGPGPQPPLSPGLFPLSPSGFFPITSPRR

SEQ ID NO: 178048 - protein, 292 aa, Glycine max
  Coding DNA Sequence Number=SeqID_86363
  Homolog annotation: Hit_ID=A5AQZ6; Match level="QueryCoverage=89%, HitCoverage=88%, E-value=2e-29, Identity=36%"; Hit description =Putative uncharacterized protein
  Pfam annotation: Domain name=VQ; Domain location=47-77; Score=42.3; E_ value=1.8e-09; Accession=PF05678.5; Description=VQ motif
MDESKNRHNDNLGVNKMGKNIRKSPLHQPNYGNNNNSSMNGGRQQQQQPQPQVYNISKNDFRDIVQQLTGSPSQSQDHPQSKPPQNQNNSPKPQSMRLQKIRPPPLPYVRPPLHTTLPAARPAHFRQQPSPNPNNIAESPISAYMRYLEHSITDPTSRGAQFQPHRHPASSALLPNPPMMPLNATNPLPPPPSIAAVPSPQPNGPPILPLPSPTSQFLLPSPNGYMNFLSPQSGYPPLLSPGIQFPSPFTPHFPLSPFAQSGILGPGPQPPLSPGLFPLSPSGFFPMTSPRW

SEQ ID NO: 178049 - protein, 131 aa, Glycine max
  Coding DNA Sequence Number=SeqID_86364
  Homolog annotation: Hit_ID=A5AU60; Match level="QueryCoverage=76%, HitCoverage=10%, E-value=4e-10, Identity=32%"; Hit description =Putative uncharacterized protein
MCEQYLGVVSLKGEAIVGSAIKLKWLQDNMSSLPSEPTQQQLEAHCRVYILWLIGGVLMQDKMENWVHLMYLIVLDDLDRVRRWSGGGLRHGDVINYRMRLDYMTAEQFSWNPYLHFLDALESTTFVDSSI

SEQ ID NO: 178050 - protein, 294 aa, Glycine max
  Coding DNA Sequence Number=SeqID_86365
  Homolog annotation: Hit_ID=A5AQZ6; Match level="QueryCoverage=89%, HitCoverage=88%, E-value=1e-29, Identity=36%"; Hit description =Putative uncharacterized protein
  Pfam annotation: Domain name=VQ; Domain location=49-79; Score=38.7; E_ value=2.1e-08; Accession=PF05678.5; Description=VQ motif
MDESKNRHNDNLGVNKMGKNIRKSPLHQPNYGNNNNSSMNGGRQQQQQPQPQPQVYNISKNDFRDIVQQLTGSPSQSQDHPQSKPPQNQNNSPKPQSMRLQKIRPPPLPYVRPPLHTTLPAARPAHFRQQPSPNPNNIAESPISAYMRYLEHSITDPTSRGAQFQPHHHPASSALLPNPPMLPLNATNPLPPPPAIAAVPSPQPNGPPILPLPSPTSQFLLPSPNDYMNFLSPQSCYRPLLSPGIQFPSPFTPHFPLSPFAQSGILGPGPQPPLSPGLFPLSPSGFFPMTSPRW

SEQ ID NO: 178051 - protein, 98 aa, Glycine max
  Coding DNA Sequence Number=SeqID_86366
MIDYILPGASNMDYTPPVVQPDDFLSNVFGTDCGMPASACEYMHSLQNKVEPSFTLMFNQDVEENNPSLHDIPDECPHRNSGRNMRCPPYGPGHHYGD

SEQ ID NO: 178052 - protein, 66 aa, Glycine max
  Coding DNA Sequence Number=SeqID_86367
MVMTTTTVKSEWPWSNFIKRLACDRGDLSMVVVMTMTMPPPYGKFKLNCDGVVVMGGQATCGSVTK

SEQ ID NO: 178053 - protein, 35 aa, Glycine max
  Coding DNA Sequence Number=SeqID_86368
MHFYRRSASRDHIWTVQITQTLLGDPQPLKLPPST

SEQ ID NO: 178054 - protein, 652 aa, Glycine max
  Coding DNA Sequence Number=SeqID_86369
MSSFLSDSAIGLGDNNFGGSIEESIMDREGEDLTPNWCEHFSPSQKGMTLCYFRGACPGYCDPPHSAYEGVRRGSVNGDVRVFPRVQRSKSDGSASSTLVIAGYEWVRDDVLKYKSCLTLATSVVGLQCQGGAWLSALLLYVLEHLNVTPSQIHPNSWAMLSGKIGWVSLNSVSKKLFEFELNVFRHVNDRFFRVLTTDVVADGMPLIDFGAAAILARRVGHIVSSFDERSSHCLAYIMGDFAWRPLVKQVGPTSGIVPPSVATPSTGEEGQPASEVGPIFIAAEVASNAHSFVLVKRKMDDVVGLSGRKKLMPAAGLMPTAGHLSTAKDVFLAPPAIEALAPLTVEALAAAASTPVIHAPLPLPVVAIQEVALAIVPATQDGIVVVSLPTIVEPLLSAGVAATGASTMMPPSSMTLMAFPSVILAMVASLSSLSCPRVLLGHSYTSSDVDSLWGATYTMEHKTPVGFVSAFDKNLIRSTRVQNATDSAKVFLQRSLAILEENGLQHQETVQKVASLADGDELFGCCKGLQAKKMDLGGKVESLATEKDGLAKVVVDLEARLKESETRLEESKLWAAKERKVSRELEEELILYKKEVVEQYEKQFQKAIRHVDFFAKDVKEGVLLDEEEINVEEEAADEGQCAAEQGDDACI

SEQ ID NO: 178055 - protein, 200 aa, Glycine max
  Coding DNA Sequence Number=SeqID_86370
MASHKRRVMPTPGEASNWDSSRFTSEIAWHKYQDNIQLWNILPERNVELGPGMIDVALVKEFYSNLYDPEDHSPRFCRVRGQVVRFDADMINDFLDTPVILEDGEEYPAYARYLSTHPDPDSIATTLYTPGGRFVLNADGLPWKLLRKDMMTLLRHGGMLDLQLSTEDGYGRGQLHISADQSDCPVQYLEAWVPGVDHND

SEQ ID NO: 178056 - protein, 159 aa, Glycine max
  Coding DNA Sequence Number=SeqID_86371
MRGRSTSRTVVPIDLEIEATCRRNNATRRQREQDIDTSPPLSPNHAQMDEEPARRVTLEDFSHTATPEFFISITSPEVQAPNISYPHSLIQLIQGNLFHGLPTGEAKNWLHSFKGNTFRTWEEVVEKFLKKYFPESKTAEGKLEISYFHQFPDDPLAKP

SEQ ID NO: 178057 - protein, 192 aa, Glycine max
  Coding DNA Sequence Number=SeqID_86372
MVILRLSIQARSCPMARRDKLWSFCAFPSRLDRVRWHAETNYGHSAPLSSRGGGPDDMREPFGPALFTFSHPEAAGPMTCGNHLVLHFFTFCHPKAAGPMTCGNQLVPHFFTFCHPEAAGPMACGEPFDPTPFFTIQKQSSSIAHGDKLWSSAPSVDREEQLQQYQDDVGRSVLIIFKNFVGAAGGDIDRPK

SEQ ID NO: 178058 - protein, 149 aa, Glycine max
  Coding DNA Sequence Number=SeqID_86373
  Gene Ontology: Mol. function=protein disulfide oxidoreductase activity; Cellular component=cytoplasm; Biological process=cell redox homeostasis
  Homolog annotation: Hit_ID=A7R2K3; Match level="QueryCoverage=32%, HitCoverage=11%, E-value=4e-10, Identity=75%"; Hit description =Chromosome chr10 scaffold_433, whole genome shotgun sequence
MGSEIYPEVHENPRAFFSSYSPIFLEPLAHGSSDCLYFVLTVKGKYLSCMEDNMYYVQDCFHLHPRVVLGLCPKTSFDKEDGKTLYTLEGVDSSSLANKVAKVAGSINLGEVASHAILRMAAGDAVLETVKEFDKHKHKPHITKVYTHK

SEQ ID NO: 178059 - protein, 200 aa, Glycine max
  Coding DNA Sequence Number=SeqID_86374
MRVELKTIDEVQEMVRIREEATKLQATRLVKAHGPPLEIPIGSHIMSPVRATPQVTLHVTRDVTPRVTCMQEHDIMSPVCATPRVTCMQEHEITSPYVPLHKGHICKSMTLRLQEHNTMSPVHDTPRETRDPTNLARQLHLEEIKKHWHTRPDVEVGAQNLKGPHRGPTVRVELRRGHVQVLKQSTLECGQGKNETQDLN

SEQ ID NO: 178060 - protein, 109 aa, Glycine max
  Coding DNA Sequence Number=SeqID_86375
  Subcellular localization annotation: CTP_CleavageSite=66; ConfidenceScore=5.17e-01
MDKSTPFTRNLHSEMTYHPCHTTPNLSFVKTPQPPRENRNNVVSLLACSQPHCFFIPLAPLFFHVLLEESPQLKPWEKIKVIEEEGLLQGDGHHNGLLRRCYFLVFVVG

SEQ ID NO: 178061 - protein, 99 aa, Glycine max
  Coding DNA Sequence Number=SeqID_86376
  Homolog annotation: Hit_ID=A5BU22; Match level="QueryCoverage=94%, HitCoverage=16%, E-value=2e-10, Identity=35%"; Hit description =Putative uncharacterized protein
MVDKNRTLKELATPDVVYQPWCIRYPETKVSYELKSGLIHLLPEFHGLADYAKMKAFSFSLDGVAKDWLYLQPDTINTWTNMKKRFIEKFFPTSRTTSI

SEQ ID NO: 178062 - protein, 227 aa, Glycine max
  Coding DNA Sequence Number=SeqID_86377
MAASDHAILHDRTYFPTKKSLLELSSQDALLAQNKVALFVVELTNLAVVFLLKTQHMKLITWETSQDKILMQVDTQDFMARITTSSKDSGELTLVSMSNHKSTESAIKNLEIQVGQLAKQLADKPSSSFGANAKKNLKEECKAIMTRGRRAIFAKDEGRLVAEHQDVVAKEEKEGEEKNKNEKEINVEEKEKEKEKNEKEKEKEEKKRTKSELAREKKRKASPSTGK

SEQ ID NO: 178063 - protein, 334 aa, Glycine max
  Coding DNA Sequence Number=SeqID_86378
  Subcellular localization annotation: CTP_CleavageSite=54; ConfidenceScore=5.56e-01
MAPKKLSTKRSRKDATREGSRPPWSLIVTGSGVPSTSSASRPSRDGHFIGRGVSSSGRTSTLTSRENQQCEFSQRRNQADGFDKEAITQLLCIPGQDFARSAAGRRVCIMRTNMTTLTQIWMALLFSNVLPSDHNFDLPLPKCQLVYAIQTRKSVHVAKVIADAIYLFAGMAPTRHPLDPEKSNRALGFLALITGLCQFYGVHVTPSKVIRPPITRAFIEKYYTPRQAQGDAHKAAGAPPPPRQADSAGPLSVEQYQQHLVRQQAANHHGQGQGSAPFVCPTPEQFGAEVAWPGDWPDAQTGEEPAEFPGEADEPHTDEDMTDLLGFLGGSGAT

SEQ ID NO: 178064 - protein, 139 aa, Glycine max
  Coding DNA Sequence Number=SeqID_86379
  Homolog annotation: Hit_ID=Q6WAY4; Match level="QueryCoverage=84%, HitCoverage=23%, E-value=1e-14, Identity=33%"; Hit description =Putative uncharacterized protein
MVEVSTEAIASLAQYYDQPLRCFTFGDFQLLPTVEEFEEILGCPLGGRKSISKIVKISTQELDRGKQVENGVVGVPRKCLEAKARTLASQDEWAPFMDVLALLIFGVVLFPNVDRLVDLAMIDAFLAFHDRKESPVSLS

SEQ ID NO: 178065 - protein, 72 aa, Glycine max
  Coding DNA Sequence Number=SeqID_86380
  Subcellular localization annotation: CTP_CleavageSite=34; ConfidenceScore=5.20e-01
MKLCFHNLQPLLSTFFSLHSFSFQTLAHSNSMMCLFEERSRVGDAKLRAPDSIYRALPIIELNLHGLERGYG

SEQ ID NO: 178066 - protein, 120 aa, Glycine max
  Coding DNA Sequence Number=SeqID_86381
MTIEESIHVTFDETNITSPRKEFVDDIADALEDTQNEERNLKRKRDDEDKDDQDNTAQENDNLLKEWKTSRNHPLDNIIGDISKGVKWTNWENEWIFWFIKNHSATTHDLIHTHDLIHGG

SEQ ID NO: 178067 - protein, 66 aa, Glycine max
  Coding DNA Sequence Number=SeqID_86382
MEVIESLKLKMEVGRGSYWKLKLEVVVIIKKGENVNHEDFDDVKKIKPGIMSVIIKKGENVDHALF

SEQ ID NO: 178068 - protein, 122 aa, Glycine max
  Coding DNA Sequence Number=SeqID_86383
MGAKYLEVVKRGSHPNNGWSPDEIRAQNDHNLSLRVFGHDRAWVARRRMTIICLRVPPDTIASGWQKEVVCAEDDVNLRVSTGLLDVIDKGYLRMSHDPRVSMTEIVGLTDKSKALAPTYPQ

SEQ ID NO: 178069 - protein, 104 aa, Glycine max
  Coding DNA Sequence Number=SeqID_86384
MRGAPLEEEIAPVISRGFNKTNMETLQKVRKAWEVVRKKDKELRGSNNGPIGGYHELKVCTRSERNLPQRLCETETNMLAIVSKYQEELNLATAHEHRVADEYA

SEQ ID NO: 178070 - protein, 89 aa, Glycine max
  Coding DNA Sequence Number=SeqID_86385
MITTKKLFPLLAMNPKERWSFVSTDNNQEVIPTSLINQEANPASCNEPKERWSLVFSVCNQEDLLLKTVTKNRSLEKLFVRMKERKKIE

SEQ ID NO: 178071 - protein, 124 aa, Glycine max
  Coding DNA Sequence Number=SeqID_86386
MVIFHHGDAAKDKGEEFFRGVWDWERVVIGGSSITFLYLIMAEGLSMMFNEVVKSLFCGFQIEGFPIMVNYKRLAAWEPMVQNMKKRLVSWDKHLQVLLLPLKAYLKNFFGGRGVVWIKGRFVR

SEQ ID NO: 178072 - protein, 269 aa, Glycine max
  Coding DNA Sequence Number=SeqID_86387
  Homolog annotation: Hit_ID=Q5XM22; Match level="QueryCoverage=26%, HitCoverage=41%, E-value=5e-17, Identity=59%"; Hit description =Resistance-like protein HAAS-2
MIRCHGSYVRLSWLRDVYQMKIDACHWIVAVRAYLLHLLGCTLFANKSVTYVHVVFLDALRDLTQSGTYACVLLHLCIFAEDYDEGRPRACRWTSGKALPVSTYRRHLDRLTPDVVCWIPYDGVPRWSFTDWRGLYDSLDTSRLFRQILLRLRSLLKKWMIDGYSLQKDPPRVSLVQQYDTFVEPDVHQQPVAAMTPNEANVVVHHLRHVVDGYVAIADKLERLLNLRILTEGTKAYTIAEECLSIARSYISQPTIGHKSRRRRRTYDH

SEQ ID NO: 178073 - protein, 714 aa, Glycine max
  Coding DNA Sequence Number=SeqID_86388
  Gene Ontology: Mol. function=1-deoxy-D-xylulose-5-phosphate synthase activity; Cellular component=type II protein secretion system complex; Biological process=terpenoid biosynthetic process
  Homolog annotation: Hit_ID=Q8L692; Match level="QueryCoverage=98%, HitCoverage=99%, E-value=0.0, Identity=83%"; Hit description=1-deoxy- D-xylulose 5-phosphate synthase 2 precursor
  Pfam annotation: Domain name=Transket_pyr; Domain location=392-558; Score=216.8; E_value=5e-62; Accession=PF02779.15; Description =Transketolase, pyrimidine binding dom
  Pfam annotation: Domain name=Transketolase_C; Domain location=573 -696; Score=152.1; E_value=1.5e-42; Accession=PF02780.11; Description= Transketolase, C-terminal domain
  Pfam annotation: Domain name=Transketolase_N; Domain location=88-365; Score=-212.8; E_value=0.069; Accession=PF00456.12; Description =Transketolase, thiamine diphosphate b
  Pfam module annotation: Pfam domain module=Transket_pyr::Transketolase _C::Transketolase_N; Domain location=392-558::573-696::88-365
MAFCGGTFVKPNYSASPCYKYTALSPYHGCRNKFCVRVSASGSADEERTIIKKEKDGWKINYSGEKPATPLLDTVNHPIHMKNLSTQDLEQLAAELRADIVHSVSETGGHLSSSLGVVELSVALHHVFNTPEDKIIWDVGHQAYPHKILTGRRSRMHTIRKTSGLAGFPKRDESVHDAFGVGHSSTSISAGLGMAVARDLLGKNNSIISVIGDGALTAGQAYEAMNNAGFLDSNMIVVLNDNKQVSLPTATLDGPATPVGALSSALSKIQASSEFRKLREAAKTITKQIGGQTHQVAAKVDEYARGMISASGSTLFEELGLYYIGPVDGHNIEDLVTIFEKVKAMPAPGPVLIHVVTEKGKGYPPAEKAADRMHGVVKFDPKTGHQLKAKSSTLSYTQYFAESLIKEAEIDNKIVAIHAAMGGGTGLNYFQKKFPERCFDVGIAEQHAVTFAAGLAAEGLKPFCAIYSSFLQRGYDQVVHDVDLQKLPVRFALDRAGLVGADGPTHCGAFDITYMSCLPNMVVMAPSDETELMHMVATAAAIDDRPSCFRFPRGNGIGATLPLNNKGTPLEIGKGRILVEGSRVAILGYGSVVQQCRQASEMLKELGIDVTVADARFCKPLDTGLIRLLAKEHEILITVEEGSIGGFGSHVSQFLSLSGILDGPLKWRAMMLPDRYIEHGSPQVQIEEAGLSSKQIAATVLSLMERPKQALLFK

SEQ ID NO: 178074 - protein, 86 aa, Glycine max
  Coding DNA Sequence Number=SeqID_86389
  Subcellular localization annotation: CTP_CleavageSite=33; ConfidenceScore=5.65e-01
MTTPPSSLPSPSPPPLPTDATSHSPLTLKRTRKATHLRSLATRLVGAERPLVHVDPATGKADGRCDIGELETSPYCAEGLIWEDIQ

SEQ ID NO: 178075 - protein, 68 aa, Glycine max
  Coding DNA Sequence Number=SeqID_86390
MTHQEVTRQPQSSNIDSTPWSFDTIWLGHIQKHSTYVEHRPIVEDFHDIDSAIKSRITRRRAIQKLKR

SEQ ID NO: 178076 - protein, 80 aa, Glycine max
  Coding DNA Sequence Number=SeqID_86391
MNHKGILSFLFSDYNQEVMPTSCNEPKSALSPVITTKKLYPLLAMNPKAVSLLDLVINQEANPLLAMNPKAVSLLSPMFN

SEQ ID NO: 178077 - protein, 90 aa, Glycine max
  Coding DNA Sequence Number=SeqID_86392
  Gene Ontology: Mol. function=protein serine/threonine kinase activity; Cellular component=membrane; Biological process=protein amino acid phosphorylation
  Homolog annotation: Hit_ID=A7P5U0; Match level="QueryCoverage=100%, HitCoverage=11%, E-value=4e-33, Identity=74%"; Hit description =Chromosome chr4 scaffold_6, whole genome shotgun sequence
MTREQSHVFTTLRGTTVYLAPEWITNYPISEKSDVYSYGMVLVKIIGGRKNYDPNETLEKSYFQSFAFKMVEEGNVTEILDSKVETYEND

SEQ ID NO: 178078 - protein, 280 aa, Glycine max
  Coding DNA Sequence Number=SeqID_86393
  Gene Ontology: Mol. function=ATPase activity, coupled to transmembrane movement of substances; Cellular component=integral to membrane; Biological process=auxin mediated signaling pathway
  Homolog annotation: Hit_ID=A7NVZ8; Match level="QueryCoverage=38%, HitCoverage=16%, E-value=7e-25, Identity=39%"; Hit description =Chromosome chr5 scaffold_2, whole genome shotgun sequence
MVLDKGYTGGQASPILTAFIAGQAATFKMFETIKRQPDIDAYDTGQSGSEKSTIISLIERFYDPQAGEVLIDDGPIDEEIRVAAELANAAKFIDKFLRGLDTMVGKHIRTSTNLRGAMGYIAPKWLGNAPITAKVDKYSFGAKECTLLLLSMDNEELKLLKEDGERLHGSPRLLAALRFGYRVFDLRVRGPCEIASCGSESNLLDLVKICLVMFIGLSLENNPCFREQFDDVAVAKEVVEMRICLLLLVAFATKYCLPLVYVGGSFIAAKGHDPEVCNNY

SEQ ID NO: 178079 - protein, 225 aa, Glycine max
  Coding DNA Sequence Number=SeqID_86394
  Subcellular localization annotation: CTP_CleavageSite=54; ConfidenceScore=5.51e-01
MTTPPSSPPPPPTTDATSHSLFTLKRTRKSTHLRSLTTRPIGAERPLVHVDPVTGKADGTHKKKFRTYLGIIARDKVDVTYENWKQVPAAQKDLIWEDIQAEFDIPEASDLRTKKKILQIVGHLQPTRTVSMTLFAKRCVKKGTGHSETKHCPSHVVSWGYEFLEKKLMDKRKKKQLEEATQSRSTDIVIDPSSPIRQHMKWKMTHTKKSGQMTSKAVKEIADKI

SEQ ID NO: 178080 - protein, 77 aa, Glycine max
  Coding DNA Sequence Number=SeqID_86395
MWYHVSEKPRRRLGVHDKTNNTLGDQLGSRCFVRMLQPCGIGTGLKEHSNRVTPKAYTPKSPSWPLPLDSGPTQKTF

SEQ ID NO: 178081 - protein, 772 aa, Glycine max
  Coding DNA Sequence Number=SeqID_86396
MESVSVHVYCDGDMIPSYEGIMFECPSDPKVITMSDDIPLQDVHAPVPGMTRKVDRLSNVERDILVSRVIVPWRGRLPDVGGSSLNRVDMLLVSQVRSDVSVGTYWRHRSWLSGAALWYFPLIMSFFLSNSVIGMGGSDSEGSIQQHLVDQKVISIGSSSLEGNHHGASNSGSSSSERLRVLCHAGGGTSGLHRKAGARISGCEDIRASSLDDVLKYRSFITFVASITVLQLQVKLASPVDSCKIVVQACGSDDFSFLRAASNNPPIFFMYMCLFKVLGLVLLLTAFQCALLEHLNVAHSQLHPNSWAMMELMDKNGWISLNILSKKLFKFDSNVFFRLKDHFLKLDPTRFKSFNKDLLTLVERVNKAIFGAARGQPAIEVRPITSVDEVSPNVPSSILAKRKRDDIVGAYVPVALAPPPLSVVPVQEVAPTAKVSVPTASTCLVVAPSKCRSGNHKCSYDVTSSFFGSNGSFLYYVGATFYEFCQGLSPTKFGNPRRKWPKAARGTKKGDILGVWRVKHPKVANAIVAFIEPMKSNHQRSSKVDNVLAKLLHTKLDGDELFKRYKDLQKEKETWLAGSRSPSWKNPSCGRPRRETVSKELEEELLMYKKEAVEQHEKGFHKVNRQAGFFAKDLDLGLFYPFKEMKDGILLDEEDLDLGLLLVVVRMSHRDMSQIFDGVGTKTLAYARKNLEEDELSSPLSAPLQICAKRTSTNKATYLSLKSDLQREFGTFLEKLCMLKGSRERKVQVPESSERFCCVKIYRDASSKRKPF

SEQ ID NO: 178082 - protein, 53 aa, Glycine max
  Coding DNA Sequence Number=SeqID_86397
MELESRHDRQDGLIKLFGMLPCGTCMRPTSLSLAIRTDVENSHSTSVITTQSM

SEQ ID NO: 178083 - protein, 491 aa, Glycine max
  Coding DNA Sequence Number=SeqID_86398
MASLWHIMLRLITSMSDGCQENGSVFLCRTSTMRTLPGFVSKLQLDEFFNKLWASIESVIAQIYIEYVVQACLAFNVAMSCLGLICLDSHDLSCQGGELHLQARCGDDGSELVERFLANHKVNIASGLYSFSCEAKEWTDLRLDDVDGAALVDDDLGHHEVGDYNGDNHGIVDVNVPDGVEVMLARVARMPFVRESTHNGVDYTYVFLGGLSFPFLVVSLSSSIFCFVSSSIDIVVSVVILLALTIFCVVTIIVVVFAYLVLSNPGLGESGGGSFIGSSVLKASLKIVVRLAIRVSKLSMDLGGNPLYQVNASLLRDVGKTRHKIASSLVYKFAWMRKASRCSSGSVVSLYRSRLSDFQPKVFDFLSSSSWCHSISTMQFWSCWRMSISIMVVGGGLESLKGISRLRLDCMLTMGEKGKLRGMFYRGPTVDTKCTYQSSELAHVRVDVAKESMSEHEKNMREPGTYSVEWKLRVLVCKGCYSDITTLADSF

SEQ ID NO: 178084 - protein, 124 aa, Glycine max
  Coding DNA Sequence Number=SeqID_86399
  Subcellular localization annotation: CTP_CleavageSite=67; ConfidenceScore=5.62e-01
MLLLLEPLRAASFPCPGTPLGATSFLLPACFFFSTRPASPATSSSSRTTPFAFQKTPKKLGKGVVTVAASGRSVKGSSGTSGRRVLPKVTKGHPKEHIFRNTSSGNFPEEVVLPENFRKKGSSG

SEQ ID NO: 178085 - protein, 76 aa, Glycine max
  Coding DNA Sequence Number=SeqID_86400
METRLSPSFKDAKHALQLGIRVDGRPITGATYYDWEEMCEQYLGVVLPKGEAIVGSAIKLKWLQDNMPLLPSESTQ

SEQ ID NO: 178086 - protein, 67 aa, Glycine max
  Coding DNA Sequence Number=SeqID_86401
MKEISGVLIQGEGGLQRVVPFQLAFLLRWTKTKMNKQVEKNVDFAGNRVIAEIIVLIHILGREGVVR

SEQ ID NO: 178087 - protein, 178 aa, Glycine max
  Coding DNA Sequence Number=SeqID_86402
  Homolog annotation: Hit_ID=Q6WAY3; Match level="QueryCoverage=34%, HitCoverage=2%, E-value=4e-07, Identity=42%"; Hit description =Gag/pol polyprotein
  Pfam annotation: Domain name=G-patch; Domain location=4-48; Score =20.5; E_value=0.00063; Accession=PF01585.14; Description=G-patch domain
MSGAAIMVARVMLGHNYEPGMGLGKNNDGTTNLVDIKENRRKFGLGYKPTRTDLRRSIIERRNRGTSPQLRPQARENPPCHISKSFMSAGLRHEEKVTMIHGTNTEDPAVDFEQEANRPEVEEDEGMEFPSELERTVAQEDREMKPHQEEMEVVNLGVGNEKKEEKVDTGMTTPNELA

SEQ ID NO: 178088 - protein, 332 aa, Glycine max
  Coding DNA Sequence Number=SeqID_86403
  Subcellular localization annotation: CTP_CleavageSite=30; ConfidenceScore=5.19e-01
MPVISEGVLSVGVSLSAQPFLQLMTSRKRRASTSRPQEPYDTSWFVTEVTWERYEELKRHRWHRALTRQPDNHIDLALVKEFYANLYDPEDHPPRQCKVRGKLIKFDAATLNEFLETPVVLEPGERYSTYSRFCSTHPDPQELITMEAPEEGLDYTRTDLECPFLLQPPPTSHTSDLNMDRARLVYGLVMKMDMDISKNWWNPDDLTIIFPGSRKARARASSDASIPALAPALAPVDPSMQTTDILVAWPGVQPSSLGGGEAPTAQEPQPQAPEAEAEAEETPEETPADTPMEEPGEEGTWDPWPTPAQDTLMPAQDALTPPHDDPTPAQEE

SEQ ID NO: 178089 - protein, 146 aa, Glycine max
  Coding DNA Sequence Number=SeqID_86404
  Homolog annotation: Hit_ID=A5BVM8; Match level="QueryCoverage=86%, HitCoverage=7%, E-value=2e-14, Identity=39%"; Hit description =Putative uncharacterized protein
MKLNFNLERKLRLSNFDRGGNERFLEEVKFGKEENIRNIVFEEELVIDSAQVPIPITVQETTPVIENNVLIIVDDIVQEQDNNEVLPQIPIQQSQEVSLRRSVRERRSSIPYDYIIFLQEHEDDIGLIEDDAINFYQAMRSSNSQN

SEQ ID NO: 178090 - protein, 91 aa, Glycine max
  Coding DNA Sequence Number=SeqID_86405
  Homolog annotation: Hit_ID=A5BEV8; Match level="QueryCoverage=81%, HitCoverage=9%, E-value=9e-09, Identity=37%"; Hit description =Putative uncharacterized protein
MTFFLLRSQPPTDSSVHCKICIGHVYDNHFVQVYFKDRCPLPPLALLWSRNCHPQAKQWPTPYISKMQQYRKLMMLKKDYVDITEDRTCSF

SEQ ID NO: 178091 - protein, 314 aa, Glycine max
  Coding DNA Sequence Number=SeqID_86406
  Gene Ontology: Mol. function=protein dimerization activity; Biological process=DNA integration
  Homolog annotation: Hit_ID=A2YTW4; Match level="QueryCoverage=23%, HitCoverage=15%, E-value=5e-15, Identity=43%"; Hit description =Putative uncharacterized protein
  Pfam annotation: Domain name=DUF659; Domain location=189-288; Score= -65.5; E_value=0.048; Accession=PF04937.6; Description=Protein of unknown function (DUF 659)
MVKTRELGRALARVMGRALGREDHHDLDDVLQRRRPTTSARRQREAAPIAEDDPMLTEDVHAHAEEVVDDVEGFPSGLCDPSVLTDYGDHVVVIVWNEEVQKFGRPVPKIEGLVAALEARMRHLSGVSRVGSALDTHSGPTSVRRGVRCFRRHRTRGSSSSSPCRFPQANQTPPPVHVVASVSPAARNPHYRKTFVYAANNKINGYQPRGVSIVSDGWSDPQRRSLINFMVVTESRPMFLKAIDCSNEIKDKNFIAKHMREEDDVAKAKFVKDTLLDDKWWDKVDYILSFTSPIYDVLTRTDTEASSLHLVYEM

SEQ ID NO: 178092 - protein, 405 aa, Glycine max
  Coding DNA Sequence Number=SeqID_86407
  Gene Ontology: Mol. function=nucleotide binding; Cellular component =mitochondrion; Biological process=response to cold
  Homolog annotation: Hit_ID=Q9SD94; Match level="QueryCoverage=80%, HitCoverage=81%, E-value=6e-61, Identity=39%"; Hit description =Putative uncharacterized protein F13G24.100
  Pfam annotation: Domain name=mTERF; Domain location=104-378; Score =56.8; E_value=7.7e-14; Accession=PF02536.5; Description=mTERF
EFDNTVQYLLRLTVLCVALPLHHIINNVHWKMVRNFLLIARLTASFTHHRRISSDSESDDENHHKGDTFTVSYLINSWGLSPRRAREISNRINLKNPDGPNAVIDLLNNYGFEKTHLAKLVERKPSVLLADAENTLLPKLKFFRSIGISNTDMPKILIASHNMLFRSLNKCLIPRYEILKSVLRDKGEVVRALKNAPFSFTYGDMMKRLVPNIRVLRESGVPQGSISYLLMHSRTLAYRDHSKFVEAVNTAKEFGFNPLRRTFVVGVEVLAIKRWESRFEVYERCGWNREIALRAVRKFPSVVKLSEEVFIKKMSFLVKDMGWPSEDIAEYPQVVTYNLEKRIIPRFSVIKMLKSKGLLKNNLHFSGIICITEAKFLKKFVISFQKDLPFLPDFYNSLANQQNVL

SEQ ID NO: 178093 - protein, 26 aa, Glycine max
  Coding DNA Sequence Number=SeqID_86408
MWTEQSMSTTPNHHLVVKVPLIPTKQ

SEQ ID NO: 178094 - protein, 247 aa, Glycine max
  Coding DNA Sequence Number=SeqID_86409
KEHGTEAALQELSENGTDRAKRKVGSILELLQRMEGDLWKLKIPLKPTTFAWQLIKDTIPTKGNLRKRQLEKGFAQPYNYWSSKEGSKAICVVERFKAIIQYSKLGRHDSKQHEMEGGWEWQFTWRRSMFDNEIEAAINFLRDIEDMIIQQHGSDEWVWLGDQSGNYSTCSAYKLIWEATATGQQEEWCMELWKIKIPSKIPVFAWRDAEEEVSHLFFHCSKIQPIWSKGKEVEILVASGNMGYLEV

SEQ ID NO: 178095 - protein, 205 aa, Glycine max
  Coding DNA Sequence Number=SeqID_86410
MIQSFEQQQEMSVIELCVEVDVAGASAINLTNSLLSCGNNMSHNESGSATVGTNSEEDFDDDDYLISNSYVKDSSDEDEDIDEMSDTDDEAARLIEPLTIVQSGEGGSQTPFWDSASHYSNINWSHPDQEEICGLDMGSNFNMGQELYVGMEFDTKSAVKNALQQYVMKVHQSFKVVESKSQKYVVCCGNRSDDIPCPFYMREIL

SEQ ID NO: 178096 - protein, 110 aa, Glycine max
  Coding DNA Sequence Number=SeqID_86411
  Homolog annotation: Hit_ID=A5BIS3; Match level="QueryCoverage=100%, HitCoverage=8%, E-value=5e-18, Identity=49%"; Hit description =Putative uncharacterized protein
MDMVRSMLINSTLPISLWMYALKTVIMRIVKTGNARFIENGEISGSIVPREMKIKEVRVQVPLACASSSKVIAPLVIVTNNNEEAQHNNESMIHNEPIVEEPHEVALRRS

SEQ ID NO: 178097 - protein, 27 aa, Glycine max
  Coding DNA Sequence Number=SeqID_86412
MSGLNPGQAVETTKLEYGRGRGNFRWN

SEQ ID NO: 178098 - protein, 136 aa, Glycine max
  Coding DNA Sequence Number=SeqID_86413
  Homolog annotation: Hit_ID=A7NUU5; Match level="QueryCoverage=26%, HitCoverage=10%, E-value=4e-08, Identity=69%"; Hit description =Chromosome chr18 scaffold_1, whole genome shotgun sequence
MLLQSAQIFRNLMVKPIRYVILQALKYWTILPAPLDTPDLFETRSSLKSGIYGWGLFTRRDIQEGEMVVEYHGVHIRPGVAQSATKTTFLAATIRKCSGNEEKGKTIYNAYGSNGQLRGSSNNLKLVNLLSDQFME

SEQ ID NO: 178099 - protein, 174 aa, Glycine max
  Coding DNA Sequence Number=SeqID_86414
MAHHRGFLKVVRLSEHKGKVVPEIGLCIEKFCDFGLLEYVATYPLAGGRRESSRVRLVEAKLHGESKNNSRVQDKNQEEFKTQEESLESRIKIQGSRSQESRSRFKTQDSRIKRRLNQDNSSGGVATYPSAGGRRVTRGMRVPRKEYARSRHQRLFEENVGKTGKDAIYELLSE

SEQ ID NO: 178100 - protein, 102 aa, Glycine max
  Coding DNA Sequence Number=SeqID_86415
MPSKDQLVEAKLHGESKMIQRCFDDNNDDDKGYILCGTSRGYIYLGLTENKRGYISCGSVLVEGISTRFKENKGGYIPCGSLLVKGFYKVERNLKDRRLLGD

SEQ ID NO: 178101 - protein, 145 aa, Glycine max
  Coding DNA Sequence Number=SeqID_86416
MSGWTWPKWASGLHMSNLRMAFVERTKGGTCKTKDSDAQGDEFVERLSMDEYCPLSGVLVNPLSLDKCCLSCFCQVVREGHVFGVLGVCDTCAILLHMCQSRSGHLLESRFVHEWESMMVPNFRAPIQLRPVIEEFVSLLNGVNV

SEQ ID NO: 178102 - protein, 290 aa, Glycine max
  Coding DNA Sequence Number=SeqID_86417
MAEEQPRRVTLEDYSSTSVPQFFTSIARLEVQAQNITYPHSLMQLIQNNIFHGLPNEDPYAHLATYIEIYNTVRLAGNSLKTWDEVVEKFLKKYFQSPRLLKEKMPSHPFINFQTIVLYVVGHMILATAFPQKIQHMKPQQQGPSLYDRTTKLEETLAQFMQVSMSNQKSTKSAIKNLEVQVRQLAKQLTDRPSSSFAANTEKNPKEECKEFMSRSKMVSMNEGEKRIGEEKQQLVTEPEIDPVLEPLSETEEEVEAEDDQQKEIPIIGGGAISIGTNKERQGMTSGSFP

SEQ ID NO: 178103 - protein, 140 aa, Glycine max
  Coding DNA Sequence Number=SeqID_86418
MEEKGHTRNFKKKAQHTLEEFSNLGRSEKKLIINGQKPTPAFSAATLACIFRKHCNPTPSETLQPYSMPEGVSPMGEARPSSRGSTSAVSPLVMAAPMHARQVSQLLAIGDGGTGISPLLSATPLQKQTPFTNSLKRDPV

SEQ ID NO: 178104 - protein, 308 aa, Glycine max
  Coding DNA Sequence Number=SeqID_86419
  Homolog annotation: Hit_ID=A5BSK3; Match level="QueryCoverage=57%, HitCoverage=20%, E-value=4e-09, Identity=26%"; Hit description =Putative uncharacterized protein
MAGAGDNGGVYHQLDGSQRLFLDAMTTQMQRLLNRNKEELYRRIAKSSLFTLKPLSPREEIPHGLPPSRGIEHQDAHAKVEYVKILYDQVKVQIAKKNESYAKQANKKRKEVVLEPGDDPGHLRANVFQKEGNDENPEIGQIQAKGPSGESSHHEDDSVDGIFDTDDEVTDIIEPVSIVHPTEGVQGIQNPFWNDVLHYNNINWSHLDEEDICGLDMPSTFNVGQELYVGMDFDSKDAVVETKSHKYIVCCPNNSAESPCPFYMRAILSKKTDAWKVTQWGGPHACLNMSMTQDHEKLDSDLIATCIV

SEQ ID NO: 178105 - protein, 92 aa, Glycine max
  Coding DNA Sequence Number=SeqID_86420
MSVLELYIEKDVAGDSMFDFANSVTSCGHNLSHNESELPRNISNLHDDEDDDYLASNSYVEESLDEMMRILKLTKYRLKAQVEKGEGPSGEG

SEQ ID NO: 178106 - protein, 200 aa, Glycine max
  Coding DNA Sequence Number=SeqID_86421
  Gene Ontology: Mol. function=helicase activity; Biological process =viral genome replication
  Homolog annotation: Hit_ID=Q2A9I1; Match level="QueryCoverage=87%, HitCoverage=12%, E-value=3e-30, Identity=38%"; Hit description =Putative uncharacterized protein
MMLGSCKGPTSFEDIRTIANIQYATYREAYFAMGFVQDYRKYVEAIKKAKDWGTTNYLRKLFVLILLTGAMSKPEEVWNQCWHWLADDIAYRHSKSTINSELHINDDTLRNLTLIEIEQLLHTNQRSLKDYPTMPYPQDINLTSYLQNNLVLSELDYNHDTTRSEFEHLFASMTCNLPIHILQILLITVNILLKDAHQEL

SEQ ID NO: 178107 - protein, 69 aa, Glycine max
  Coding DNA Sequence Number=SeqID_86422
MMTKSSKVNQIMSSRCSRRNQEKFKTQEEKLKNTSRFKRKVEFKNQDSRIRSRFKIKIQDSRFKNQEKT

SEQ ID NO: 178108 - protein, 104 aa, Glycine max
  Coding DNA Sequence Number=SeqID_86423
  Gene Ontology: Mol. function=prenyltransferase activity; Cellular component=integral to membrane
  Homolog annotation: Hit_ID=Q647J9; Match level="QueryCoverage=100%, HitCoverage=25%, E-value=9e-33, Identity=68%"; Hit description =Homogentisate phytylprenyltransferase
DIPDVEGDKEHGINSLSVRLGQKRVFWICVFLFEMAFGVGLLAGASSSYLHTKIVTGLGNVVLASILLYQAKSVDLNNKASTGFFYMFIWKLLYAAFFLMALIR

SEQ ID NO: 178109 - protein, 229 aa, Glycine max
  Coding DNA Sequence Number=SeqID_86424
  Gene Ontology: Mol. function=oxidoreductase activity; Cellular component=integral to membrane; Biological process=electron transport
  Homolog annotation: Hit_ID=A7PFB6; Match level="QueryCoverage=44%, HitCoverage=21%, E-value=8e-31, Identity=58%"; Hit description =Chromosome chr11 scaffold_14, whole genome shotgun sequence
MEIIDNILLLLFAAHDTSRSVLSLVMKYLGQLPQVFEHVLKEQLEISQGKEAGQLLQLEDVQKMKYSWNVASEVMRLSLPVSGAYREAKEDFTYADYNIPKGWNTSACMLKGENLDVAALKLARSLNAIVLTLGGNLDAAALKLARNLSAAPIGSLDIIITFALAKPSLIVAASFTPRTPLNSLVSETSAKMGGNEEALVGGSGIVDRWWRQHGAVACGGDMVVHDGGG

SEQ ID NO: 178110 - protein, 76 aa, Glycine max
  Coding DNA Sequence Number=SeqID_86425
MPHQKRKTLDEASLLSSESETQHDHKSTSTPYGLHRPGCHVCIEQSKNYPTLLAKQTYNSQIDRCTPRDNNMAKVI

SEQ ID NO: 178111 - protein, 76 aa, Glycine max
  Coding DNA Sequence Number=SeqID_86426
  Gene Ontology: Mol. function=peptidase activity
  Homolog annotation: Hit_ID=A5BP60; Match level="QueryCoverage=88%, HitCoverage=26%, E-value=4e-11, Identity=43%"; Hit description =Putative uncharacterized protein
MASSNFPFLEGNSINRPLMFNGEGYYYWKTRMHILIEAIDLNIWDAIEVGPFIPTKVVGNAIIEKPREEWMMMKEE

SEQ ID NO: 178112 - protein, 149 aa, Glycine max
  Coding DNA Sequence Number=SeqID_86427
  Gene Ontology: Mol. function=protein disulfide oxidoreductase activity; Biological process=intracellular signaling cascade
  Homolog annotation: Hit_ID=A7PNI1; Match level="QueryCoverage=55%, HitCoverage=12%, E-value=1e-17, Identity=52%"; Hit description =Chromosome chr1 scaffold_22, whole genome shotgun sequence
  Subcellular localization annotation: CTP_CleavageSite=61; ConfidenceScore=5.67e-01
MAFIGSFTAPVSPVPPTTTYTQNDVIVSSSSSTFEKFLRQRIRRFFKERALRFVKINVDVFAEREKDLRERTGSVTVLKIFFDERLIGGLVELNALRKNGDEELERRLTTPVGEGPLAPMYGFDEATEVEEAAVATYVRHHGCAPSKVR

SEQ ID NO: 178113 - protein, 113 aa, Glycine max
  Coding DNA Sequence Number=SeqID_86428
MGEVDEVQEQIKADIEALKEQMATMMKVMMSMKKIMEVNVATVAATSAIAEVDPTPPFGLNQINHLISDMVGQRGKELGSAGSAHFVQVQNKHMFSPYGLPPNYTPPNGDPLE

SEQ ID NO: 178114 - protein, 62 aa, Glycine max
  Coding DNA Sequence Number=SeqID_86429
MDISISFGNRLRKVRGDNNDEDCKHGMIHGTCNMDASKIRKVHDVVGANTRTMSSFGSIGYM

SEQ ID NO: 178115 - protein, 436 aa, Glycine max
  Coding DNA Sequence Number=SeqID_86430
  Homolog annotation: Hit_ID=A7QT56; Match level="QueryCoverage=8%, HitCoverage=8%, E-value=1e-07, Identity=75%"; Hit description =Chromosome chr1 scaffold_166, whole genome shotgun sequence
TIREQVRNEIQEEKKRSLQAWKNELKDAIITDIFDGDKVSAPANFDLNVLGARVSTKESNAEIVVNPSREEHVGRVTPPMGLYVQSQDCTKLVALVKIHDGPSTIHCVAYADDVVRVSIEKVIDGEAEVPFATSEIKYVREALNTFIAWPLPLVKLVSNEHSGVTPNKVVNAAKLNNDFPKQDPLRELIKTLVEIYNKSIEFVWDLTEFGIPNPQSIHNAKDRCGQREEYIENWLKESQRQLYIGVHRRPDVHIKTAINKKLNTTADGKVPKTAPQWLELKTHVQRGGYECGYYVMHWMWNIIGAKLKSDWNVVLSSCMRGRKHTVVTAETIKGRLLMEMNYMLAYGSGKASLRLLWNSGSLDILLPFEPDLKSKRFNVVADVNNVFEGEASTTAMTSAPSQESRPSKTVYNDVAFKDGRASSLNADKDRRKTAFF

SEQ ID NO: 178116 - protein, 117 aa, Glycine max
  Coding DNA Sequence Number=SeqID_86431
MRLFMNVPKYRKPEEKQNQGSGLNRGGMLLCTSYIDKQIDLGSQRLVKKWRKVPKEASLFNLQKAFLGLGWWKRLNLGGKEVVVGKGIMSSLMMNQSKKNGEVNKGFAFAPTYPQMQ

SEQ ID NO: 178117 - protein, 135 aa, Glycine max
  Coding DNA Sequence Number=SeqID_86432
MVTQNNESSKFLLWDRECTKLIGETADDVNRVKIEVRIQSKFKNAVVLRYSKDLDLINVVLEMLPDSEACSKIDPSNVDCNDATHAEFDHDPVAGLPLTPKKRMSSDEADEELGSSQISPAQLSSNKLTRHSHKS

SEQ ID NO: 178118 - protein, 205 aa, Glycine max
  Coding DNA Sequence Number=SeqID_86433
MAGKNDYQLPLSNGIFLNPLGKVNVTAMRRHCLTNELDFGASKDFAQVQKNTRHLLVVERAVQNEFWMFASRSQRNCYCGLYVRKAVILVDLGRIDGDPVLRETRLWATWEYVSSVGGGQQGMVGLCAHCGCGKLVVHHRPTATYGTWRYVAGVRRPWGRQASSWQSTDKRKTRPQSKEACGGWPAEAKMVSGNRLPRGVIDYQA

SEQ ID NO: 178119 - protein, 90 aa, Glycine max
  Coding DNA Sequence Number=SeqID_86434
MVIAILPCMGTANQTGEFQVAGCRLQVAGCRLGRHAFFRWYIMNSVITVLYFNGRVYEENDSVIFEGNKKAIQIKRGISFNALKKKLEIR

SEQ ID NO: 178120 - protein, 61 aa, Glycine max
  Coding DNA Sequence Number=SeqID_86435
MCLVGMASTSGDGTPPSPKTARLMVEMIKLGDQMRRMSYDNEERMERMRRVWEEYTGIVKL

SEQ ID NO: 178121 - protein, 66 aa, Glycine max
  Coding DNA Sequence Number=SeqID_86436
MAEPLMNKLETLCAVDGCSYVIFWQIHPQNSLSIGRRDYRQGFIGPFDGRRFSPNKQDKVQILNFK

SEQ ID NO: 178122 - protein, 78 aa, Glycine max
  Coding DNA Sequence Number=SeqID_86437
  Subcellular localization annotation: CTP_CleavageSite=68; ConfidenceScore=5.01e-01
MEDDAGGEEDLDAGRRLLDAWSSGRGRRRTRSFMLLPMLLTPLFTMFWPSVTSSPTHARTTPLFRHVVVEELASWDLF

SEQ ID NO: 178123 - protein, 309 aa, Glycine max
  Coding DNA Sequence Number=SeqID_86438
  Homolog annotation: Hit_ID=Q2HTA0; Match level="QueryCoverage=85%, HitCoverage=39%, E-value=7e-24, Identity=32%"; Hit description=IMP dehydrogenase/GMP reductase, related
MYQGRYRARQWVAAARAYLLHLVGCTLFANKSATHVHVVHLQAFRDLAQAGTFSWGAAALVHLYDQLNEVSQAPTRAGFTSTFHQSTGKAQMIGIKEAPYRAHIDALTVTDVCWMPYAEHRGVRGYDLISSYMGQVRWGPIIVYLRPERVVRQMGYIQTVPPPPVRDSLTGTDIDDRWVQFSDHVAPTGELCVVPGQVAPDYMECFFQISHPFVTPAEDIAEPRPAPPLPTHDDDFVEPPVAQVPIASDPPTHSVVDCTACVRMGRIAEHLERVINLRMVTARIDLYDIMDLCLRIARDDDPDDSLRPR

SEQ ID NO: 178124 - protein, 491 aa, Glycine max
  Coding DNA Sequence Number=SeqID_86439
  Gene Ontology: Mol. function=ribulose-bisphosphate carboxylase activity; Cellular component=chloroplast; Biological process=carbon utilization by fixation of carbon dioxide
  Homolog annotation: Hit_ID=A7PNR4; Match level="QueryCoverage=99%, HitCoverage=99%, E-value=0.0, Identity=82%"; Hit description =Chromosome chr8 scaffold_23, whole genome shotgun sequence
  Pfam annotation: Domain name=AAA; Domain location=160-375; Score =58.0; E_value=3.2e-14; Accession=PF00004.20; Description=ATPase family associated with various cellular activities (AAA)
  Subcellular localization annotation: CTP_CleavageSite=55; ConfidenceScore=5.73e-01
MAASVPTVGAVNIAQLKLNGSSSRVTSSPFFGTSLKKVNSESSSQRGVCRNFKVSAQIEYDEEKQTSKDRWGGLAYDTSDDQQDITRGKGMVDTLFQAPMESGTHYAVMSSYDYISAGLRQYNLDNTMDGFYIAPAFMDKIVVHITKNFLNLPNIKVPLILGIWGGKGQGKSFQCELVFAKMGIKLQSKIALTLWPIAFEFSPIVMSAGELESGNAGEPAKLIRQRYREAADIIRKGKMCCLFINDLDAGAGRLGGTTQYTVNNQMVNATLMNIADNPTNVQLPGMYNKEENPRVPIIVTGNDFSTLYAPLIRDGRMEKFYWAPTRDDRIGVCQGIFRTDGVLKEDIIKLVDTFLGQSIDFFGALRARVYDDEVRKWISGVGVENIGKKLVNSKEGPPTFEQPKMTLSKLLEYGNMLVQEQENVKRVQLADKYLNEAALGDANDDAIKTGNFYGQGAQQVHVPVPEGCTDPTAENYDPTARSDDGSCTYKF

SEQ ID NO: 178125 - protein, 67 aa, Glycine max
  Coding DNA Sequence Number=SeqID_86440
MEITNFGIVVGGSSITSGSSLPVTSWASVIVAEAEPFDNDENGVDSEEEGLVELHVPDLGGKHDEKG

SEQ ID NO: 178126 - protein, 149 aa, Glycine max
  Coding DNA Sequence Number=SeqID_86441
MRLHSKQNLGVSTSIVNMVIVTIHQSLLEMKTYQGNPCGVYPDLSSFTGSGVIQNSVDCIKRFAPSQGLVGIVGSVSEKYWDHHLGDISLATMAGVKIFITIIIESLSMSLIVLTRCQVFKRKIRGSRSGVRVWSGCGRCERMGKKAWV

SEQ ID NO: 178127 - protein, 66 aa, Glycine max
  Coding DNA Sequence Number=SeqID_86442
MEDAPVSLVSPSRRRVGYDTPLCQIFKRYANKEESIAYPLSANLALSTISSRAKSSLLALSAKTPD

SEQ ID NO: 178128 - protein, 309 aa, Glycine max
  Coding DNA Sequence Number=SeqID_86443
  Homolog annotation: Hit_ID=A2WKK4; Match level="QueryCoverage=64%, HitCoverage=67%, E-value=2e-64, Identity=61%"; Hit description =Putative uncharacterized protein
MAYTQGVYDEAWRVNVRIQGCDLEHGYLCGTMEALNVPMADTPVVTFWEGEIVDTKNYTFFTGKWEASPEDDIRHWSKFPSFSPLLGQVEADGGKSLDLSNYPYIFMRLFAMRRYGGGILCAALPLHMQRGCFRIRTHDQQVTKAQLYRCTRARPHQEKMIMLKKKRWKEQYFVNVGTDCGLTIAGFYYICFSCSDGSISGFYYDPNSRARKMDLTWWAGLASLQVGPGWALKKIMVRTKGLGRTLGRIIGRALGDKLVVMRMNPPSSEGLQHLHIDSEKLHLLLRMFSMWIMQMMRSMNSLKKQLLMM

SEQ ID NO: 178129 - protein, 63 aa, Glycine max
  Coding DNA Sequence Number=SeqID_86444
  Subcellular localization annotation: CTP_CleavageSite=52; ConfidenceScore=5.37e-01
MAEWHRGFLDKRHQIAVALRGMSTSATNSTSTTHQRTTHTTNERRLRRQRLQFATAMCPLLNG

SEQ ID NO: 178130 - protein, 113 aa, Glycine max
  Coding DNA Sequence Number=SeqID_86445
MEFGPQQALDHAHDRSLNVQEVTARLPGPEGTTPDAGTAAREQQAPEIARRKGGACGRVRRPTAARVPGVDRAFRGDPNPGLAGENHRSWRRPAAANGGRRGGVRRQPALMPS

SEQ ID NO: 178131 - protein, 79 aa, Glycine max
  Coding DNA Sequence Number=SeqID_86446
MAGTFFLLKQQNSLEIMNGTPHHDIPAITQPWFNLIHEKNLRPGDEVVFYYRFHDHAWELLIRNAIEWNNSNTDLDFDE

SEQ ID NO: 178132 - protein, 77 aa, Glycine max
  Coding DNA Sequence Number=SeqID_86447
MALEWRRKRERRCHFKENISLEEAHHHMRALCPDVLQHKVPLSTSPSHLLPRTQGSRSSQDPNRNNKPGVSYHIPNY

SEQ ID NO: 178133 - protein, 380 aa, Glycine max
  Coding DNA Sequence Number=SeqID_86448
  Homolog annotation: Hit_ID=A7R1J8; Match level="QueryCoverage=25%, HitCoverage=26%, E-value=3e-18, Identity=52%"; Hit description =Chromosome undetermined scaffold_359, whole genome shotgun sequence
MTNANCPQESLHSVSNGNLRFDAAQTLVSRFLHVSSFFEDEGESPVESDEIKVQTWSSQHYRNEPVVVVAAPWLQKYSSFDDQSGEQPLLLPIRSLKSRLSEKDIDVQSLNMSMSSKRFSSYSNRKAEVEAVDVDVDVDVQYLNRSTTFKRFSSNSNRNAEVEADAADTDVQSLNRSTISQGFSSNSNRKAEVIMLSSNTYVIMLSSNAEDSVRKKGFYKSCRPPPPPPPPIMFQKSMFMKPRFDGSSNKAPSFNKELKRCFTSERTTPVGKKSHEENKSMQGTLFRSNKFMGHASVPLVSQPVEKESLLVESDDDDDDNDTETEDQDVQGGRTVAQNNDRGKGPPVIGGESSKINGDEGPDVDKKADEFIDKFIEQVRL

SEQ ID NO: 178134 - protein, 158 aa, Glycine max
  Coding DNA Sequence Number=SeqID_86449
  Subcellular localization annotation: CTP_CleavageSite=88; ConfidenceScore=5.29e-01
MTPAADSDPGPALRPMPHPQSLPTVQPAQSCASFPHGKPDTLKNDGTVAGAVVTTTLERESGRGFGGRAPGQWTPRTANVRARMLRITAMRRQQACTQALRGQPQAAGGDHASGEGHAGVAEVLGDRTDHHHVQPEVRVDQRETDRGHQHPAAAAVVT

SEQ ID NO: 178135 - protein, 69 aa, Glycine max
  Coding DNA Sequence Number=SeqID_86450
MTGAGAITSFGYRKDRDGQWLKKDMQPLQDERTPSPPPQQDDSSALMNELEEDVGYLRRCFDLPPPSQF

SEQ ID NO: 178136 - protein, 61 aa, Glycine max
  Coding DNA Sequence Number=SeqID_86451
MVVNEGWTWIRKVRPKRILRSLGLGAKDTRFECSFKPMLIPCGWGILAKQSNPDWSPYDVT

SEQ ID NO: 178137 - protein, 87 aa, Glycine max
  Coding DNA Sequence Number=SeqID_86452
MLRNLTDHVIIPFLPSKMLRNFTDCALTLPFNFQHVTELHRLCYNVFLLASCMFQNFTNCLTMGAKYLEVVKRGSHPDIGWSPDEIR

SEQ ID NO: 178138 - protein, 53 aa, Glycine max
  Coding DNA Sequence Number=SeqID_86453
MGGLKKGRMNENAVQGAPKKGREWRIALSNHYAWLETRGWRMHERKHNSWGSE

SEQ ID NO: 178139 - protein, 79 aa, Glycine max
  Coding DNA Sequence Number=SeqID_86454
MTLLMVHVVYVRGGCIGLVGCPFCGKIEWLKSLSISEGMLRSFNSSMVIVLDGAHVYMSYVVYVHGGSLTLSDVPCVGN

SEQ ID NO: 178140 - protein, 68 aa, Glycine max
  Coding DNA Sequence Number=SeqID_86455
MEAMKEQMTIMMEAMMSMRKMMKVNTATVVATSTTTEVDPTHLSGLNQNVDNSASIPIESQQPQSGHA

SEQ ID NO: 178141 - protein, 58 aa, Glycine max
  Coding DNA Sequence Number=SeqID_86456
MVMEEQEENIGEEGEEAGNFWRKEREGVSSPSKKHIATVGTTSNNMLSKRKTLYEGSL

SEQ ID NO: 178142 - protein, 156 aa, Glycine max
  Coding DNA Sequence Number=SeqID_86457
MSNHKSTKSALKNLEIQVGQLAKQLAEKSSNNFGANIEKNPKEECKVVVTRSRKLMVAEDKDVVALKEHAPLKDTTIKKKNEVTDAMSQRGEKQIMVEERKIKDQENEIEVGKEKEKEEKEKVKKNKDEEKSRNEKEREKRKEKASDKGMEVPYPM

SEQ ID NO: 178143 - protein, 127 aa, Glycine max
  Coding DNA Sequence Number=SeqID_86458
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYHDEDVPYVLKTGLIHLLPKFHGLA

SEQ ID NO: 178144 - protein, 63 aa, Glycine max
  Coding DNA Sequence Number=SeqID_86459
MAGGKCGDFGGSAARPGKLLLQPEVTLLAQKLVLNSLIRLTRIKMLANDSPRTKLGSDTMILE

SEQ ID NO: 178145 - protein, 112 aa, Glycine max
  Coding DNA Sequence Number=SeqID_86460
MVSRGIIPFEKYIAAVGTTNNNMLSKRKTLDEGSLLSSKSETQHDYRFTSTPYVPMDPVPSGVANCHNLPFGGRATRGSWVRIPRKENARSRHQHLFEENVGKTGKGVVYEL

SEQ ID NO: 178146 - protein, 115 aa, Glycine max
  Coding DNA Sequence Number=SeqID_86461
MACQTEQQPPAQFQRRRAATGGAAHRNQPFGTGAAYQPGAERRAFAHHHQDVGVGDVSDQFIFVGVVAVQRASLYLRLQRCPVGQRQGNILIIIKNDAVQAHDGPQREAVGAPAD

SEQ ID NO: 178147 - protein, 157 aa, Glycine max
  Coding DNA Sequence Number=SeqID_86462
MSLAAIFSMRSMASLGVFNLIFPPAEVSNSCLDCGLNASIKILSCIESFQGLTQRFIGKLVKRRDGSFAFCSLRLQRNISSEISPQPHPCGSNAFQDYFDDAKISRVKKIPKFQDTRFKNQVSRIKNQVSRIKIQDSRSRFKTQDSRIKRRLNQDNY

SEQ ID NO: 178148 - protein, 67 aa, Glycine max
  Coding DNA Sequence Number=SeqID_86463
MSRGLELDQRVASQFFAERLRVRVRVKDRERELQCQEESESERPRTGVSTRRGDIARRVRLRDQERE

SEQ ID NO: 178149 - protein, 160 aa, Glycine max
  Coding DNA Sequence Number=SeqID_86464
  Gene Ontology: Mol. function=beta-lactamase activity; Biological process=beta-lactam antibiotic catabolic process
  Homolog annotation: Hit_ID=A7P510; Match level="QueryCoverage=98%, HitCoverage=17%, E-value=3e-60, Identity=72%"; Hit description =Chromosome chr4 scaffold_6, whole genome shotgun sequence
MGLKLRLDIPEQAMEVTTVFFRATTPANEYHKTMKSLADQRDRNMKVIQEKMNLDKKEMKRFNPVDAFPGDIVIFGRVLNLLRGLSSTMNVRIVYMDIMRPFAESVLSGGTLARYISKGPSLNDRWIFDSPVHSDVESKLRQLLIEMGNNDKILGIQGIL

SEQ ID NO: 178150 - protein, 642 aa, Glycine max
  Coding DNA Sequence Number=SeqID_86465
  Gene Ontology: Mol. function=hydrolase activity, hydrolyzing O -glycosyl compounds; Cellular component=integral to membrane; Biological process=carbohydrate metabolic process
  Homolog annotation: Hit_ID=A9PF62; Match level="QueryCoverage=99%, HitCoverage=99%, E-value=0.0, Identity=78%"; Hit description =Putative uncharacterized protein
  Pfam annotation: Domain name=Glyco_hydro_3; Domain location=103-340; Score=300.3; E_value=3.6e-87; Accession=PF00933.12; Description =Glycosyl hydrolase family 3 N terminal domain
  Pfam annotation: Domain name=Glyco_hydro_3_C; Domain location=412 -638; Score=180.7; E_value=3.7e-51; Accession=PF01915.13; Description= Glycosyl hydrolase family 3 C terminal domain
  Pfam module annotation: Pfam domain module=Glyco_hydro_3::Glyco_hydro_ 3_C; Domain location=103-340::412-638
MAKIPIFSVGIMLLHCWAAMTGAEYLKYKDPKQPLNNRIKDLMNRMTLEEKIGQMTQIDRKVASAEVMNKYYIGSVLSGGGSVPRAQASAKDWIHMVNDFQKGALSTRLGIPMIYGIDAVHGHNNVYKATIFPHNVGLGATRDPKLVRKIGEATALEVRATGIQYVFAPCIAVCRDPRWGRCYESYSEDHKVVQAMTEIIPGLQGDIPPNSRKGVPFVAGKKKVAACAKHYVGDGGTTKGINENNTVISRHGLLSIHVPAYYNSIIKGVSTIMISYSSWNGQKMHANHNLITDFLKNTLRFRGFVISDWQGIDRITTPSHANYTYSIYAGITAGIDMIMVPYNYTEFIDGLTSQVKNNLIPMSRIDDAVKRILRVKFIMGLFENPLADYSLVKQLGSKKHRKLARKAVRKSLVLLKNGEDADQPLLPLPKKASKILVAGSHADNLGYQCGGWTIEWQGLETNNLTKDSFSTSLAFVNLAKGTTILSAIKNTVDKDTEVVYKENPDLDYVKSNGFSYAIVVVGEKPYAETNGDSMNLTISEPGPDTIMNVCGGVKCVAVIISGRPVVIQPYLHLIDALVAAWLPGSEGHGVTDVLFGDYGFRGKLPRTWFKTVDQLPMNVGDSHYDPLFPFGFGLETKPPKAN

SEQ ID NO: 178151 - protein, 170 aa, Glycine max
  Coding DNA Sequence Number=SeqID_86466
MAFTQLCVEAKLHDESRLIQRCFDDNKNDDKGDDKKLKGQSKNEFKMFKIESRTLQDSRGNLISRIKNQDSRIKLPRIKIKIQESREDLIKISMKRFFQKLSSTWIFLKTCLPKSFYSLRVHLLGLLTENKRGYISCGSVLVEGTSTRSKENKGGYIPCGSLLVKGFLPG

SEQ ID NO: 178152 - protein, 149 aa, Glycine max
  Coding DNA Sequence Number=SeqID_86467
MAPTRHPLDPDKSNRALGFPALITGLCQSFGVPIAPSKVIRPPITRAFIEKYCTQRPAQRDAPQAADAPPPYQAGPTGSFDSEQYLRHLVRQQAANYRAHFRAEVAWPGDWPEAQAGEAPAEAPSEADEAREDEEMTDLLDFLGGSGAT

SEQ ID NO: 178153 - protein, 112 aa, Glycine max
  Coding DNA Sequence Number=SeqID_86468
YMMNSVITILYFNGRVYEETDGVIFEGSKKSIQIKRGISFNALKKKLEIRNNLSNNEAQPPTNVSNLHGDEDDDDDDDYLVSNSYVEESLDEDDSVDGISDTDNEVTDMIQP

SEQ ID NO: 178154 - protein, 37 aa, Glycine max
  Coding DNA Sequence Number=SeqID_86469
MTPIDSLQNDPLELAWYVNYLCKKKENHAREMLSKNK

SEQ ID NO: 178155 - protein, 180 aa, Glycine max
  Coding DNA Sequence Number=SeqID_86470
  Gene Ontology: Mol. function=helicase activity; Biological process =viral genome replication
  Homolog annotation: Hit_ID=A2Q378; Match level="QueryCoverage=100%, HitCoverage=11%, E-value=3e-47, Identity=50%"; Hit description =Putative uncharacterized protein
MEWCNQSTSIKYLFKYINKGSDRITAFLGNQDEIKQYLDCRYVSPPEACWKIFAFPMHVRSPAVERLYFHLENQQHVYWTDDQQIGEVLSKNTIKESMFTAWMHSNKICSYGRDLTYHQYISRFVYVARKRCWQPRKQGNTIGRLIWVPPSAGELFYLRMMLSTAKCAQSYNDIRTVNGL

SEQ ID NO: 178156 - protein, 29 aa, Glycine max
  Coding DNA Sequence Number=SeqID_86471
MALEGSSLLRWNYQPGESCSELELGELPL

SEQ ID NO: 178157 - protein, 70 aa, Glycine max
  Coding DNA Sequence Number=SeqID_86472
  Homolog annotation: Hit_ID=UPI0000ECBAF8; Match level="QueryCoverage =58%, HitCoverage=48%, E-value=1e-16, Identity=100%"; Hit description= UPI0000ECBAF8 related cluster
MKKENEEGGWKNHSSGIGMQAWHWPSFYNVVTGKTLALPNLIALQHIPLSPAGVIAKRPAPIALPNSCAA

SEQ ID NO: 178158 - protein, 285 aa, Glycine max
  Coding DNA Sequence Number=SeqID_86473
  Gene Ontology: Mol. function=helicase activity; Cellular component =nucleus; Biological process=viral genome replication
  Homolog annotation: Hit_ID=A2Q378; Match level="QueryCoverage=100%, HitCoverage=18%, E-value=3e-77, Identity=51%"; Hit description =Putative uncharacterized protein
  Pfam annotation: Domain name=DUF889; Domain location=1-210; Score =247.0; E_value=4.1e-71; Accession=PF05970.5; Description=Eukaryotic protein of unknown function (DUF889)
MRLQSNPSNHSSTHELIQFSDWLLDIGDGKLGQPNNVHCEITIPDEFLIMVFEDPIQAIVDATYPDLLQNYNNADFLQKRAILASTKDVVDKINDYVLSLIPGDEKEYCSADSVDKSDELLNPTFGVLTPEFLNTLKTSGIPNHKLRIKIGTPIILLQNLDQADGLCNGTRLIVTKLGTNVVEAEVIAGPNIGHRTYIPRMNMSPSDSPWPFKLIRRQLSFIVSFAMTINKSQGQSLAHVRLYLPNPVFCHGQLYVALSRVQSKKGLRILIHDKQGIAKNTTINV

SEQ ID NO: 178159 - protein, 184 aa, Glycine max
  Coding DNA Sequence Number=SeqID_86474
MTTLTQIWMTLLLSNIQPSDHNSNLPLPKCQLVYAILMRMSFHVAQLITDAIYIFAGMAPTRHPLDPDKSNRALGFPALITGLCQSFGVPVAPSKAANHRAHVQTHDCLYQMSLSLQSQGFTSFLCPTPDQFRAEVAWPGDWSEARAGEAPAEAPAEAPDEADEAREDEEMADLLDFLGGSGAT

SEQ ID NO: 178160 - protein, 153 aa, Glycine max
  Coding DNA Sequence Number=SeqID_86475
MDLPVVRSQPVAPTKVIRSPITRAFIEKYYTQRQAQGDAPQAAGAPPPPHQAGSFDMEQYLRHLVRQQAANHRAHVQTHDCLYQMSLSMQSQGFASFSCPTPDQFRAEVAWPGDWPEAQAGEAPPEAPGDGEEAHEDEEMADLLDFLRGSGDT

SEQ ID NO: 178161 - protein, 384 aa, Glycine max
  Coding DNA Sequence Number=SeqID_86476
GGRCWPAPSAFGGGGGAVGEHAAQEVHQLRDFVGGKTAQMMVQHMGDIGRDFARLGFAQFGQFDFHDAPVLLAAGAAQQALGLEPIERARHGAGVHPIEPGQFGGRVGTAQGDHGDGTPLHGGEIERSHFLVQHPVQGVGDELDQVAGVLFHHAARVAAIMDRIFGGIRAGRGVHPRILLPRQGLAQAGPDDGGHDQGRAGHHAHGRLLAEQDPGEGDGVHRLQRDHQAGAARVQPRQAGNEQEMRQAGAEHAQQCQPEPVHGGQGGQLADGEWQHHQCHHQVLPAGYLHRIHARGRAAVAQGQQREGQARQQAPGQADGALVGEVERRRDQHQAGGDQPQQQPFGQPHALTEDQALEQRDEGGKAGKAQGGDGDPAHFHRNEE

SEQ ID NO: 178162 - protein, 270 aa, Glycine max
  Coding DNA Sequence Number=SeqID_86477
  Gene Ontology: Mol. function=motor activity; Cellular component=cell projection
  Homolog annotation: Hit_ID=UPI00016621D1; Match level="QueryCoverage =98%, HitCoverage=40%, E-value=6e-15, Identity=28%"; Hit description =UPI00016621D1 related cluster
RKLHILAFRALQTLAFRGLHVLAFRGLHVLPFRGLHALAFRGPHVLTFRGLLAFTFRGLHVLALGGLHAIAFRGLHVLPFRGLHVFAIRGIHIVTIRGLHALTFRGLHVLAFRGLHVLPFRGLHVLAIGGLHIVTFRGLHALAFRGLHALAVRGLHVLTFRGLHVLAFRGLHTLAFRGLHILAFRGLHVLAFRGLHALAFRGPHALTFRGLRAITFRGLHVLALRGLHAIAFRGLHVLPFGGLQVFAFSGLHVVAFRGLHVVAFRGGSSR

SEQ ID NO: 178163 - protein, 192 aa, Glycine max
  Coding DNA Sequence Number=SeqID_86478
MLRFGKCCWHSRLTISHGVFRLIVAGDHDRLGLLGARRAHAAASASVASRNKPAVTPQHADGADVALQYGNAHFVGHQQAADHLAETPEADDDHLRIVVLYVRRSSSRPGAGQNGDGLHQRAWSSSRHHILEQQHREVRAAPLRCGSCPSRASAAAPWRWKTSPKADTADGCTAACQAKCVRYSNAPRSTAR

SEQ ID NO: 178164 - protein, 154 aa, Glycine max
  Coding DNA Sequence Number=SeqID_86479
MAPKKLFAKRSRRDAAAEGTSSAPEFDSHRFRSAEHQQRFEAIKEEIARRHWTSLVTLMAMFDPEIVLEFYANAWPIEEGVRDMRSWVRGQWIPFDADALGQFLGDSLVLEEGQECEFSQRRNMADGEAGADHAHQHDHLDPDVDDIAAQQCLA

SEQ ID NO: 178165 - protein, 15 aa, Glycine max
  Coding DNA Sequence Number=SeqID_86480
VNAVKIFPDAQNGLR

SEQ ID NO: 178166 - protein, 79 aa, Glycine max
  Coding DNA Sequence Number=SeqID_86481
PFVVKRAFSGGALVLTNMDGEKLPSPGQDHLELPSGVRTTHGQQKPIKEWMQVGIGSRSTDRCPLSALDKQRTSLQGSP

SEQ ID NO: 178167 - protein, 129 aa, Glycine max
  Coding DNA Sequence Number=SeqID_86482
MPSKVILMMPKNQELSKFQKIQDSRIKFQDQDSRIKFQESRFTNNQDQDSRLKIQESREGSIKWYIYLGVVILRTREGISLVDQFKWRVCPLGYSKRTREGTSLVDLWIVKDFARLNEISRTGSLLGDW

SEQ ID NO: 178168 - protein, 281 aa, Glycine max
  Coding DNA Sequence Number=SeqID_86483
  Homolog annotation: Hit_ID=Q84VH5; Match level="QueryCoverage=100%, HitCoverage=46%, E-value=1e-112, Identity=70%"; Hit description =Envelope-like protein
  Subcellular localization annotation: CTP_CleavageSite=21; ConfidenceScore=5.15e-01
MATSPKETSSPGSPSVPSSPSSTKAPSNQEQPEFHIQPIQMIPGQAPVPEKLVPKRQQGVKISENPSLATTFENASVPDADEDVPTSSTPNVSVADADKDVPTSSTPNAEILSSPSKEDSTEEEDQATEETPAPRAPEPAPGDLIDLEEVESDEEPIANKLAPGIAERLQSRKGKTPIKRRSKVAIPSKKRKEISSSDSDDDVELDVPDIKRAKTSGKKVPGNVPDAPLDNISFHSIGNVERWKFVYQRRLALERELGRDALDCKEIMDLITAAGLLKTVT

SEQ ID NO: 178169 - protein, 160 aa, Glycine max
  Coding DNA Sequence Number=SeqID_86484
  Gene Ontology: Mol. function=transferase activity
  Homolog annotation: Hit_ID=A6X4I6; Match level="QueryCoverage=100%, HitCoverage=21%, E-value=5e-87, Identity=99%"; Hit description =Glycosyl transferase family 2
MRTGKEPVELRLSAGSLGPTAQAIVYPANELAPFDVEYVVSDLTLPGHIKLLTNILTTWRSTFRLSRNQTFASLVRDLTFALTPEPREAQHCGEPVQGHHLLETAVDPMLGEISAIYGITPGSVTVIPPRFVVGRQARNAWQPCHFLLEAAQDLPSSLLL

SEQ ID NO: 178170 - protein, 203 aa, Glycine max
  Coding DNA Sequence Number=SeqID_86485
  Homolog annotation: Hit_ID=Q6WAY6; Match level="QueryCoverage=77%, HitCoverage=27%, E-value=3e-17, Identity=34%"; Hit description =Putative uncharacterized protein
MGSNQTPLLKKMFYQVKIKSLEVTGLRELGQLMGQLQRKPSAKPMYYDQPLRCFTFEDFQLVQTVEEFQEILGCPLGGRKPYLFSGFYPSMARVAKVVKISAQELDRVKQNRNGVVGVPQKHLEEKAKALASQGEWASFIDILALLIFRIVLFPNMEGLVDLEAIDTFLAFHHSKEGPVVAILADMYDMFDQRCEKSGMRIVC

SEQ ID NO: 178171 - protein, 189 aa, Glycine max
  Coding DNA Sequence Number=SeqID_86486
MVICTICRRLNVNRPRLLKSPHRHPETIKSDDMKRPTWSSAPFVEDLMSIDQDYFSLPFVIRRQSSPMTQIIKSDDTQRSTWSSAPFVEDSMSIDRDYSSFPIVIQRQSSLMTHKDQCGRLLIFFEYSMSFDRDNFSLPFVIDEYGHLPPLVEDSMSFDRDCYSPPFGIQRQPSPMACRGRNGHSLLLF

SEQ ID NO: 178172 - protein, 55 aa, Glycine max
  Coding DNA Sequence Number=SeqID_86487
MSTQQEAQAEIIGDPVDHVQTRSSLRAQGHTALISKMEQKHIDEAMQDDNWVKVM

SEQ ID NO: 178173 - protein, 69 aa, Glycine max
  Coding DNA Sequence Number=SeqID_86488
  Subcellular localization annotation: CTP_CleavageSite=20; ConfidenceScore=5.36e-01
MVSGDSGDSMASVKFLKTLEKSSRSPSVTLSRRFREQICEDFPPFFTVLHPFFVLQPQNLTDRSRCNLG

SEQ ID NO: 178174 - protein, 999 aa, Glycine max
  Coding DNA Sequence Number=SeqID_86489
  Gene Ontology: Mol. function=calcium ion binding; Cellular component =cytoskeleton; Biological process=cytoskeleton organization and biogenesis
  Homolog annotation: Hit_ID=A7PWH1; Match level="QueryCoverage=96%, HitCoverage=97%, E-value=0.0, Identity=65%"; Hit description =Chromosome chr8 scaffold_34, whole genome shotgun sequence
  Pfam annotation: Domain name=Gelsolin; Domain location=159-239; Score= 48.9; E_value=1.8e-11; Accession=PF00626.13; Description=Gelsolin repeat
  Pfam annotation: Domain name=Gelsolin; Domain location=273-349; Score= 53.2; E_value=8.7e-13; Accession=PF00626.13; Description=Gelsolin repeat
  Pfam annotation: Domain name=Gelsolin; Domain location=39-122; Score =68.6; E_value=2.1e-17; Accession=PF00626.13; Description=Gelsolin repeat
  Pfam annotation: Domain name=Gelsolin; Domain location=412-495; Score= 47.2; E_value=5.8e-11; Accession=PF00626.13; Description=Gelsolin repeat
  Pfam annotation: Domain name=Gelsolin; Domain location=545-616; Score= 18.2; E_value=0.0068; Accession=PF00626.13; Description=Gelsolin repeat
  Pfam annotation: Domain name=Gelsolin; Domain location=670-740; Score= 20.5; E_value=0.004; Accession=PF00626.13; Description=Gelsolin repeat
  Pfam annotation: Domain name=VHP; Domain location=964-999; Score =68.4; E_value=2.4e-17; Accession=PF02209.10; Description=Villin headpiece domain
  Pfam module annotation: Pfam domain module=Gelsolin::Gelsolin::Gelsoli n::Gelsolin::Gelsolin::Gelsolin::VHP; Domain location=159-239::273 -349::39-122::412-495::545-616::670-740::964-999
MGDKDQTLDHTVIEAPIPCHEFVLNLTCCRGTEIWRIENFQPVALPKSEYGKFYTGDSYIILQTTQGKGGTYFYDLHFWIGKDTSQDEAGTAAIKTVELDAALGGRAVQHREIQGHESDKFLSYFKPCIIPLEGGVASGFKKPEEEEFETRLYVCRGKRVVRLRQVPFARSSLNHEDVFILDTENKIYQFNGANSNIQERAKALEVIQFLKEKYHEGKCDVAIVDDGKLDTESDSGEFWVLFGGFAPIGKKVISEDDIIPETIPAQLYSIVDVEIKPVEGELSKSLLENNKCYLLDCGAEVFVWVGRVTQVEERKSACQAVEEFVASQNRPKSTRITRIIQGYEPHSFKSNFDSWPSGSASTSAEEGRGKVAALLKQQGMGVKGMTKSTPVNEEIPPLLEGGGKIEVWRINGNAKNALPKEEIGKFYSGDCYIVLYTYHSGERKEDYFLCCWFGKDSVEEDQTTATRLANTMSTSLKGRPVQGRIFEGKEPPQFVAIFQPMVVLKGGFSSGYKKLIADKGVSDETYTAESIALIRISGTSIYNNKSVQVDAVPSSLNSTECFVLQSGSTIFTWHGNQCSFEQQQLAAKVADFLRVEGEKLRLGTTHVFLHDRQYFRRDDEAVGSITIVEHLGTGRLVPGATLKHAKEGTESSAFWSALGGKQSYTSKKVVNEVEEVYNFSQDDLLPEDILILDTHAEVFIWIGHSVEPKEKRNAFEIGQGLSPHVPLYKVTEGNEPCFFTTYFSWDHAKAMVMGNSFQKKVSLLFGLGHAVEEKLNGSSPGGPRQRAEALAALSNAFGSSSEKASGLAQDRLNGLGQGGPRQRAEALAALNSAFNSSSGTKTFTPRPSGRGQGSQRAAAVAALSQVLMAEKKKSPDGSPVASRSPITEGSATETKSDSSEVEEVAEAKETEELPPETGSNGDLELKQENAEEGNDGQRMFSYEQLKTKSGHNVPGVDLKRREAYLSEDEFNTVFGMAKEAFYKLPRWKQDMLKKKYELF

SEQ ID NO: 178175 - protein, 169 aa, Glycine max
  Coding DNA Sequence Number=SeqID_86490
MSFQMPPSLKHFDQLNSQYYLMVSFLTFELSGEEFISIKRNGVDWIIICSNIGIHFNMWHYTLNPWKATFANFTGGRTYCDHESCFLFGILIAMLFMQQAIKVCPTCRQEATGTKVEATSLFENFHQLKSRCWVLKWVAFAEAFPVALDACFENLKRLNDVIVYSTLYQ

SEQ ID NO: 178176 - protein, 20 aa, Glycine max
  Coding DNA Sequence Number=SeqID_86491
MVDDRGDEREGGIGVDGSSE

SEQ ID NO: 178177 - protein, 369 aa, Glycine max
  Coding DNA Sequence Number=SeqID_86492
QGVPFEGTIVDDWKFDFSSHDARRMVCTNQAEMTGRLLTGSLTFECCIMHYLIVSIIPRSSNLAQVSEEDLIVMWAFLTGRQIDWAHLVRSFSIGARAVTSFGYCKELDGSWVKKDAQPQPADERIPSPPRHDSSTLLNDVFTELRSLRAHFDDRLDRIDTHFKEMDIRIDQFTDDMSYIRQVVKDLQDSGTPKRVSWGLDVGNGLCRTMDPLRYRCPQPILGPPANPRKISSANTARGGARTAPTRHPLDPKKSNRALGFPALIMGLFQFYGVPVAPSKAPQQPGDDQQQAAGAPPPPPDSTSDHLPRLEWYIRHEVDQQAANHRGQFVAVVAWPGDWPEDQTGPVCGPGGEDEAEDDQDMVGLIDFL

SEQ ID NO: 178178 - protein, 170 aa, Glycine max
  Coding DNA Sequence Number=SeqID_86493
  Subcellular localization annotation: CTP_CleavageSite=42; ConfidenceScore=5.92e-01
MGSPPASTTPPPPPPPSPPSPPRPPPTSGASASTSAVKRTRKASRLRSLSTRPPSVERPVVHVDPATGKADGPHKKKLRTYLGIVARDKVDITYENWKEVPTAQKDLIWEDIQPIRTVSRTLSVTNTTSARKSGPSFARLAETLLGRMCASRHRPSRSRILPPRFVSWGL

SEQ ID NO: 178179 - protein, 58 aa, Glycine max
  Coding DNA Sequence Number=SeqID_86494
MAFYDDLQETNVFIDEEDPRPTSCGSNVFQDYFDDAKESRVKQVSRFKNNLDQDSRFK

SEQ ID NO: 178180 - protein, 155 aa, Glycine max
  Coding DNA Sequence Number=SeqID_86495
  Homolog annotation: Hit_ID=Q6WAY4; Match level="QueryCoverage=85%, HitCoverage=24%, E-value=4e-11, Identity=31%"; Hit description =Putative uncharacterized protein
MGSNQAPLLKKRFYRVKIKCPEVASLQELGQLMDQLQRQAFRKTYGKIWDLAMIEVSVEAIASLTEYYDQPLRCFRFGEFQLVPTVEEFEEILGCPLEGRRPYLFFGFYPSMARITKEVKISAQELVRVKQSRNGVVGIPRKHLEEKAKALAVKF

SEQ ID NO: 178181 - protein, 70 aa, Glycine max
  Coding DNA Sequence Number=SeqID_86496
MARSVSAPCPYSRDLYGRELTRLLVIIPKVVISHLMVSRGIIPFEEHIAAVGTTSNNMSSKRKTLDEGSL

SEQ ID NO: 178182 - protein, 71 aa, Glycine max
  Coding DNA Sequence Number=SeqID_86497
MYMKWPRGSLPQRDLGRIKRLKEPVPLPSMTVTILGALNTSSASRPSRDGHFSESDASSLGTMSIPISRKK

SEQ ID NO: 178183 - protein, 265 aa, Glycine max
  Coding DNA Sequence Number=SeqID_86498
  Homolog annotation: Hit_ID=A5BSR3; Match level="QueryCoverage=47%, HitCoverage=40%, E-value=3e-14, Identity=39%"; Hit description =Putative uncharacterized protein
IDGVIDPPSPVRRHVKWKMARTKKTGEMTTEAAKEIAEKIDSFEEQATQGSFVPHGRQDVLAAAIGRPEHPGRVRGIGAGVTIKQYFGSAPRTSRNASSLPPNELHQLTQQIRDQLEESITEKVTRQEMILRPVTLTGTSHLPCLADTSGQVVVSPPKPPPKPDPEVDDPLYLMTLTIPKLFLRPYQVRWDATVFGSIQRSGQSQFESESYIKSWMQSSQRDVYLGAYLNGPDNYLKGIINSALKGLDNAPQPKSKASARWTAII

SEQ ID NO: 178184 - protein, 375 aa, Glycine max
  Coding DNA Sequence Number=SeqID_86499
  Homolog annotation: Hit_ID=Q6WAY6; Match level="QueryCoverage=80%, HitCoverage=61%, E-value=4e-25, Identity=27%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPQKYLEDKARGMANQGEWVPFMDVLALLIFGVVLFPNVDDLFDTFDRRCKKSSARIICCLPALCVWLVSHLFQQDTRHPCPLLSHRSCTEKRRMDWDQLLAGIGGVVLITIPSLAIRQLGYPMRGAPTEESMSPFLVTDLGAQNSKTIQRIHKAWETPLRKDQELRGIRNGIIGGYHEWLKVRIRGLDWLAKVKVVSEENFEAPEEDEEVQTLKSELGKAKLAKEKFSWLLHTFGRSGA

SEQ ID NO: 178185 - protein, 318 aa, Glycine max
  Coding DNA Sequence Number=SeqID_86500
  Gene Ontology: Mol. function=unspecific monooxygenase activity
  Homolog annotation: Hit_ID=Q9AVH2; Match level="QueryCoverage=67%, HitCoverage=100%, E-value=9e-54, Identity=46%"; Hit description =Putative senescence-associated protein
MARHKVTRTHTHTHSRRHKGEEGLGREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRRADIEGSKARRYDAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 178186 - protein, 373 aa, Glycine max
  Coding DNA Sequence Number=SeqID_86501
GMANQGDWVPFMDVLALLFFGVVLFPNVDGLVDLAAIDAFLAYHHSKESPVVAVLADLFDTFDRRTDWDQLLAGIGGRTISWFPRWKEGKEGVLFSCGRYPNIPLVGTRGISAHKIPKTIQRIHKAWETPLRKDQELRGIRNGIIGGYHEWLKVRIRGLDWLAKLKVVSEEDFEAPEEDEEVQSLKSELGKAKLAQGEVQVGRYTQNAITARALEQETKRARKEEYGWNKFRGALWGSNSELKLRREERDQSRAHSMVLKEELVACSRSKRSLSQRLCETETNMLAIIAKYQEELGLAAAHEHRIADEYAQVYAEKEARGRVIDSLHQEATMWMDRFALTLNGSQELPRLLAKAKAMADTYSAPEEIHGLLGY

SEQ ID NO: 178187 - protein, 184 aa, Glycine max
  Coding DNA Sequence Number=SeqID_86502
  Homolog annotation: Hit_ID=UPI00006A2D9E; Match level="QueryCoverage =66%, HitCoverage=65%, E-value=6e-08, Identity=12%"; Hit description =UPI00006A2D9E related cluster
MTKDKVDTSKPYTGAMKGTVHEPQANPGADQKIHTLTFRGLHVLALRGLHAHALRGLQVLAFRGLHALAFRGLHVLAFRRLHVLAFTRLHVPALRGQHVLVFRGLRALAFRGQRVLTLRGLHALAMRGLQVLAFRGLHALAFKGLHVLAFRGLHALAFRGRHVLAFRGLHVLAFIGLHVFAFRG

SEQ ID NO: 178188 - protein, 82 aa, Glycine max
  Coding DNA Sequence Number=SeqID_86503
MSNHKSTKSALKNLEVQVGQLAKQIDDKSSNSFVANTEQNPKEECKAVMTSSKRFVEAEDEDSVVHKKKTADKKGTDGKKNK

SEQ ID NO: 178189 - protein, 328 aa, Glycine max
  Coding DNA Sequence Number=SeqID_86504
  Gene Ontology: Mol. function=motor activity; Cellular component=cell projection
  Homolog annotation: Hit_ID=UPI00016621D1; Match level="QueryCoverage =73%, HitCoverage=43%, E-value=1e-22, Identity=35%"; Hit description =UPI00016621D1 related cluster
MSSPSEEYISSPPEDYTSSPQEDYTSSPPEDYTSSPSKDYTSSPSEDYTPSPSEDYMSSPLEEYMSSPSKDYTSSPLEDFTFSPSEDYTSSPLELYALTFRGLHALAFRGLHVLPFRGVHFLTFRGIHVHAFRGLHVLTFRGLHILTFRGLHTVTFRGLHVLTFRGLHALTFRELHVLAFRGLHVLAFRELHALTFSGLHVLAIRGLHGLTFRGLHALTIKGLHTHAFRGVPALAFRGLHVLAFRALDALTFRGLHVLPFRGVHFLTFRGIHVHAFRGLHVLTFRGLHGLTFRGLHTVTFRGLHVLTSEGLHALTFRGLHVLAFRGTT

SEQ ID NO: 178190 - protein, 171 aa, Glycine max
  Coding DNA Sequence Number=SeqID_86505
  Subcellular localization annotation: CTP_CleavageSite=32; ConfidenceScore=5.16e-01
MASFSHLQSQMQSQGLAVPSEPLVGPGPSGPRVSTKGSCVDPSGNDPEIGDSDRCGLYIEADPARLVAIRRVYEGSTVVHNTHLLLGQVKVSVEEVRDADAPIPVPTDEVSLVGQALHTFLAWPTHLVKSLSQQVVVSPPKPPLKPDPEVDDPLYLMALTIPRAFLEALSG

SEQ ID NO: 178191 - protein, 15 aa, Glycine max
  Coding DNA Sequence Number=SeqID_86506
MEVWMTPLPVKEDKS

SEQ ID NO: 178192 - protein, 203 aa, Glycine max
  Coding DNA Sequence Number=SeqID_86507
MARTKKTSQMTSKAANEIAKKIDSLEEQASQGSFVPHGQHLGRVRAVRAGVTIKQYFGPAPRTSRTSSSLPPEELEQLTQQIRDQLEESITEKGLALPLEPEVGPSTTRVSTRKSCVDPSGNDPDTGDSDKYELYREENPPRLVSLGKVYEGSTTVHTIPLLHDQVKVGVEEYFNDVRPLEVERLKALHIQWAKYYLKVRNQT

SEQ ID NO: 178193 - protein, 269 aa, Glycine max
  Coding DNA Sequence Number=SeqID_86508
MSSQGKKTISSIRVSPLFEQNCNCGQGFSKKFGPHKTDSERHSGPTTGVPRRQGEGYGQSRRLGPVYGCVSFANFWDGPFSKRGWRIDWDQLLAGIGGRTISWFPRWKEGKEGVIFSCGGYPNIPLDSRRTNSKTIQRIHKAWETPLRKDQELRGIRNGIIGGYHEWLKSSAKRILKHRKRTKKVQALKSELGKAKLAKEKFKLAATHVRKECAGLREENAITARALEQETKRARKEEYGRNNFAELYGVAIVNSSCEGKKGTSREHMA

SEQ ID NO: 178194 - protein, 34 aa, Glycine max
  Coding DNA Sequence Number=SeqID_86509
TGRIVLVWFKTCKGFFQVSGTLKRVAWGLDIGTR

SEQ ID NO: 178195 - protein, 81 aa, Glycine max
  Coding DNA Sequence Number=SeqID_86510
  Gene Ontology: Mol. function=protein binding
  Homolog annotation: Hit_ID=A0EXV6; Match level="QueryCoverage=100%, HitCoverage=40%, E-value=7e-09, Identity=39%"; Hit description=LRR repeat protein
MDGEIPEKGQFHTFPPTSFQGKMDLYYSHDTSGFVLSPSDETCARPHHQKLEIIGFPFGFGGVAGFRITIAISFAFGWLFS

SEQ ID NO: 178196 - protein, 122 aa, Glycine max
  Coding DNA Sequence Number=SeqID_86511
  Homolog annotation: Hit_ID=UPI0001652057; Match level="QueryCoverage =69%, HitCoverage=31%, E-value=4e-08, Identity=34%"; Hit description =conserved hypothetical protein
TYQGNPCGVYPDLSSFIGSGVYPDLSSFTGSGVYPDLSSFTGSGVYPDLSSFIGSGVYPDLSSFTGSGVYPDLSSFTGSGVYPDLSSFTGSGVIQNLRSLYQTIRSYSGSHHLVSELRLLIQ

SEQ ID NO: 178197 - protein, 237 aa, Glycine max
  Coding DNA Sequence Number=SeqID_86512
  Gene Ontology: Mol. function=protein-tyrosine kinase activity; Cellular component=plasma membrane; Biological process=protein amino acid phosphorylation
  Homolog annotation: Hit_ID=Q56I14; Match level="QueryCoverage=45%, HitCoverage=24%, E-value=1e-35, Identity=66%"; Hit description=TPR -containing protein kinase
MMKDAVNGHNSAALGLHFLLGSSSSSASHKKAGAEKFAQALDLTRGKHFLILVDSCLEGHISNDDGIEIVRLAWRYLQYEPRERPNALSLVPSQVLLGIPDEIAPSKEAVPLTPFGEACSRRDLTLICRILETLGYKDDEDVANELLVESLLPTISAQPNKGKAPKSLQTKLIDAISLGVKRISILRGHTSSVNCNISRILYKREEATQVAGEESHLKRNTFNNFGGPDIHIQIRYF

SEQ ID NO: 178198 - protein, 163 aa, Glycine max
  Coding DNA Sequence Number=SeqID_86513
  Homolog annotation: Hit_ID=A7Q2K9; Match level="QueryCoverage=26%, HitCoverage=4%, E-value=5e-08, Identity=63%"; Hit description =Chromosome chr1 scaffold_46, whole genome shotgun sequence
MMLFVRYNIVFRTPLLNCIIQGHDGNIIVPESKLVSSTTLSFSLLRPRSLPFSLKFHTSFSLKSPTSTFRAFSDAEEDEEDDEEEDQDQDNVSADEYDDVLGEASDEADVFARHGGFKWQRVDKLCNKVREFGADLIDVDELTSVYDLIGVDLIDVIYQRWLG

SEQ ID NO: 178199 - protein, 106 aa, Glycine max
  Coding DNA Sequence Number=SeqID_86514
MKDRRNTSSGDVSSTFRNLTIFQNLIQSSARWLPLQGTPVDGHALSGRKARLAHPEGEDGVLSELAFAQHLYTTHPSSKIVHALNHQIGRLVNDALGQKISGLASS

SEQ ID NO: 178200 - protein, 85 aa, Glycine max
  Coding DNA Sequence Number=SeqID_86515
MEFVFCIFSGKCDELAKRVYCAKRVHQKCLNEFYANLYIPEEQSPKQVRVRGHCRNLPFGGRATRGLTGASSKGGRHAESPPTFI

SEQ ID NO: 178201 - protein, 103 aa, Glycine max
  Coding DNA Sequence Number=SeqID_86516
MSEVEEVQEQMKADMEAMKEQMATMMEAMMSMKKIMEANAVAVAATSVVAKVNPMPSFDINQMKHPTSDMVGKDLGSTGGPHYAQIQNKHAFPPYGYLPTGIL

SEQ ID NO: 178202 - protein, 60 aa, Glycine max
  Coding DNA Sequence Number=SeqID_86517
MVMIPKTPNQETVSPLLIRRENESPIRKKVIWLKKVIKPIIRDRCKISLRVDQALWIQIY

SEQ ID NO: 178203 - protein, 261 aa, Glycine max
  Coding DNA Sequence Number=SeqID_86518
  Gene Ontology: Mol. function=receptor activity; Cellular component =integral to membrane; Biological process=protein amino acid phosphorylation
  Homolog annotation: Hit_ID=A7QGE7; Match level="QueryCoverage=63%, HitCoverage=16%, E-value=7e-27, Identity=43%"; Hit description =Chromosome undetermined scaffold_91, whole genome shotgun sequence
  Pfam annotation: Domain name=LRR_1; Domain location=117-138; Score =10.5; E_value=3.5; Accession=PF00560.24; Description=Leucine Rich Repeat
  Pfam annotation: Domain name=LRR_1; Domain location=48-70; Score =11.9; E_value=1.9; Accession=PF00560.24; Description=Leucine Rich Repeat
  Pfam annotation: Domain name=LRR_1; Domain location=72-91; Score=7.0; E_value=15; Accession=PF00560.24; Description=Leucine Rich Repeat
  Pfam annotation: Domain name=LRR_1; Domain location=93-115; Score =11.5; E_value=2.3; Accession=PF00560.24; Description=Leucine Rich Repeat
  Pfam module annotation: Pfam domain module=LRR_1::LRR_1::LRR_1::LRR _1; Domain location=117-138::48-70::72-91::93-115
MREMGVIRRKIVTRQRLTYGVMSSNVYDSNVLLMWKGQEYLYLNPEFLLKSIDLSSNDLTGEIPKEVRYLLELVSLNLSRNRLSGEILPEIGNLTSLELSRNHFSCEVPSTLSKIDRLAMLDLSNNYLVGRIPWGRQLQTFSASTFEGNTDLCGEPLNKSCPVNGTATKPQGPAIHDDDDNSVFCEALYMSLGLGFFTGFWGLIGCPGQYFQRIQILTFMVGLHISDEHVEWEDIHEQRALNVFLAVGDCVLVGFQVINFS

SEQ ID NO: 178204 - protein, 279 aa, Glycine max
  Coding DNA Sequence Number=SeqID_86519
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=90%, HitCoverage=54%, E-value=1e-130, Identity=89%"; Hit description =Photosystem II 44 kDa reaction center protein precursor
  Pfam annotation: Domain name=PSII; Domain location=1-279; Score =355.0; E_value=1.3e-103; Accession=PF00421.10; Description =Photosystem II protein
MTTILGIHLILLGIGAFLLVFKALYFGGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 178205 - protein, 48 aa, Glycine max
  Coding DNA Sequence Number=SeqID_86520
  Gene Ontology: Mol. function=structural constituent of ribosome; Cellular component=ribonucleoprotein complex; Biological process =translation
  Homolog annotation: Hit_ID=P56791; Match level="QueryCoverage=91%, HitCoverage=20%, E-value=5e-15, Identity=73%"; Hit description =Chloroplast 50S ribosomal protein L2
MAIHLYKTSTPSTRNGAVDSQHRCGKGRNARGIITAGHRGGGHKASIP

SEQ ID NO: 178206 - protein, 241 aa, Glycine max
  Coding DNA Sequence Number=SeqID_86521
PVIAPPHPRHRLPIVEAQRQLHLHVHVAGFTLDDAHHVDPFFVVAERHEIVDTHRAGGGLVARFQHGRVGQVAAPDLARPARRQQPAAVAVVAEQGGETRGGIEMRQAQPVDGAVARDQRRRQQVADHAIVLDGLGHGSGRVPRLADAAVDHHARAGGRQFQGDATADAGSGARDDGHLSGQIRLPHVALLAAGASTGCRQARARGPLSIAKGQVSPERTAVQPAAAGAWRRFASRFLTFF

SEQ ID NO: 178207 - protein, 115 aa, Glycine max
  Coding DNA Sequence Number=SeqID_86522
  Pfam annotation: Domain name=zf-CCHC; Domain location=48-65; Score =30.4; E_value=6.5e-06; Accession=PF00098.14; Description=Zinc knuckle
MQKQQDSKSEDNGESLNISRGRSEKKGTRGKKSRSRSRDSKNGQKTKFKCFNCHKTGHFKKDCPDKIKKGSLDSADIVEASEGDNYPCKVQGIGTVRLKMFDNREYLLKNVRIFN

SEQ ID NO: 178208 - protein, 133 aa, Glycine max
  Coding DNA Sequence Number=SeqID_86523
MSCKSREIINYDKSITCRNVPFCGRARARLTGALSKGGKMRGVATNVYLGKRRENRRKLVKMKILSSGVVFTLEEGIGTSHVDKSGAFAPTYPPLERKSDLRSSSLCVNQVVLFYLKGAHFKALDLKNDPFYL

SEQ ID NO: 178209 - protein, 75 aa, Glycine max
  Coding DNA Sequence Number=SeqID_86524
MVIDYSFVNQFWKECWLLVIDYFLLDLEVAATLEEEPRSSEASSSFPIVGHSQIEPVEDTIMAKEPRRVTLEDYQ

SEQ ID NO: 178210 - protein, 112 aa, Glycine max
  Coding DNA Sequence Number=SeqID_86525
RKAVILVGVLGRVFCLCPVLLAVIVCVGLMLNYLDVGKLGRIDGDPVLRETRIWATWEYVSLVGGGQQGMSGTWRYVAGVRRPWGRQASSWQSTDKRNKDHTARRLVVAGQL

SEQ ID NO: 178211 - protein, 84 aa, Glycine max
  Coding DNA Sequence Number=SeqID_86526
  Subcellular localization annotation: CTP_CleavageSite=57; ConfidenceScore=5.04e-01
GRGAEFKGFSISCTEFSLEIGEDKRKKGKNPSRGASVTLSRHFHKRFCGSSLSFFVRSSSFFDLQPVSLIELLVGRVKIQVERN

SEQ ID NO: 178212 - protein, 42 aa, Glycine max
  Coding DNA Sequence Number=SeqID_86527
RGSTDAIAAQALKQAIERFSVLRRKLLRAHIGEQLVPAFSLT

SEQ ID NO: 178213 - protein, 118 aa, Glycine max
  Coding DNA Sequence Number=SeqID_86528
MIIIKTPKEIASTPSSRTSNKSENYKEEAWKKTQKHKPKRVESVNADAEAFGDDWKILIALCIVKLKQEEGINMGLTTMNVRRHRRKGWWMMKLPTNISWMKSYEDPPHSQRGERATI

SEQ ID NO: 178214 - protein, 141 aa, Glycine max
  Coding DNA Sequence Number=SeqID_86529
MHKALRLNAPFLYPHLVTLFLQHFNIPLDSEPYVPIKRSFLIGASVIASIGYQKEHDGSWVKKGARHVGEEGHDGEDSSLLSKILDRFDGLQTFVGERFDTLELQVDMRFNEMESRITKVEEDVSYIRSSFDLPPPPPPSF

SEQ ID NO: 178215 - protein, 94 aa, Glycine max
  Coding DNA Sequence Number=SeqID_86530
RSCHHDIGHPVDPKKSNRVLGFPALITGLCQFYGVPVTPNKVIRPPTNRAFINRYCAPRQAEGETPQQLGDGRWRATDASPLPLEFISAHPQKG

SEQ ID NO: 178216 - protein, 312 aa, Glycine max
  Coding DNA Sequence Number=SeqID_86531
  Homolog annotation: Hit_ID=Q6WAY6; Match level="QueryCoverage=39%, HitCoverage=21%, E-value=1e-13, Identity=33%"; Hit description =Putative uncharacterized protein
MDWDQLLAGIGGRTISWFPRWKEGKEGVLFSCGRYPNIPLVGTRGCINYNPTLAIRQLGYPMRGAPTEESMSPFLVRDLGAQNSKTIQRIHKAWETPLRKDQELRGIRNGIIGGYHEWLKVRIRGLDWLAKLKVVSEENFEAPEEDEEVQALKSELGKAKLAKEKFKLAATHVRKECAGLREENAITARALEQETKRARKEEYGRNKFRGALWGSNNELKLRREERDQSRAHSMVLKEELIACSRSKRSLSQRLCEIETNMLAIIAKYQEELGLATAHEHRIADEYAQVYAEKEARGRVIDSLHQEATMWMD

SEQ ID NO: 178217 - protein, 224 aa, Glycine max
  Coding DNA Sequence Number=SeqID_86532
  Gene Ontology: Mol. function=S-adenosylmethionine-dependent methyltransferase activity; Biological process=RNA metabolic process
  Homolog annotation: Hit_ID=Q8ZQJ5; Match level="QueryCoverage=100%, HitCoverage=59%, E-value=8e-89, Identity=73%"; Hit description=23S rRNA (uracil-5-)-methyltransferase rumB (EC 2.1.1.-) (23S rRNA(M- 5 -U747)-methyltransferase)
MPVADWRPPITSAQQGFRNKAKMVVSGSVEKPLFGMVARDGEPVDLCACPLYPASFAAVFDVLKPFIARAGLTPYNVARKRGELKFLLLTESTQGGMMLRFVLRSHSKLAQLRAALPWLQQQLPQLQVISANIQPVHMAILEGEEEMALTPEQALPERFNDVPLYIRPQSFFQTNPQVAAALYATARDWVAELPVHSMWDLFCGVGGFGLHCATPQMQLTGIEI

SEQ ID NO: 178218 - protein, 47 aa, Glycine max
  Coding DNA Sequence Number=SeqID_86533
MTWAKRVSTAKCIFSALSAIEESGRASISRPRAKREISALSVAVVFS

SEQ ID NO: 178219 - protein, 92 aa, Glycine max
  Coding DNA Sequence Number=SeqID_86534
MEGSQQNTHYPKEKLPKIITHKWKFGNLLEAPNTLPMKGLFLSKLESNEALKVIGPLLLDSILQGMAPISYMETHKQGSKETSNNQRPKKMR

SEQ ID NO: 178220 - protein, 74 aa, Glycine max
  Coding DNA Sequence Number=SeqID_86535
MVKEEYKELSLSSKRLSKKESHFAIKTNIKEISLLRQPTHLLLCKRTLVSIAIPLELEVIPQVLREEAQSFKKL

SEQ ID NO: 178221 - protein, 81 aa, Glycine max
  Coding DNA Sequence Number=SeqID_86536
MEASLCIPGRGFILNTKGQPWKLFRKDLTTLAQTWSVFSYSNLAPTSHTSDLNTDRARLVYGLITRMDMNIGCLISGQITM

SEQ ID NO: 178222 - protein, 45 aa, Glycine max
  Coding DNA Sequence Number=SeqID_86537
MKFYQYLAYVNKCTSTIKTSAIIGSPNTTAVLCSLPRHFNVQTSQ

SEQ ID NO: 178223 - protein, 18 aa, Glycine max
  Coding DNA Sequence Number=SeqID_86538
MVSHHMMNPMLEPERLSL

SEQ ID NO: 178224 - protein, 166 aa, Glycine max
  Coding DNA Sequence Number=SeqID_86539
  Homolog annotation: Hit_ID=UPI00016621D1; Match level="QueryCoverage =98%, HitCoverage=40%, E-value=3e-13, Identity=33%"; Hit description =UPI00016621D1 related cluster
LTFRGLHVLTIRGLHAVAIKGLHVLTFIGLHALTFRGLHVLTIRGLHVLTFRGLHRTARPHLRGLHVLTFRGLCVFTFVGLQALTFRGLHALAIRGLHVLTFVGLHALTFRGLHTLAIRGLHVLTFRGLHVLTLRGLHALTFRGLRVLIFNVLHIHTLREFKVLCP

SEQ ID NO: 178225 - protein, 98 aa, Glycine max
  Coding DNA Sequence Number=SeqID_86540
MMTKNEFKIESRTLQDSRGKLISRINNQDSRDQDFKNQDSRDQDSRLKIQELREGLVKISMKRFSQKLSSTWIFLKTCLPMSFYSLVIDYQIIVIDYQ

SEQ ID NO: 178226 - protein, 87 aa, Glycine max
  Coding DNA Sequence Number=SeqID_86541
MEKSEKKNINEKKLKKAYITWDENDMESSEDSENEEINLCFMAKSYESDEEVTSSNNLSISFDELQDAFADLHKESIKLAKKTKTCL

SEQ ID NO: 178227 - protein, 294 aa, Glycine max
  Coding DNA Sequence Number=SeqID_86542
  Gene Ontology: Mol. function=glutamate synthase (NADPH) activity; Cellular component=chloroplast; Biological process=nitrogen compound metabolic process
  Homolog annotation: Hit_ID=P09831; Match level="QueryCoverage=100%, HitCoverage=19%, E-value=1e-160, Identity=92%"; Hit description =Glutamate synthase [NADPH] large chain precursor
  Pfam annotation: Domain name=GXGXG; Domain location=41-238; Score =364.0; E_value=2.5e-106; Accession=PF01493.10; Description=GXGXG motif
PHPGKAVYCTENNPPFDNGVLNAQLLQQAKPYVDDKQSKTFWFDIRNTDRSVGASLSGYIAQTHGDQGLAADPITAHFSGTAGQSFGVWNAGGVELYLTGDANDYVGKGMAGGLLAVRPPVGSAFRSHEASIIGNTCLYGATGGRLFAAGRAGERFAVRNSGAITVVEGIGDNGCEYMTGGIVCVLGKTGVNFGAGMTGGFAYVLDEDGEFRKRVNPELVEVLDVDTLAIHEEHLRGLITEHVQHTGSSRGEEILANWPAFSAKFALVKPKSSDVKALLGHRSRSAAELRVQAQ

SEQ ID NO: 178228 - protein, 167 aa, Glycine max
  Coding DNA Sequence Number=SeqID_86543
  Gene Ontology: Mol. function=metal ion binding; Cellular component =integral to membrane; Biological process=ubiquitin cycle
  Homolog annotation: Hit_ID=A7P3V3; Match level="QueryCoverage=88%, HitCoverage=38%, E-value=2e-48, Identity=65%"; Hit description =Chromosome chr1 scaffold_5, whole genome shotgun sequence
  Pfam annotation: Domain name=zf-C3HC4; Domain location=116-156; Score= 45.2; E_value=2.3e-10; Accession=PF00097.16; Description=Zinc finger, C3HC4 type (RING finger)
MCCARRLVVVFLAFDVFFAIFCVVLACLIGIALCCCLPCIIAILYAVAGQEGASEADLSMLPKYRFRILSDEDKPSGGAGSMVPIETSSAYLANERTLLPEDAKIQRGYYLVPEECCICLCSYEDGAELHALPCNHHFHSSCIVKWLKMNATCPLCKYNILKGNEQV

SEQ ID NO: 178229 - protein, 51 aa, Glycine max
  Coding DNA Sequence Number=SeqID_86544
MDEDQWAYYSTMSEEVDMDFQDEQDYGVNEGHVDCSDAFNTSQVFATREDV

SEQ ID NO: 178230 - protein, 119 aa, Glycine max
  Coding DNA Sequence Number=SeqID_86545
  Homolog annotation: Hit_ID=A7PHU1; Match level="QueryCoverage=52%, HitCoverage=42%, E-value=1e-08, Identity=52%"; Hit description =Chromosome chr13 scaffold_17, whole genome shotgun sequence
MEIRSTRIRDKLFNERLRVVELERLSGISNLDNPVWKASLASLLLSRFSANFSPSATSDEKKKKLNTSKMRIFLATSTPTSQKELFSRLCWPGVVRERPSKTTIVKREFTFTRPSRAIM

SEQ ID NO: 178231 - protein, 110 aa, Glycine max
  Coding DNA Sequence Number=SeqID_86546
LALPPEAEVGSFAARVNTKESCVNPSRQDPETGDSDKFGLYADDSLPQLIALRRVYEGSMTAHDVPLGNDQVKDKQVAEGPTKPIDMLDPDIDPMYLMTLTITQLFLKSL

SEQ ID NO: 178232 - protein, 175 aa, Glycine max
  Coding DNA Sequence Number=SeqID_86547
  Gene Ontology: Mol. function=nucleic acid binding; Cellular component= intracellular; Biological process=regulation of transcription
  Homolog annotation: Hit_ID=A5AFC2; Match level="QueryCoverage=96%, HitCoverage=48%, E-value=3e-57, Identity=58%"; Hit description =Putative uncharacterized protein
  Pfam annotation: Domain name=zf-C2H2; Domain location=6-28; Score =22.6; E_value=0.0015; Accession=PF00096.17; Description=Zinc finger, C2H2 type
MATNRFLCETCGKGFQRDQNLQLHRRGHNLPWKLKQRTGKEARKRVYVCPEKSCVHHDPSRALGDLTGIKKHFCRKHDEKKWKHIPRPMAPENTNVTMELCFQEETARLNTASDINTFLGGNIGYNIMGTSLGPNMATHFPSIFKPVSSTNEISNQTSWGLPLWMGQTSSQAQEQ

SEQ ID NO: 178233 - protein, 92 aa, Glycine max
  Coding DNA Sequence Number=SeqID_86548
MTRGNPSDLQPFDPEIDRTFHRLVRQHLVPFEHSQHSVIGDFEQYSFEHSDFAHSENMAQLPPRERTLREMAAPDFTYESLCIQYSDEDVPY

SEQ ID NO: 178234 - protein, 93 aa, Glycine max
  Coding DNA Sequence Number=SeqID_86549
MPSKVILMMPKNSRIKRKIQEKFQVSSFQESRIKNNQEQDSRLKIQESREDLIKISMKRHEESIKARLCFVLGSSRVDLQACKLGTGRRFTTS

SEQ ID NO: 178235 - protein, 128 aa, Glycine max
  Coding DNA Sequence Number=SeqID_86550
MLRDSIRHPSKKLLSFEFGSEVQHSISSVSIYYGTQSDIRVKSYCHLNWLRGSTFNFERLDMLRDSIRHPKLHTFNFERLDMLRDSIRHPSKKLWSFEFGSELQHSISRRLDIVTGLNQTSEKKVIVV

SEQ ID NO: 178236 - protein, 235 aa, Glycine max
  Coding DNA Sequence Number=SeqID_86551
MASRKCKSIGSRPTTQYDTRRFHSLDAWNRYTDNVLGRNISPERKVELYHTELDDFKTELERHLALVKEFYANLYSSEGPSPKQAIVRGYLMKIDADSLNTFLETPVVFPEGETLPTYSRYCRLPIDYREIEAALCILSRGFILNAKGHPGRILRKDLTTLAQVWSVLSYSNLAPTSHTSDLTVDRARLIFCLVSRMDMDIGARISGQMTSIAQSNTSRLRFPSLITALYRARGV

SEQ ID NO: 178237 - protein, 168 aa, Glycine max
  Coding DNA Sequence Number=SeqID_86552
MFAHSIKGCRPLGRACGVLIPSPCVNTTPEPFTKKFVDRVFSENDEFRQELERRRWHKALTRHPNGRIDVALVKEFYGNLFDLEDKSPRQVRVRGKLIKFDGEMLNAFLETPVVLEPEERYLAYSRFCHTHPDPQELPSKLFTPGRSFVLNAEGAPWKLLRKDLTTLV

SEQ ID NO: 178238 - protein, 167 aa, Glycine max
  Coding DNA Sequence Number=SeqID_86553
MAKIAKVVKISEQELDRVKQKRNGVVGIPRKCLEEKAEALASQGEWAVFIDVLALLVFAIVLFSNVYRLVDLVAIDAFLAYHHSKKSPVIAVLGDTYDTFDLRCEKSSARIIYCTPALYVLLVSHVFNHEGRSVCPLQGHHMCSGNGKANWEELVAGMTGTSISWFP

SEQ ID NO: 178239 - protein, 110 aa, Glycine max
  Coding DNA Sequence Number=SeqID_86554
MVARVMLGHGYEPGMGMGKNNGGRTSLNKGQGPQSGQRAKEAPPCHISRSFISAGLRRKGQVAAICDDDSLRRSDLVRPCPAGTNTRDSTVDFEQEASQTEDEEDKDVGK

SEQ ID NO: 178240 - protein, 313 aa, Glycine max
  Coding DNA Sequence Number=SeqID_86555
  Gene Ontology: Mol. function=transcription regulator activity; Cellular component=intracellular; Biological process=regulation of transcription, DNA-dependent
  Homolog annotation: Hit_ID=A6T624; Match level="QueryCoverage=100%, HitCoverage=94%, E-value=1e-130, Identity=74%"; Hit description =Putative sugar-binding region
  Pfam annotation: Domain name=Sugar-bind; Domain location=57-313; Score=212.9; E_value=7.3e-61; Accession=PF04198.4; Description =Putative sugar-binding domain
MAKQDEQRLLVKIATLYYLEGRKQSDIAQLLSLSQSFVSRAITRCQKEGVVKISVVQPSNIFLNLEKGLEDRYGLKQAVVVDTEEEASDHTIKRAIGSAAAHYLETRLRPKDLIGVSSWSSTIRAMVDEVHAQNLKASGVIQLLGGVGPNGNVQATILTQTLAQRLNCDAWLLPSQSIEGSMEERNRLLASKDVADVVSRFDEVDIAIVGIGILEPSQLLKTSGNYYHEDMLQVLAARGAVGDICLHYYDKYGQPVLREDEDPVIGMALEKVKKCPNVVALAGGTDKVAAIKGALTGGYIDVLITDYPTARLL

SEQ ID NO: 178241 - protein, 71 aa, Glycine max
  Coding DNA Sequence Number=SeqID_86556
TYQGNPCGVYPDISSFTESGVYSDLSSFIGSGVYPDLSSLFGSGVIQISVACIKRSTPTQVHIIWYQSFSS

SEQ ID NO: 178242 - protein, 67 aa, Glycine max
  Coding DNA Sequence Number=SeqID_86557
MMIIKDYDKGDDKKLKDQSKNNSSESKINQRTTQVNQRSIKEQLKESRKKDWFLPLKNLIKEQGETP

SEQ ID NO: 178243 - protein, 85 aa, Glycine max
  Coding DNA Sequence Number=SeqID_86558
MDILTLGQGLWVWFGSGIKGDVPYYFHDTNATMMIWKFYAKLVMHAPMWTLKCRKIFGHVIVGPCDLNNLKRDRLRMQKKQQQSI

SEQ ID NO: 178244 - protein, 101 aa, Glycine max
  Coding DNA Sequence Number=SeqID_86559
MVILRLVSTERFRWQGGSLAEWCFARTKLVSYLYFPFISNKRQVKRGNYHTLISSGDHPLLGCDPRLTTSRYLAPIVRQFVKFRDMPEVKRKHCSTIREVS

SEQ ID NO: 178245 - protein, 107 aa, Glycine max
  Coding DNA Sequence Number=SeqID_86560
  Homolog annotation: Hit_ID=Q6WAY6; Match level="QueryCoverage=77%, HitCoverage=14%, E-value=9e-07, Identity=35%"; Hit description =Putative uncharacterized protein
MRGCINYNPALAIRQLGYTMKGAPAEESLSPFLVRDFGTQSFKLIQRVHKAWESPLRKDKELRGIRNGIIGGYHEWLKVRTRGLDWLSKLNVINEENFEAPEEDEEV

SEQ ID NO: 178246 - protein, 123 aa, Glycine max
  Coding DNA Sequence Number=SeqID_86561
  Pfam annotation: Domain name=zf-CCHC; Domain location=51-68; Score =31.2; E_value=3.8e-06; Accession=PF00098.14; Description=Zinc knuckle
MQEENEEEDSDDEEDFSLFVKKFQKFVKRRKIERRHNFNNGRTSQEGSQVLRCYKCNQLGHIKANCPSNEEWPEKSDKKRYDERRTKKAYIAWDDNDSSDGSEKEINLLTKDYESDEKISQEG

SEQ ID NO: 178247 - protein, 54 aa, Glycine max
  Coding DNA Sequence Number=SeqID_86562
MSTVRSTDDMKQRQMMHKLFIKEIATWRREGDTFGSDPLGMTLGGNRGLQIIHD

SEQ ID NO: 178248 - protein, 140 aa, Glycine max
  Coding DNA Sequence Number=SeqID_86563
NVPFVMVEQANKMFYVQDPFDERHMTTPSNSPLPPPELAAPSLSTSKKTRKATRLKSLATRPVGTEKLVVHVDPTTKRVDGPHRKKLRTYLGIITGDKLLGYDPRLTTSRYLAPIVRQFVKFHDMPKVKRKHCSTIREVP

SEQ ID NO: 178249 - protein, 124 aa, Glycine max
  Coding DNA Sequence Number=SeqID_86564
MLSFSQMQSQGLALPPELEVGPSAARVSTKDNCDDPSGNDPDTVKVGVEEVRDADAPIPVPTEEVKLVGQTLNTFLAWLTHLVKRLSEQGVVGPVKLADRSDHDVDDPLYLMTLSIPQLFLNPL

SEQ ID NO: 178250 - protein, 336 aa, Glycine max
  Coding DNA Sequence Number=SeqID_86565
  Gene Ontology: Mol. function=oxidoreductase activity; Cellular component=cytoplasm; Biological process=metabolic process
  Homolog annotation: Hit_ID=A9PHC3; Match level="QueryCoverage=45%, HitCoverage=45%, E-value=2e-56, Identity=69%"; Hit description =Putative uncharacterized protein
  Pfam annotation: Domain name=2OG-FeII_Oxy; Domain location=19-119; Score=129.4; E_value=1.1e-35; Accession=PF03171.11; Description=2OG -Fe(II) oxygenase superfamily
MANNLDLNLKPSKPYLAENTGMVRVYRYPNCSDANVGWGMEAHTDSSVLSILNQDDEVSGLQVLKDDQWLTVKPISNTLIVNLGDMMQAISDDRYKSVTHRVSINKHKERISICYFVFPGEDVVIESSKYKPFTYNEFRAQVQQDIKALGYKLANPSADLALSGVGLFAFLIQEIGSELNRLNFQGFYTVLLERNEELISVAAVRVYGKKVTEVPPVGTRIEYRPHGMCHILMKKLEKKLTQLGVEGLILPAVPSVLETWTRSFGIAKMTNLERSQFLDYTFLDFQSAIMCQKLLPSNQSPDPVLLMVAVLTSVSLVQYVNYIQVEEIDEGGMMDH

SEQ ID NO: 178251 - protein, 123 aa, Glycine max
  Coding DNA Sequence Number=SeqID_86566
  Homolog annotation: Hit_ID=A6FJQ2; Match level="QueryCoverage=30%, HitCoverage=84%, E-value=3e-11, Identity=92%"; Hit description=50S ribosomal protein L5
  Subcellular localization annotation: CTP_CleavageSite=23; ConfidenceScore=5.03e-01
MTVKPRTHAAPGDGHSLSVSGCREQTSPSGRVSGCCRMRKEKIPHQAPFAIQAAQLLGRAIGAGLFAITPAGERGMCCKAIKLGNARVFPSKHRGHHHPKVNYPNANVFARLIEIGQRTNANP

SEQ ID NO: 178252 - protein, 583 aa, Glycine max
  Coding DNA Sequence Number=SeqID_86567
  Gene Ontology: Mol. function=potassium ion transmembrane transporter activity; Cellular component=integral to membrane; Biological process=potassium ion transport
  Homolog annotation: Hit_ID=A7NYC4; Match level="QueryCoverage=89%, HitCoverage=95%, E-value=1e-168, Identity=51%"; Hit description =Chromosome chr6 scaffold_3, whole genome shotgun sequence
  Pfam annotation: Domain name=K_trans; Domain location=16-583; Score =464.1; E_value=1.8e-136; Accession=PF02705.7; Description=K+ potassium transporter
METRGDFHDHTNKFNQLNADDKLSDEEQTLLLLASLPRSFKALVIIALRENERIMRAENVDVDDEHNAIAVDSADTWQCSVVKLFFEKHPGIRKGLLIFVLLGTCMAIGDGVISPLLKYKYEHHGTHRVAFLFAPVVAIWLLCISSIGIYNIFHWNPKIYRALCPIYMVKFIKTIGIEAWLSLGGVVLSITGVETMFANLGHFSALPIKAAFLSRHHEDIRRSFYKAILGKNLVKIIHTSTRIYGKIYIPEVNWILMCFCLAITIGLRDTNVIGLAVITVMFVTTCLMTLVIVIVWKQGIIKAIACLLLFGSIELLYISACICKVPEGGWISLVLCFIFNCIMYTWNYGTMKKHQFDVENKVSMNRMLSMGPSLGMVRVPGVGLMYSNLASGFPAMFGHFVTNLPAFHQVLVFVCVKSVQVPHAVKLNGWSSVGSVQRSLACFIALSEGESIEEPTHEWSANDGNSNVEDHAVSLSQNTSDKSCCEKYSLPSSCVLQVMMNGDNHPEKSFYKDESLQIMKAKEFGVTYILGHSLAKAKNSSSILKKFAIDVVFGFLSKNCREFDAVLDVSHTSLLEVGIKYYV

SEQ ID NO: 178253 - protein, 92 aa, Glycine max
  Coding DNA Sequence Number=SeqID_86568
MGGYVGARASLLSTTPPFVAMTQELVIRGDTLWLFAPFCHPEAAGPMTSRDQVWSFCTHDTRRYLTVIRTFLSSRGGGPDDKQRPSLVILHP

SEQ ID NO: 178254 - protein, 295 aa, Glycine max
  Coding DNA Sequence Number=SeqID_86569
  Gene Ontology: Mol. function=sodium ion transmembrane transporter activity; Cellular component=1-2nm peptidoglycan-based cell wall; Biological process=pantothenate transport
  Homolog annotation: Hit_ID=A7MJA5; Match level="QueryCoverage=96%, HitCoverage=58%, E-value=1e-104, Identity=67%"; Hit description =Putative uncharacterized protein
  Pfam annotation: Domain name=SSF; Domain location=1-246; Score=106.8; E_value=6.8e-29; Accession=PF00474.8; Description=Sodium:solute symporter family
MQGLVMLIGTFLLLFAVIHRAGGLATAVTKLRSIDPQLVSPEGVGNVINPTFLSSFAVLVCFGVIGLPHTAVRCISYKDSKAMHRGIILGTIVVVILMLGMHLAGALGRAVLPDLAIPDRVIPTLMITVLPPMAAGVFLAAPMAAIMSTINAQLLQSSATLIKDLYLRIAPQHSENEARLRLLSGTITFVLGLLLLLAAWNPPDMIIWLNLLAFGGLEAVFLWPLVLGLYWERANAAGAISGMVVGAGCYTLLASLKIELWGFHPIVPSLTLSLLAFLVGNLFGSAPDARDAALE

SEQ ID NO: 178255 - protein, 83 aa, Glycine max
  Coding DNA Sequence Number=SeqID_86570
  Gene Ontology: Cellular component=integral to membrane; Biological process=vesicle-mediated transport
  Homolog annotation: Hit_ID=A9P970; Match level="QueryCoverage=72%, HitCoverage=27%, E-value=5e-26, Identity=90%"; Hit description =Putative uncharacterized protein
IRTQRSLIYAFVSRGTVILAEYTEFSGNFNTIAFQCLQKLPASNNKFTYNCDGYTFNYLVDNGVGASLKFGVVFGNEMNFVLF

SEQ ID NO: 178256 - protein, 295 aa, Glycine max
  Coding DNA Sequence Number=SeqID_86571
LEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRAAHHPGFLLRSTVPKDRVRVMLHRPQARPQPPHQAGQAGAFDMEQAPLLFHALLQTSSGQRLHGPGDWPEAQAGEAPPEAPGDGEEAHEDEEMADLLDFLGGSGD

SEQ ID NO: 178257 - protein, 177 aa, Glycine max
  Coding DNA Sequence Number=SeqID_86572
MSHGPRRMRRKAIKKEDPRRRMLLGMTMTHPMVRRRRSIFYPRTMEVMRTSLKKIKQKAKSLKWVEPSKKHKGSSSRSQRHSEAQDIPIPSSISSSALFSSEKQRIRYTNLFSSRSIIDPKFIDMDFFSNESFKCIQACQNSNLIPFMSLKLPVYSELVKAFYSNLEIQESTLISEV

SEQ ID NO: 178258 - protein, 67 aa, Glycine max
  Coding DNA Sequence Number=SeqID_86573
MSERGKVWRFGNGRAGRVGNRLQVMVIDYRRRQPTGNRLHEYCNRLQAICSSVIDYSIHVIDYQNKE

SEQ ID NO: 178259 - protein, 33 aa, Glycine max
  Coding DNA Sequence Number=SeqID_86574
  Homolog annotation: Hit_ID=A7QKE8; Match level="QueryCoverage=90%, HitCoverage=7%, E-value=6e-07, Identity=86%"; Hit description =Chromosome chr2 scaffold_112, whole genome shotgun sequence
VGKILLNALLYPGIKTNLQNNSLVAIFHTSVRH

SEQ ID NO: 178260 - protein, 174 aa, Glycine max
  Coding DNA Sequence Number=SeqID_86575
QEARGASGNRLSGDVIDYQASKGNWKTVEASGNRLPVCVIDYTEEWVTGNRLPVPEMKSLKIPLLLACSGYETHCVAAQQLGRPSKATRGADFGARSDSRLLHWVHPDEPARTLQRTVGVDTTHAYPISSRGASPSDRGNVVPRKALRRILRSYPPKPAADALDFLEGDEDPLP

SEQ ID NO: 178261 - protein, 196 aa, Glycine max
  Coding DNA Sequence Number=SeqID_86576
MGEAEEVQEKMKADMEAMKEQMATMMEAMMSMKKIMEANAVIVAATSAVAKVNPMLPSGLKQMNHPTSNMAHISQTMGETHEIPHHNLADFEPWLGYATEGQAVGGIPFENTLEGPQFRPQQQPLHFAVGRAPLAMAEMGKRKGSGPLKENICKKGDGSFKEHAQKVEGSGGPGGTPNDGKGDDDRDGRHIIDTLL

SEQ ID NO: 178262 - protein, 43 aa, Glycine max
  Coding DNA Sequence Number=SeqID_86577
MVESMLSLERSDVVIGRWKHRVKRSVKVPATSNKLADIPPHDQ

SEQ ID NO: 178263 - protein, 163 aa, Glycine max
  Coding DNA Sequence Number=SeqID_86578
  Homolog annotation: Hit_ID=Q6WAY4; Match level="QueryCoverage=87%, HitCoverage=28%, E-value=2e-12, Identity=32%"; Hit description =Putative uncharacterized protein
MGTNQNGKRFYQVKIKSLDVTSLKELGRLMGPLQRQAFRKVFTEAVVSLTQYYDQPLRCFTLGDFQMVPTVDESEEILGCPLGGRKLYLFFGFLPSLSKIAAVVGDSEKELDRMKQTRNGVVGLPRKYLEGKARDMASQEKWVPFADILALQIFGVVLFPNVD

SEQ ID NO: 178264 - protein, 104 aa, Glycine max
  Coding DNA Sequence Number=SeqID_86579
VSIVIRGVCVAKLELLKEASQGASSSSFLSKAILGGEAPSSLADSLVDGATPLLFSFAFRCISMGRSPEYEEPRDLRSNPFQGGEDDAILPPKGIGQKTLGGFG

SEQ ID NO: 178265 - protein, 62 aa, Glycine max
  Coding DNA Sequence Number=SeqID_86580
MWVQIAPRPTWALQNIPPEGCCFWRKQPGSPGGGSEEEKGSAPLALLSLSNLLGKIVSVKKI

SEQ ID NO: 178266 - protein, 400 aa, Glycine max
  Coding DNA Sequence Number=SeqID_86581
  Gene Ontology: Mol. function=amino acid transmembrane transporter activity; Cellular component=integral to membrane; Biological process=amino acid transport
  Homolog annotation: Hit_ID=Q6D359; Match level="QueryCoverage=93%, HitCoverage=79%, E-value=1e-156, Identity=73%"; Hit description=D -serine/D-alanine/glycine transporter
  Pfam annotation: Domain name=AA_permease; Domain location=53-400; Score=331.8; E_value=1.2e-96; Accession=PF00324.12; Description =Amino acid permease
MPSCPVQQHVIQQPAELTQHQDRKDIFMVDQSKAAPIEAEQPEKLRRNLHNRHIQLIAIGGAIGTGLFMGSGKTISLAGPSIIFVYMIIGFMLFFVMRAMGELLLSNLEYKSFSDFAADLLGPWAGYFTGWTYWFCWVVTGIADVVAISAYFQLWFPDFSIWMSALLCVFVFLALNIATVKLFGEMEFWFAIIKIVAIVALIITGIVLVSLHYPSPNGSHAALSNIWDHGGMFPKGLSGFFAGFQIAVFAFVGIELVGTAAAETKDPHKVLPRAINAIPLRIIMFYVLALLVIMAVTPWNQVMPDRSPFVEMFVLIGLPAAASIVNFVVLTSAASSANSGIFSTSRMLYGLAEQGVAHKAFGRLSARAVPTTGLFLSCLCLLAGVALIYLIPDVMTVFTM

SEQ ID NO: 178267 - protein, 113 aa, Glycine max
  Coding DNA Sequence Number=SeqID_86582
MRIAAKENIGVRLIIAQQHVVARLIQLDVVVLQQQRFGLRMGDRDINIMDVADQHFGLTASHLRAEIAAQAFFKVFGFTNIDHRACRVIHAVDAGLTGHGAEKGFRIENVTHY

SEQ ID NO: 178268 - protein, 101 aa, Glycine max
  Coding DNA Sequence Number=SeqID_86583
DQRVPMNPKRIKVIPEWLTPPTPLIELVRNHVPSWEDAQEMGVEGRSPEYDETRDLRSNPFQALASHLKEVSLAIRELLKEVFSKKLLKEVFSRKLLKEAT

SEQ ID NO: 178269 - protein, 245 aa, Glycine max
  Coding DNA Sequence Number=SeqID_86584
MTGPLDESISCFLIKVDPWVLVPITFRGLYVLAIRGLHILAYRGLHALAFRGLRVLIFSVLHIHTLGEYKGSRPQVAQWARRSPTGPWGFQLWLRASVSPTGNRAHKDTQWTRRSPTGPWGFQLWLRASVSPTGCPFPPARSRHHDIGIAPARHQVDPKKSNRVLELSSSNYGPLSVLQGARPTASSCHRDIGIRPPTNRAFIKKYYVSRQAQGKTPQQPGDGQQRATDAPPSPLEFTSAHPQKG

SEQ ID NO: 178270 - protein, 201 aa, Glycine max
  Coding DNA Sequence Number=SeqID_86585
MGDQEEVQEQMKADMSALKEQMASMMDDMLEMRQLMEKNAATAATVSLAAEADPTLPAIAHHPIPKRVAYPYGLPPNYTPPVIRDDTGHVPPPILEGEPPRQSDEVHEDRREHAQGDIDSHSPFPVEGPTPNALPQPNLMGEPRNPPAQSIFFSAEGPPPAAEERRKLDLIKERLKVIEGFGDYPFADMTDLCLISTSSSL

SEQ ID NO: 178271 - protein, 207 aa, Glycine max
  Coding DNA Sequence Number=SeqID_86586
PKRREVQALKSELGKAKLAKEKFKLAATHIRKECARLREENATTARALEQETKRARKEEYGRNKFRGALWGSNSELKLRREERDQPRAHSMVLKEELVACSRSKRSLSQRLCETETNMLAIIAKYQEELRLSTAHEHRVADEYAQVYAEKKARGRVIDSLHQEATMWMDRFALTLNGSQELPRLLAKAKAMADTYSAPEEIHGLIGY

SEQ ID NO: 178272 - protein, 179 aa, Glycine max
  Coding DNA Sequence Number=SeqID_86587
MQMPSSQSLGDPASVEEGQECEFSQRRNRADGFDEEAIAHLLCTPGQDFSQTAAGRRSFGVPVTPSKAIRPPITRAFIEKYCSPRQAQGDASQATDAPPPPHQANPAGSLGMGQYLQHLVRQQEANHWGQFRAEVAWPGDWLEAQAGEAPAGAPGDVEEARMDEEMMNLLDFLGGSGAT

SEQ ID NO: 178273 - protein, 77 aa, Glycine max
  Coding DNA Sequence Number=SeqID_86588
MACNVFAPCPYFRDLYGRKLKGLLVIIPKVVISLLMVSRGIIPFEEHIVAVGTTSNNMLSKRETLDEGSLLSSKSET

SEQ ID NO: 178274 - protein, 64 aa, Glycine max
  Coding DNA Sequence Number=SeqID_86589
MGNPNRGEATKAAEYQGEIEKIFRVMTCLEGKKVAFGTYTLVEEVEYWWENTRQCLEAEGQDVT

SEQ ID NO: 178275 - protein, 88 aa, Glycine max
  Coding DNA Sequence Number=SeqID_86590
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=77%, HitCoverage=13%, E-value=1e-21, Identity=77%"; Hit description=ATP synthase subunit alpha
MEREWSNCSHFLSCIGGWVVWVEGDFVKLRDGQIFLFVDLFNAGIRPAINVGISVSRVGSAAQIKAMKQVTGKLKLEFAQFVELEAFS

SEQ ID NO: 178276 - protein, 150 aa, Glycine max
  Coding DNA Sequence Number=SeqID_86591
MTLFIKQLLPITDQNWAVKVWQKLQAQVDKLSDARLEEAFYQNTKALQSFQCLDANTYRRSMILKANILLAKLQFLNFKAAPLLDLLVSSTWHGNSPCSSGIPAGTVPFGTCGRGKISHGDGDEKPPQLIQGRGRGLCSPPRKVPVSPRI

SEQ ID NO: 178277 - protein, 39 aa, Glycine max
  Coding DNA Sequence Number=SeqID_86592
MDLKVESVFYASNLVGEFQARRRWGRLRGEAPPWQCLPD

SEQ ID NO: 178278 - protein, 189 aa, Glycine max
  Coding DNA Sequence Number=SeqID_86593
MENSISLLGGKLDISSGNNSGNSLTTGRSHMETFVSTSRDKHHTTILSKHFNNTWLEDNQSIPRITSIWLKGKQIRSIKNVLPEISTGQFKHTLEVNTEPLVGVSTTKSLFKEDTKSLSFPTHEHDIKEWVAPESNITSKGIPFMKHLPWIRYLDFEASTPLRIKTFPVAFGCPVWSFRPPPFCSFLGY

SEQ ID NO: 178279 - protein, 139 aa, Glycine max
  Coding DNA Sequence Number=SeqID_86594
MRGSGVTEQDGVAAISRQWPWWVVRSDRVNERPGWKWRLIGRKRRSVSGMGSMVSIINEIVLGWGWWEEAMGSEAGMGVSVGGDFAEEEDGGDLGEDGVGVRMNSRQRMTLSLVVISRVLVVMVDRFWVRWYMTSSDGP

SEQ ID NO: 178280 - protein, 59 aa, Glycine max
  Coding DNA Sequence Number=SeqID_86595
MLQRALLRACEARLTGALSKGGKVDKSGAFAPKYPPSKRKSNLRSSFLSVNQAILFTLR

SEQ ID NO: 178281 - protein, 134 aa, Glycine max
  Coding DNA Sequence Number=SeqID_86596
MECPFTVKDVKPYGAIEIEDQSKDYSRVGKKETNTQEFLYWFGNNPCLHPVPKRPAVLEISFQPCKNPFTSKDPQGMYPPLFSLNNLVDVPSTRTDPQEMYPLLLSVNNPSRCTLYLYHKGCTLQCVKTKFSGG

SEQ ID NO: 178282 - protein, 216 aa, Glycine max
  Coding DNA Sequence Number=SeqID_86597
VRGCEHATARGHAAQPRDIGYLGRQRADVSGFFLPFTWRRIPPQNCVAVLVWKRNRSNYRGGLVDKPSGGRHVFQRLGPARPTRLDGINRSPSMIGKRVCFYVGLVLWKRQPSGFYQMLDLCLKARHCSVEWPGVFPWRLVDLSGRYHSHLVGDEGWQELFVRHWDQGECCPRGKVPYRVGNSAKVGIAGRASRGWSRSLGGLPLDGRRRPSLYGC

SEQ ID NO: 178283 - protein, 163 aa, Glycine max
  Coding DNA Sequence Number=SeqID_86598
MRGIVHEPQVNIGADQKFSPVDVFKQEKEKGGQTLGFQWIDQTSNDSIAVTPNGQDGPSGTSTLVFRGLHVLANRGLHALTLRGLCVLTFRGLRVLTFRGLHVLTFRGLHALANVGLHALTLRGLNVLALRGLRPHHQRAACPHLQRTTCPHLERATRPHLGY

SEQ ID NO: 178284 - protein, 85 aa, Glycine max
  Coding DNA Sequence Number=SeqID_86599
MHKKELRRSDFLSKGGFLRFFRRFPQINVGGDSAHLSSFGKRTREPRPRSPAKGHVATLGYHEESRSSSPGDNIGTDVSSFSHIS

SEQ ID NO: 178285 - protein, 15 aa, Glycine max
  Coding DNA Sequence Number=SeqID_86600
VSAVKIFSDAQNGLG

SEQ ID NO: 178286 - protein, 185 aa, Glycine max
  Coding DNA Sequence Number=SeqID_86601
MNHLVDAGWGRRVHLSNNAGSGNCNRMASIIFFMLIMASIIVAICSFMASMLAFTFSCTSSALPITLALTQISNTVHDIFVKVKQEVTGTSTALNVFGSRRSSDVTRSIFCPNFCKMVTSILQLDSMNLFVKARAWFNPITQGMAILIANTSSTFHKDERLGNTHAMHGKCNYEIEMPEETSFLS

SEQ ID NO: 178287 - protein, 74 aa, Glycine max
  Coding DNA Sequence Number=SeqID_86602
MEAGSLSFNEVLQWRKGERRRYPLGNKPWKKELRHQECALDKKLGEDASMEEKKEREKERGGSTKLKEEKRERS

SEQ ID NO: 178288 - protein, 99 aa, Glycine max
  Coding DNA Sequence Number=SeqID_86603
SFGVPFTPSKVIRPPITRAFIEKYCTPRQTQGDAPQAVDTPSPPHQADPAGSLGMERARVSLLLRTGEAPAGAPDDVEEARMDEEMTDLLSFLGGSEAT

SEQ ID NO: 178289 - protein, 54 aa, Glycine max
  Coding DNA Sequence Number=SeqID_86604
MTVYVFSMTDYLIKCGGKWDKMADTTGRIPLWIIGTRNNSPGIHSNSSKKEWIP

SEQ ID NO: 178290 - protein, 126 aa, Glycine max
  Coding DNA Sequence Number=SeqID_86605
MDICEDTDIPVILGRPFMLTASCIVEMGKRKLELGFEDQKIDFDLFVEDKPTPEQNVCLQVMEGGQEVLTRKLRAKRIFVHALSRVSQALSGQPLHLRLIWFTKLAKAELSQRQFDLNSAKLQSDR

SEQ ID NO: 178291 - protein, 71 aa, Glycine max
  Coding DNA Sequence Number=SeqID_86606
GKGRIKRILRLSPFEFSWKGRRETQKNSGEFSLVEEQGLKNKKLKKLFGKGRRRKMSSKGFKISQKLFKKF

SEQ ID NO: 178292 - protein, 95 aa, Glycine max
  Coding DNA Sequence Number=SeqID_86607
MSLLTLSPFVKVKRSFSIGANVVSSFGYRKERDGSWHILDRLDGLHTFVGKHFDSLDSRIDAIDARFAGMDTCITQLEEDMSYVRQCFDLPPPSS

SEQ ID NO: 178293 - protein, 253 aa, Glycine max
  Coding DNA Sequence Number=SeqID_86608
  Gene Ontology: Mol. function=motor activity; Cellular component=cell projection
  Homolog annotation: Hit_ID=UPI00016621D1; Match level="QueryCoverage =91%, HitCoverage=41%, E-value=5e-24, Identity=38%"; Hit description =UPI00016621D1 related cluster
MTDPLDESISCFLIRVDPWVLVSIAFRGLHVLAFRGQHVLNFRGLRVLAFRGLHVLAFRGLHTLAFRGLQVLAFRVLHVIAFRGLHVLAFRGLHVLTFRGPHVLTFRGPHVLAFRGLHVLAFRGLHVLAFRGLHVLTFRGLHALAFRGLYVLTFRGLHVLTFRGLHVLTFRGLHVLAFRGLHALAIKELHVLAFRGLHALTFRGLYVLLFRGLHTPTFKGLHVLTFRGLHVLAFTGLHALAFRGLNALAHPRL

SEQ ID NO: 178294 - protein, 25 aa, Glycine max
  Coding DNA Sequence Number=SeqID_86609
MTPINRATTAKGGRSLLDAAIVWYL

SEQ ID NO: 178295 - protein, 57 aa, Glycine max
  Coding DNA Sequence Number=SeqID_86610
MSCLAPPTPRPSSAEVSAGMPPTRHPLDPDKSNRAQGFLALITGLCQSFGVPSLLVR

SEQ ID NO: 178296 - protein, 203 aa, Glycine max
  Coding DNA Sequence Number=SeqID_86611
  Homolog annotation: Hit_ID=A5AHQ6; Match level="QueryCoverage=88%, HitCoverage=19%, E-value=3e-07, Identity=22%"; Hit description =Putative uncharacterized protein
MTCRLLAGSLTFDNRIMHYIIVRILLPRSSNLAQASEEDLILMWAFLTGRQIDWAHLVQYRLHKALRANAPLPYPHLITLFLRHVQILLDDEPFVQVKRSFAIGASAVTSFGYRKDRNGQWLKKDALPPQDEHTPSPPPQREDSALLNEVLTELRGLRSYVGERFDSLDTRFAGMDIRLTQLEKDVSFIRTCFDPPPPPPSSS

SEQ ID NO: 178297 - protein, 87 aa, Glycine max
  Coding DNA Sequence Number=SeqID_86612
  Subcellular localization annotation: CTP_CleavageSite=57; ConfidenceScore=5.50e-01
MSFLVFPMFSSNKRWWRLLAYSFLGRRTHKSRVTLPPKAPMELVCLGSSSSMDSFASWMMNDSGMEKKEREETPLQGEDESRRSSPP

SEQ ID NO: 178298 - protein, 71 aa, Glycine max
  Coding DNA Sequence Number=SeqID_86613
TYQGNPCGVYPDLSSFIGSGVYPDLSSFTGSGVYPDLSSFTGSGVIQTFVACIKRSAPTKVHIIWYQSFGS

SEQ ID NO: 178299 - protein, 102 aa, Glycine max
  Coding DNA Sequence Number=SeqID_86614
MMTTKDDDKSDEQKAQVNQRTSQENQEQVKSSRIKKNSRLKKKAYKQVSRFKIQDLKNQISRFKNQESRLKISRIKIKIQDSRSRFKTQDSRMKKRLNQDKY

SEQ ID NO: 178300 - protein, 121 aa, Glycine max
  Coding DNA Sequence Number=SeqID_86615
MCSATDYKTKSIGVSVGALHSKCYVSVASNLFGWKCSMAEVAETLQYMMSPQGRNTWTVDDFVPHVEKITILSEEQERIIEPVSHGPAKEHQFPSQELHTLQSSVETHGIGRRSQVLKLKA

SEQ ID NO: 178301 - protein, 72 aa, Glycine max
  Coding DNA Sequence Number=SeqID_86616
  Pfam annotation: Domain name=4F5; Domain location=9-64; Score=60.5; E_ value=5.6e-15; Accession=PF04419.5; Description=4F5 protein family
MWKLRRGQRGNQRERDRERAQARAGGKTKQPKNDGLTPEQRRERDAKALQEKTAKKAAQAAGGNNAGGGGKK

SEQ ID NO: 178302 - protein, 92 aa, Glycine max
  Coding DNA Sequence Number=SeqID_86617
MERRHNFNNGKRSQESSPTHKCYKCNQPSHIKAHYPTNESWPEKNEKKSHEERRSKKAYIAWDDNDSSDGSEKEINLLSKDYESDENISQED

SEQ ID NO: 178303 - protein, 179 aa, Glycine max
  Coding DNA Sequence Number=SeqID_86618
  Homolog annotation: Hit_ID=A5C7C5; Match level="QueryCoverage=78%, HitCoverage=23%, E-value=1e-10, Identity=28%"; Hit description =Putative uncharacterized protein
MEEGFSTNKPLRGIKYDYWKEHMIAHFESIHIDRCGQWAKEQKLRFLLNSKARNVMLCALSKEEYIKVHSFRSSKQIWDTLVVTYEGTSQTTSNNTKSLKVKNLNSMSFEELDGTLKEDFDKDELAFISRKIHKMWRNRGGFKWRNSSRRMPKEKKDKDRSSIICYGCKKPGHFKFESS

SEQ ID NO: 178304 - protein, 252 aa, Glycine max
  Coding DNA Sequence Number=SeqID_86619
MGAKYLKVVKRGSHPNNGWSPDEIRESLTPFITRGFSDPNARVLRGVCKAWDAVQRKDKELRGNENGIVGGYRKWLRFHTQGLDWLPKLMAVREEEAEAPEESEEPLPKPWSRKPRGPERKNTSETSFEELYGATTASLSSEETKGISRELKLSETEGKMLAIIDKYKEKLNLATAHEHRLVDEYTKVFAEKEAGGRVIDSLHGKAMIWMDRFASTLNRNQELPQLLARAKAMTGIYSASRRFTSSSTTVSK

SEQ ID NO: 178305 - protein, 68 aa, Glycine max
  Coding DNA Sequence Number=SeqID_86620
MMLVSVVVVAVVIVTIVMVVIDNSGDNNDYDNGCNKGYSGNNEDDHDSGSWCADDGGGIGHYSSDGNE

SEQ ID NO: 178306 - protein, 224 aa, Glycine max
  Coding DNA Sequence Number=SeqID_86621
MVIDQSLFFSLTHLPSQGAPIEGTIVDDWKFDYSSHDARRMVCNDQAEMTSRLLAGSTGPIWFGTECIKALRANAPLPYPHLITLFLRHFQILLDDEPFVQVKRSFAIGAGAVTSFGYRKDRNGQWLKKDALPPQDERTPSPPPQREDSALMNEVLSELWGLRSYVGDRFDSLDSCFAGMDIRLTQLEEDVRYIRQSFDLPPPPPSSKILVSDYKSLISRVFWL

SEQ ID NO: 178307 - protein, 182 aa, Glycine max
  Coding DNA Sequence Number=SeqID_86622
MLRNLVDYIIIPFLTYGMLRNLTNCAMMLPFDFRYSIIYNSTLSTRYKYLLPLSLIQIIISKLPTIIYKSRIIYKANNSPYKQGLAPLLIYYKYRFHQTPLHVIIHNLLSHTHHMATSMCPSFSLSLIRGPPSCQRYPQCRHVKFGTPLYHVNLDVPSEKAYGIELDTNGYKRYAFTLPLTE

SEQ ID NO: 178308 - protein, 230 aa, Glycine max
  Coding DNA Sequence Number=SeqID_86623
  Homolog annotation: Hit_ID=Q6WAY6; Match level="QueryCoverage=70%, HitCoverage=29%, E-value=3e-12, Identity=30%"; Hit description =Putative uncharacterized protein
MYDTFDQRCEKSGARIVYCTKALYVWLVSYLFHQEGRPVCPLQGHRLYAEKGKANWDQLLASMEGVSVNWFPRWKEGRTRILTSCEGFPNVPLMGTRGCINYNPVLAIRQLRYPMRGAPSEESIVPFIAQGFNDPNARDKELRGSSNGIIDGYCKWLRVRTQALDWLPKLRATREEEAEALEESEEVQALKAELERAWAVKEKFKSTAIKVRREYVELRDANMATTEALE

SEQ ID NO: 178309 - protein, 142 aa, Glycine max
  Coding DNA Sequence Number=SeqID_86624
  Subcellular localization annotation: CTP_CleavageSite=40; ConfidenceScore=5.30e-01
LPFYLMQANDHPQLEPVVKTPSQPQPSPLIASTLTKKRKSASAGININPPTSSKQECPNKRFVDLTEELGCIKKELADLTPKSTLLNLELKAPPFVPSTSVAPFAVIPPIAIMDYIVEIVVKVSTAHATAIAQMLPLLPPTL

SEQ ID NO: 178310 - protein, 69 aa, Glycine max
  Coding DNA Sequence Number=SeqID_86625
MVDYTPSSFADFVFAGCHTQISSEDHMFGGMQPSLDHFKDVPTEGGAFWWKQPSSPGRAGWQPLPSFPL

SEQ ID NO: 178311 - protein, 143 aa, Glycine max
  Coding DNA Sequence Number=SeqID_86626
  Gene Ontology: Mol. function=DNA-directed DNA polymerase activity; Cellular component=intracellular; Biological process=nucleobase, nucleoside, nucleotide and nucleic acid metabolic process
  Homolog annotation: Hit_ID=A7P230; Match level="QueryCoverage=87%, HitCoverage=13%, E-value=1e-62, Identity=92%"; Hit description =Chromosome chr19 scaffold_4, whole genome shotgun sequence
GHNISGKDLRVHCSLNINTETGRLSARRPNLQNQPALEKDRYKIRQAFIAAPKNSLIVADYGQLELRILAHLADCKSMLEAFEAGGDFHSRTAMNMYPHIREALEKKEVLLEWHPQPGEDKPPVPLLKLMTSNIVTTRVLAGA

SEQ ID NO: 178312 - protein, 80 aa, Glycine max
  Coding DNA Sequence Number=SeqID_86627
MKLGLIRFDEGSRRRNQERVRKFLQDLEATAIPEEEPQSFEASSSFPIVGHSHLDHIEDHIMDEEPRRVTLEDYSSSNVP

SEQ ID NO: 178313 - protein, 151 aa, Glycine max
  Coding DNA Sequence Number=SeqID_86628
  Subcellular localization annotation: CTP_CleavageSite=34; ConfidenceScore=5.10e-01
MASFSQMQSQIQSQMQSQGLALPPEPLVGPSDPRVSTKGSCVDPSGNDPETGDSDRCSLYIEADPPRLVALGRVYEGSTVVHNTHLLTGQVKVGVEEVTDANAPVPIPTDEVAVSPAKPPPKPDPEVDDPLYLMTLTILELLLRPYQVAVC

SEQ ID NO: 178314 - protein, 66 aa, Glycine max
  Coding DNA Sequence Number=SeqID_86629
MALTHIQGRTMMQSYPARALGRRLQVDWARDPRAILGGEAPSSLAYSLVDGASPRLFSFAFRCISM

SEQ ID NO: 178315 - protein, 61 aa, Glycine max
  Coding DNA Sequence Number=SeqID_86630
MEEDPKKTLKFLDATNAINLVTSKKIVPQMRNGRRKVIRKEKEINLLTKDYESDENISQEN

SEQ ID NO: 178316 - protein, 881 aa, Glycine max
  Coding DNA Sequence Number=SeqID_86631
  Gene Ontology: Mol. function=6-phosphogluconolactonase activity; Cellular component=ATP-binding cassette (ABC) transporter complex; Biological process=carbohydrate metabolic process
  Homolog annotation: Hit_ID=A4W8A9; Match level="QueryCoverage=26%, HitCoverage=71%, E-value=7e-70, Identity=57%"; Hit description=6 -phosphogluconolactonase
  Pfam annotation: Domain name=ABC_tran; Domain location=130-461; Score= -25.5; E_value=9.3e-05; Accession=PF00005.18; Description=ABC transporter
LARCGAGLGGDGVSADGARHSSGTGSGRQPAGTGGTYPGRGPLAGVFHHHTAADFPGHHRWHRAGVRPLARHCGAAVRGGDCAGAAVAGGLRAAGALGPQAAGSGLMLKINIAQQLGEHQLNVDVEIPASGITAIFGVSGAGKTSLINAISGLTQPQSGQIALNDLWHGAQNESAVRGAGDAAGTGRAAGSLSGLAVGWRKAARGDGPGAAERAGYPADGRTAGVARSATQARTDALFAEAGEAGGDSAAVREPQPGGDCPAGESGAAQQRTARAGAGAASGLPDDRAVAWRSAHLGQPGESAGEKRTAHPYRLGGRVAGAAAAAKYLDPQYLTGAGGGAAGAGRPGRSEAAHRRQRAVGAHFTVGARRTEYPARSVAVCADQERVDYRVTQTGRQLGTSGLRISAFFRAFFRPTLLMPCAATSLALQHFLVDHLRNARLKVGADHFARACFDGVIGIAHRHAQPGLLQHAEIVVIIAKRQHVLHAQTLARHPLRQAFAFAVAGLGDVDLIVPRPFTRQTQLAFGAFGKLLQRAGIRMRQGKFPDRLRVVRRLRQTRHLHKQRALRFRQRLRPVEGARHMAGRFLRIGSQHPLRLVIVQVRAVTADGGRCQLQRLIKRGAVEVKGDYAVAHYTFRPDPESQQIHAWHDAGRWRTDVIAGHGCGRPGAADGGEPEERFSLCRRASEFRVLAYRIAADGTLSLAGEAPLPGSPTHISTDRQGNYLFCGSYNDACVSISPIGSDGLPQAPLQVINGLEGCHSANIDLSNQTLFVPALKQDRICLYQLQADGTLAPRAQPQVTTVEGAGPRHMAFHPNGAYGYVVNELDSTVDVWALNNVNGQVERVQSLDIMPPGFSDTRWAADIHITPDGRSPVCLLTAPAAR

SEQ ID NO: 178317 - protein, 136 aa, Glycine max
  Coding DNA Sequence Number=SeqID_86632
  Gene Ontology: Mol. function=transferase activity, transferring nitrogenous groups; Biological process=biotin biosynthetic process
  Homolog annotation: Hit_ID=Q47829; Match level="QueryCoverage=27%, HitCoverage=9%, E-value=1e-08, Identity=73%"; Hit description=8 -amino-7-oxononanoate synthase
MASDSAIQPLIVGENRTALALSQRLAQAGCWVSAIRPPTVPPGGGAGIWPGGRALRTACSAAAPERRGAAGAGAGRIWPAAAGCRLRHRLVQPLLARSRSPGLRAGSVSGDAAGGTRTALGARLFTGRYRPVTAGG

SEQ ID NO: 178318 - protein, 181 aa, Glycine max
  Coding DNA Sequence Number=SeqID_86633
  Subcellular localization annotation: CTP_CleavageSite=43; ConfidenceScore=5.41e-01
VIRMTTPPPSPTQAEIPSDGTSRKTRQATRLRRLTTRTLDQARATISVNPATGRGFGPHKDQFHSYLRVVARDKIPIVHPSWNDAKFDIPKGDNAKKKVMSTVATRWRQFKSALTTKYVYGNTDGQPKDDPLVKYGIDAKDWAEFAKMRQTLPGRGYGKRHKRFKSTMTLRTCCLGEAMSC

SEQ ID NO: 178319 - protein, 259 aa, Glycine max
  Coding DNA Sequence Number=SeqID_86634
MRGAPTEESMSPFLVRDLGAQSSKTIQRIHKAWETPLRKDQELRGIRNGIIGGYHEWLKVHIRGLDWLAKLKVVSEESFEAPEEDEEVQALKSELGKAKLAKEKFKARKEEYGRNKFRGALWGSNNELKLRREERDQSRAHSMVLKEELIACSRSKRSLSQRLCETETNMLAIIAKYQEELGLATAHEHRIADEYAQVYAEKEDRGRVIDSLHQEATMWMDRFALTLNGSQELPRLLAKAKAMADTYSAPEEIHGLLGY

SEQ ID NO: 178320 - protein, 113 aa, Glycine max
  Coding DNA Sequence Number=SeqID_86635
MRPDEVVLPEPIILVIHDIVEVGESRLRQEATTLERTPQTPEDSLSPGMDLSFAQQVADPPTPVHERQADPPTPIMEMLEDPTMSVLRLSSTPPTTPVLHLTDEEDMQDTQGT

SEQ ID NO: 178321 - protein, 114 aa, Glycine max
  Coding DNA Sequence Number=SeqID_86636
PNGTRLCLNGKRGADNRKGISAYHVCRMTKLGLCVPTDTTVSEWQRGADNRKVSPRIIMTKLGLCVPSDTTVSEWQRGADNRKVSPRIIMTKLGLCVPSDTTVSEWQRGADNRK

SEQ ID NO: 178322 - protein, 152 aa, Glycine max
  Coding DNA Sequence Number=SeqID_86637
MTMIVDTLPVFYYGKRWATHLQSFEDLVFASERIDVGLKKGKFDHPTRTTEKTGANKEGEDEGETHAVTAIPVRPSFPPTQQYLYSANNKPSPYPPPRYPQRPSLNQPQSLSTALPMTKTTFSTNQKHQPRSEFCSEKACRIHPNSSVLCQT

SEQ ID NO: 178323 - protein, 175 aa, Glycine max
  Coding DNA Sequence Number=SeqID_86638
MLLSSNVIYICVRVVMLVRMIRTRLFTAARMKSCPGMHSSCVIASLSGCARTVGPPPISGGGPEPLKETTGPLPEAQVSVKHLRIEDLNSLKVRMWSTLKMRTHSPLKVRACNPLKARMYSPLEVRACSPLKVRACSPLLARTCSPLKVRTCSPLKVRACSPTKVRVTSTQGEGV

SEQ ID NO: 178324 - protein, 23 aa, Glycine max
  Coding DNA Sequence Number=SeqID_86639
NLAKVSTVLRRSSFVLHRSSIFN

SEQ ID NO: 178325 - protein, 143 aa, Glycine max
  Coding DNA Sequence Number=SeqID_86640
  Homolog annotation: Hit_ID=Q84VH5; Match level="QueryCoverage=79%, HitCoverage=20%, E-value=4e-43, Identity=67%"; Hit description =Envelope-like protein
KLSAGKLSVKYAILHRIGAANWVPTNHTSTVATESFAVKLPIAFPTVLCGIMLSQHPNILNNIDSVMKRESPLSLHYKLFEGTHVPDIVSTSGKAAASGAVSKDALIAELKDTCEKAAEEEEEAAEGRGKMQQRILKSDDDDS

SEQ ID NO: 178326 - protein, 484 aa, Glycine max
  Coding DNA Sequence Number=SeqID_86641
  Homolog annotation: Hit_ID=Q2HW90; Match level="QueryCoverage=74%, HitCoverage=71%, E-value=1e-36, Identity=31%"; Hit description =Putative uncharacterized protein
MGTNQNGKRFYQVKIKGLDVTSLKELRRLMGPLQRQAFRKVYGKILDLTTAKVFTEAVVSPAQYYDQPLRCFTFGDFQIVLTVEEFEEILGCPFGGRKLYLLSGFLPSLSNIAAVVGDSAKELDRMKQTRNGVVGLSRKYLEGKARDMANQEEWVPFADILALLIFGVVLFPNVDGLVDLATIDAFLAYHHSKESPVVAILADLFDTFDRRCEKNNTRIVCCLPALCVWLVLHLFRQDIRHPCPLQSYRSCIEKRRVDWDQYLAGIGGSTINWFPRWKEGNEGLLFSCGDYPNVPLIGTRGCINYNPALAIRQLGYPMRGAPTKESLSPFLVRDFDTQSFKIVQRVHKEWESPLRKDKELRGIRNGIIGGYHEWLRVHTRGLDRLSKLKIINEENFEAPEEDEEVQALKSELGKARLVKEKFKLVATDIRKECVGLREENAATARALERETKRARKEEHDRDKFRGALWGSNNELKLRERGKRP

SEQ ID NO: 178327 - protein, 206 aa, Glycine max
  Coding DNA Sequence Number=SeqID_86642
TQLDMNVGALISGQIISMDQSNSSRLRFPTLIIILCRSRGVISDSLAFERLSPIINLAYIRKNCWNPDDPIVIIRGARRPRARPAKVPATSTAPPPSRMTTTPSTLPPADFQHSIPMVEQFNEWVAWPGTQPPLHKEDEDPATQEAAATSEKSLEATPELPAPVANTTSPQQAVDPSTPEDQTTPVLSPNTSPIATPVLHLSEEEE

SEQ ID NO: 178328 - protein, 55 aa, Glycine max
  Coding DNA Sequence Number=SeqID_86643
MAKSPWPQQQGPSLYDRTTKLEETLAQFMQVSMSNQKSTESAIKNLEVQVGQLSK

SEQ ID NO: 178329 - protein, 312 aa, Glycine max
  Coding DNA Sequence Number=SeqID_86644
  Homolog annotation: Hit_ID=Q6WAY6; Match level="QueryCoverage=34%, HitCoverage=19%, E-value=3e-10, Identity=32%"; Hit description =Putative uncharacterized protein
MDGLVDLAAIDAFLRYHHSKESPVVAILADLFDTFDRSAINWFPRWKEGKEGVLFSCGDYPNIPLLGTRGCINYNLALAIRQLGYPKRGAPTEESLSPLLVRDLGAQSLKVIQRVHKAWRSLLRKDKELRGIRNGVIGGYHGWLRVHTQGLDWLSKLKVIDEENFEAPEEDEEGPQGGYGREKFRRALWGSNNELKLRREERDRSRVHGMILKEELAACARSKRSLAQHLEATEQSMLAIIGQYKEELNKSVTHAQKLAEDFAQVYAEKEAKGRVIDALHQEATMWMDRFALTLNGSQDLPRLLAKAKAMAE

SEQ ID NO: 178330 - protein, 134 aa, Glycine max
  Coding DNA Sequence Number=SeqID_86645
MASPPASPPPPPPLAPSDASASPPFGAERPVVHVDPSTDKADDPHRKKLRTYLGIVVRDMVDVTYENWKEAEFEIPEASDSMTKRKLLQTVGERWRKFKSDLMRKWALAADQDGVDDTVCEKYDISKEKWAQFC

SEQ ID NO: 178331 - protein, 105 aa, Glycine max
  Coding DNA Sequence Number=SeqID_86646
MRSLPLNPNPYLSATNLDSAVTDITYMVMQHDPSLVSPLLLLHGRNIEAITEIKQMGNCSMKGTIGECHHSIRVMCDSGAILQLKAPKTVAQVLQHYPGTTPFCS

SEQ ID NO: 178332 - protein, 121 aa, Glycine max
  Coding DNA Sequence Number=SeqID_86647
  Homolog annotation: Hit_ID=A7PHK4; Match level="QueryCoverage=48%, HitCoverage=11%, E-value=1e-10, Identity=53%"; Hit description =Chromosome chr17 scaffold_16, whole genome shotgun sequence
  Subcellular localization annotation: CTP_CleavageSite=25; ConfidenceScore=5.28e-01
MFPSPLSCLFVSSLSLSLSVSRSASCNKYREEPFRRHTFTKVQKSHVGDVAFLHKVFLFLEHWGLINFDTAPPSSHADEKYVEEEYCKGPVTRAMSMRLQEDWARAFEEGPRVLMKLRVDF

SEQ ID NO: 178333 - protein, 111 aa, Glycine max
  Coding DNA Sequence Number=SeqID_86648
MANIYAPCDLQGKRQLWKSLSTRKLQSQLGKGIKWASIRNLVRKHKIDLLCLQETKRDSIDRALCQALWGHSDFDWESFPADNTSGGFSVLKGFHHVGGGMAGRKSEGSGG

SEQ ID NO: 178334 - protein, 144 aa, Glycine max
  Coding DNA Sequence Number=SeqID_86649
  Subcellular localization annotation: CTP_CleavageSite=20; ConfidenceScore=5.57e-01
MATTPVWPPPPPPPSHTSASSSTVKRTHKATPLRSLATRPPGAERLVVNIDPDTGKVDGPHKKKLRTYLGTIARDKVDVTYETWKEVLAAQKDLIWEDIQGVRKKGQAIQKQNTAPHVLSCGGYEYLEEKLMSEKTKKKLEETA

SEQ ID NO: 178335 - protein, 114 aa, Glycine max
  Coding DNA Sequence Number=SeqID_86650
MGETYEIPHHNLADFEPCLGCATKGQAVHVGSAPPAMAENGKLDQIEERLKVIEGSGDYAFANLEELFLVPNVVTPPKFKVPDFDKYKETTCPKNHLKDVLSEDGVIQQKMRNC

SEQ ID NO: 178336 - protein, 59 aa, Glycine max
  Coding DNA Sequence Number=SeqID_86651
MTNANCPQESLHSVSNGNLSWVCDNQEGLGFEYTSQPTAYETSRPGLLSGPHEGGCVYL

SEQ ID NO: 178337 - protein, 29 aa, Glycine max
  Coding DNA Sequence Number=SeqID_86652
MRTGISGKGSNGQIGRQLVLTGTYLLQDR

SEQ ID NO: 178338 - protein, 182 aa, Glycine max
  Coding DNA Sequence Number=SeqID_86653
  Gene Ontology: Mol. function=oxidoreductase activity; Biological process=electron transport
  Homolog annotation: Hit_ID=A7Q3C8; Match level="QueryCoverage=47%, HitCoverage=15%, E-value=8e-17, Identity=48%"; Hit description =Chromosome chr13 scaffold_48, whole genome shotgun sequence
MKNQSQVQCWCLVGDFNCIRHPAERVGSTLCNPDTNLIAEFNMVNVDLVCIQETKRENFNKSICQAIWGDSTAQWDCVPSVQAAVVVVGILSWILSVYGNLWHESQRVRKRLQMQGIKGPPPSFLHWNLPNMQRIQSQTKADSTFNSNHSDQFLAHDYTTTLFPYFEHWRKQYGTLLLLLIY

SEQ ID NO: 178339 - protein, 48 aa, Glycine max
  Coding DNA Sequence Number=SeqID_86654
EKDSFGLEEHIGIDLSGNTDFMHIVFKKTGKASEVEVKDVKLNHPKEV

SEQ ID NO: 178340 - protein, 246 aa, Glycine max
  Coding DNA Sequence Number=SeqID_86655
  Gene Ontology: Mol. function=structural constituent of ribosome; Cellular component=ribonucleoprotein complex; Biological process =translation
  Homolog annotation: Hit_ID=O81363; Match level="QueryCoverage=60%, HitCoverage=61%, E-value=6e-69, Identity=79%"; Hit description=40S ribosomal protein S4
  Pfam annotation: Domain name=KOW; Domain location=123-157; Score =35.2; E_value=2.3e-07; Accession=PF00467.20; Description=KOW motif
  Pfam annotation: Domain name=Ribosomal_S4e; Domain location=50-116; Score=81.8; E_value=2.2e-21; Accession=PF00900.11; Description =Ribosomal family S4e
  Pfam module annotation: Pfam domain module=KOW::Ribosomal_S4e; Domain location=123-157::50-116
GLVDKDCRCKALRVRFTTDGEADASEGRGGGGGGKGGGGGGQAEAVSIPKTNENIRLLYDTKGRFRLHSIRDDEAKFGPKGIPYLNTYDGRTIHYPDPLIRANDTVKLDLEKTRLSIFIKFDVGNVVMVTGGRNRGCVGVIKNREKHKGSFKTIHVQDATGHEFASRMGNVFTIGKGTKPWISLAKGKGIKLGSNSVNILVPIDCSPKGKLVEMNTQCAHADNGCGSCSYEDNSMNEPILNSKLEA

SEQ ID NO: 178341 - protein, 138 aa, Glycine max
  Coding DNA Sequence Number=SeqID_86656
  Gene Ontology: Mol. function=two-component response regulator activity; Cellular component=endoplasmic reticulum membrane; Biological process=two-component signal transduction system (phosphorelay)
  Homolog annotation: Hit_ID=A7QMR7; Match level="QueryCoverage=93%, HitCoverage=16%, E-value=2e-55, Identity=79%"; Hit description =Chromosome undetermined scaffold_127, whole genome shotgun sequence
MEGVQLGSIGLWSIHNMLVCQKVSDFFIAIAYFSIPLELLYFVSCSNVPFKLVFLQFIAFIVLCGLTHLLNAYTYYGPHSFQLFLSITVAKFLTALVSCATAISFPTLIPLLLKIKVRELFFRQNVLELGQEAGMMKK

SEQ ID NO: 178342 - protein, 241 aa, Glycine max
  Coding DNA Sequence Number=SeqID_86657
  Gene Ontology: Cellular component=outer membrane-bounded periplasmic space; Biological process=protein transport
  Homolog annotation: Hit_ID=Q8X6L5; Match level="QueryCoverage=48%, HitCoverage=58%, E-value=9e-36, Identity=61%"; Hit description=No significant matches
MVQSMSGQPPQVITADSNPQMFQFNHLLRALFQADEQVLRENFVLDFHDDGGDGWQLSLTPKAAPLNKIFNRIDLQGAAYLNRITLDDRQGDKTEITLSDTRTQPGQLTDEERARFAAAHSVLALLPQQNLGQAPAEIQQGFMQRLDRQLVWLVSAPGADGDAAAAWLQAQLRALPMLSEVSGALDDDQLQRWGSFAYQHRNGLIDPLTRARLQHGGGAQADWILAQLFSAFAGVSSKELA

SEQ ID NO: 178343 - protein, 68 aa, Glycine max
  Coding DNA Sequence Number=SeqID_86658
MLGFTSNSPQISASPHQLDLAPYALGPYNAQWNAPGLLHDKHTLRSSCILREMEVVFVIGSAVDRLCG

SEQ ID NO: 178344 - protein, 177 aa, Glycine max
  Coding DNA Sequence Number=SeqID_86659
  Gene Ontology: Mol. function=protein transporter activity; Cellular component=integral to membrane; Biological process=protein secretion
  Homolog annotation: Hit_ID=A4W548; Match level="QueryCoverage=100%, HitCoverage=46%, E-value=3e-89, Identity=94%"; Hit description =Secretion protein HlyD family protein
  Pfam annotation: Domain name=PsbY; Domain location=1-32; Score=-0.4; E_value=0.085; Accession=PF06298.2; Description=Photosystem II protein Y (PsbY)
MDLLIILTYVAFAWAIFKIFRIPVNQWTLATATLGGVFIVAGLILLMNYNHPYTFTAQKAVISIPITPQVTGVVSEVTDKNNQLIKKGEVLFKLDPGRYQARVDRLQADLVTATHNIDNLKAQLAEAVANTTRVSAERDRLYKDYQRYLKGSQAKVNPFSESDIDNARQNYLAQDAL

SEQ ID NO: 178345 - protein, 51 aa, Glycine max
  Coding DNA Sequence Number=SeqID_86660
MRIPFLQAKVQKATRPTWAFQGVPIEGGAFWWKQPNLPGRARRQPPPSFPL

SEQ ID NO: 178346 - protein, 41 aa, Glycine max
  Coding DNA Sequence Number=SeqID_86661
MHEYDAGMICPLGCHEEMQDTIKEYARADFVADWMVGNEKG

SEQ ID NO: 178347 - protein, 143 aa, Glycine max
  Coding DNA Sequence Number=SeqID_86662
MLATHFGYRATARKPASNCFFTSSFIFKDVSGFILLSFCFTGEHSGFRGLHYARCVNAGAFLHSPISQLEIRRAWSYQIQCTRNIIFVYRDHLTFVSQTRAYKASTYVAGRASFTFLPQPRALTTALSFRDASLYIRLSGFIA

SEQ ID NO: 178348 - protein, 72 aa, Glycine max
  Coding DNA Sequence Number=SeqID_86663
MDTQIVDALAKKGIAKLFPIQFFIMPSGDRDGYMSDPGHDLNERGSVSSLNAHRESVFVYVRAFTRKEAQKL

SEQ ID NO: 178349 - protein, 32 aa, Glycine max
  Coding DNA Sequence Number=SeqID_86664
MKVFHRLHRLVLRRSSVFNRIKSERSFTRNHV

SEQ ID NO: 178350 - protein, 305 aa, Glycine max
  Coding DNA Sequence Number=SeqID_86665
  Gene Ontology: Mol. function=RNA-directed DNA polymerase activity; Biological process=regulation of transcription, DNA-dependent
  Homolog annotation: Hit_ID=A5C5U6; Match level="QueryCoverage=80%, HitCoverage=11%, E-value=1e-45, Identity=38%"; Hit description =Putative uncharacterized protein
MASESDDNSETDLQKQIQKAKQTKIVCNQKPSQSLTKQESTPQPGNSYISKNKFFNVLQMEPEYWDKNPFKATAKAFPPGFHYKPIATNKTRKFYEFILIDTNSVSIKHFKDPKDPNLNTHSTIQILKVMQPRHYGSNLNQPKKFSAPFDPAGYNYWDYIDAWTNVFWHQNSKFKHSWLIYFKNNTAYNFPNWFLQWWNYFGPIPQIFPEEVQQGFEQFNKLYNSKESRIPADLKYFSSFALSWIFSWQYRYEKTENNKQYPPLQRHAVVKWWSQFDTSKAAPDQVKNWFQSNPEFLKPADPETS

SEQ ID NO: 178351 - protein, 47 aa, Glycine max
  Coding DNA Sequence Number=SeqID_86666
MADSGQQTHCRHLQSPQLIYKGWSVAYDLWSTSRRPSPKPKGTPSCS

SEQ ID NO: 178352 - protein, 84 aa, Glycine max
  Coding DNA Sequence Number=SeqID_86667
  Gene Ontology: Mol. function=sugar:hydrogen symporter activity; Cellular component=integral to membrane; Biological process =pathogenesis
  Homolog annotation: Hit_ID=P0A919; Match level="QueryCoverage=97%, HitCoverage=47%, E-value=1e-43, Identity=100%"; Hit description =Outer membrane protein X precursor
MPAGPAYRINDWASIYGVVGVGYGKFQTTEYPTYKHDTSDYGFSYGAGLQFNPMENVALDFSYEQSRIRSVDVGTWIAGVGYRF

SEQ ID NO: 178353 - protein, 98 aa, Glycine max
  Coding DNA Sequence Number=SeqID_86668
MTKARQKGVHKEKEGEACHPARPGELGCFLQKAPPSGELPRRPKWACMLGNFTGCATMLCFDFRHVTKLHELPNDGCQVPRSSQTRVASQQRMVPGQN

SEQ ID NO: 178354 - protein, 195 aa, Glycine max
  Coding DNA Sequence Number=SeqID_86669
  Homolog annotation: Hit_ID=A4WCH0; Match level="QueryCoverage=100%, HitCoverage=100%, E-value=8e-78, Identity=70%"; Hit description =Putative uncharacterized protein
  Pfam annotation: Domain name=DUF1282; Domain location=7-195; Score =376.2; E_value=5.2e-110; Accession=PF06930.3; Description=Protein of unknown function (DUF1282)
MNHVWGLLAHPNQEMRDIKQENESVSHHYTHHVLLMAAIPVICAFIGTTQLGWNLGEGQFVQLNMLTGIGLGILFYLIILGGVAVMGRVIHWMARDYPQRPSIQRCTVFAGYVATPLFISGLVALYPLVWLCVLAGALALMYTGYLLYVGIPVFLNIDREESLRFSGSTLAIGVLVFEVLLALTVILWGYGPRLF

SEQ ID NO: 178355 - protein, 148 aa, Glycine max
  Coding DNA Sequence Number=SeqID_86670
MKQQNESNLATAAAVSSVAEVAPTLLTAVHHPIPNMVGGEGSTPGHINNPSGVQSRHVVTFLPSSSKGNLLDILTGSTRIIESMLRETSTPTPRYPLRGRAQRTTSTQNHGRASKPPNAANVFVRERTTPGSGRKGETRSHRREIEGC

SEQ ID NO: 178356 - protein, 40 aa, Glycine max
  Coding DNA Sequence Number=SeqID_86671
MALKNKEAEQGTKFSTFREIRELLSDCEVPRGGGDIPPPV

SEQ ID NO: 178357 - protein, 339 aa, Glycine max
  Coding DNA Sequence Number=SeqID_86672
  Homolog annotation: Hit_ID=Q6WAY6; Match level="QueryCoverage=91%, HitCoverage=68%, E-value=6e-16, Identity=23%"; Hit description =Putative uncharacterized protein
QISAQELDHRKQVENGVVGIPRKYLEAKARILAGKGEWALFIDILALLIFGGVLFPNVDGHACPLESHRSCTEKGGANWDQLLANKEGASVNWFPRWKEGRTVVLISCGGFLNVPLIGTRGCISYNPVLAIRQLGYPMRGAPLEEEIVLVRKAWEVLQKKDKELRGSNNGPIGGYRKWLKAHVQGLDWLPSLRTAKREEVEALEEDEEVQALRTKLKQAQTTKRAHREEHGRNKFRGALWGSNNELKLRREERDQSRVDSLILKEELKACSRSKRSLSQRLCETETNMLVIITKYQEELNLATAHEHKVADEYARVYMEKEVRGRVIDSLHQEATMWMD

SEQ ID NO: 178358 - protein, 75 aa, Glycine max
  Coding DNA Sequence Number=SeqID_86673
MYPCQKWQENASQMNKMAPRKLSAKRSRKDAAAEGTSAAPDFDNHRFRSAEHQQRFEAIKEWSFHRERTRPAQGR

SEQ ID NO: 178359 - protein, 252 aa, Glycine max
  Coding DNA Sequence Number=SeqID_86674
  Subcellular localization annotation: CTP_CleavageSite=38; ConfidenceScore=5.16e-01
MLLAKQTIHSSLIQQQQQPQKQPTVEAPPQPSLKELVRQMTMQNMQFQQETRASIQSLTNQMGQLATQLNQQQSQNSDKLPSQAVQNPKKVSAISLRSGKQCQRTQFPVASSSAKTYQEGLSRIQKRREPLALNQKSVPVARVCGLCSSVDHHTDLCPSMQQPRAIEQPEAYAANIYNRPPQPQQQNQPQQNNYDLSSNRYNPGWRNYPNLRWSSPQQQQQHLLLPSKCCWPSRPYIPPPINNSSTPETAIS

SEQ ID NO: 178360 - protein, 206 aa, Glycine max
  Coding DNA Sequence Number=SeqID_86675
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=19%, E-value=1e-100, Identity=90%"; Hit description=DNA -directed RNA polymerase subunit beta
  Pfam annotation: Domain name=RNA_pol_Rpb2_1; Domain location=14-184; Score=128.1; E_value=2.5e-35; Accession=PF04563.6; Description=RNA polymerase beta subunit
MLGDGNEGMSTLPGLNQIQFEGFCRFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWARVSRKQKISILVYHQLWVRIKRNSRECLYPEISFLS

SEQ ID NO: 178361 - protein, 171 aa, Glycine max
  Coding DNA Sequence Number=SeqID_86676
MEAMKEQMAAMIEAMYIMKEIMESNAVVVATTSAAAEVDPTHPSGLNQVNPLVLDMVGQGREALGSTSGPHVVQSKISFLPYGLPPNYSPPNAVPVPNEDVNNSAPIPIKSQQPQSNHAHVSQPMRETYEAPRDHNLADVEPHLGYATEGQAVGCVPLPNTFEGPQFLPQP

SEQ ID NO: 178362 - protein, 27 aa, Glycine max
  Coding DNA Sequence Number=SeqID_86677
MIVVVALVAVVGLVAMATSKQDGIDIC

SEQ ID NO: 178363 - protein, 187 aa, Glycine max
  Coding DNA Sequence Number=SeqID_86678
MEDWGNFLHRILQKDFEDSAPIKVFLLVQGFNGTQRWLAAATGGRGWWRRILGVLNIGHSVGYHHRNHISKFVELGELDVLSVVHLGDIAEELGLSALLRPQFVASRFCFELEFHSECEAPLYLFFQSELIMMTLIITSCCGSNVFQGYFEDAKESRVKQNPKIQESSFKNQDSRFKNQVSRIKIQE

SEQ ID NO: 178364 - protein, 55 aa, Glycine max
  Coding DNA Sequence Number=SeqID_86679
MNIIVLFLGIARDLQSISDMREMTPTMQGKKKRESNNLKAERKTKKKWKIGVKVL

SEQ ID NO: 178365 - protein, 110 aa, Glycine max
  Coding DNA Sequence Number=SeqID_86680
NKLLSKQLEALTETLRCVICGGAHDSGCCLPNEEPTAHEVNYMGNQPINNFNAGGFPGFQHGQQYNQQQGHWRNHPGNQFNRDQGGPSTRPQQQRPSLYECTTKLEETLA

SEQ ID NO: 178366 - protein, 404 aa, Glycine max
  Coding DNA Sequence Number=SeqID_86681
MASRKRKAPASTSQEILPERNVMLYYTEFDEFIEELERRNWHKELTNFMDGSIDVAIVKEFYANLYDLEDKSPKQVRVKGHLVKFDADALNTFLKTYVIIEEGENLPANSRFRKGFELNADGLPLKILRKNLTTLAQTWSVFSFSNPVPTSYTSDITLDRAKLIYDIIQKMDMNLGHIISSQISLIAQHDSSRLGFPALITALCKTRGVTSDSLTFESLSLTINVAYVKKNCWNLDDSTVTFRGPCRTKGKRSEALPSSEVPPTTSTPSTTAPASFTSATYAPSPAQLPGSSLQPIMSVADFLSQVAWPRVHPSPSGGGEASAAQEPKPTKDDVPPKPFIIETDPIAQEEVAAQEPTSPVPVSRTLVPDDLQPSALASEPEQPIVQDPPAALVLDLNKHAEDQQ

SEQ ID NO: 178367 - protein, 75 aa, Glycine max
  Coding DNA Sequence Number=SeqID_86682
MEVRDKVKILPYRDLDELVQLCIRVEQQLKRKPSSNSYGSHSYPRKDQAHGILGAAPSKPMDDVTLPLNAPQRKP

SEQ ID NO: 178368 - protein, 98 aa, Glycine max
  Coding DNA Sequence Number=SeqID_86683
MLRGVLRSSKIQKSTRKKKKEKKKKKKEERVKQRRYRITTVIIPYIIRLLVVPPATVNDDKDDDKKLKDQSKNNSSESRTIQEFKIIIKKNSRLKKKV

SEQ ID NO: 178369 - protein, 73 aa, Glycine max
  Coding DNA Sequence Number=SeqID_86684
MLSVYRFQASKDLNLLEDDMPCQTQPDKETDVSSIGACRPRIFFINGFLCFLEDEWQRNGQGRERGDATSRRR

SEQ ID NO: 178370 - protein, 396 aa, Glycine max
  Coding DNA Sequence Number=SeqID_86685
  Homolog annotation: Hit_ID=Q84VH5; Match level="QueryCoverage=95%, HitCoverage=61%, E-value=1e-122, Identity=59%"; Hit description =Envelope-like protein
  Subcellular localization annotation: CTP_CleavageSite=21; ConfidenceScore=5.30e-01
MATAPKETSAPGSSSVPSSPSSTKAPSHQERPEFNIQPIQMIPGSAPVPEKLVPKRQQGVKTSENPSLATSPREVDTEMDKKIRSIVSSILKNASVPEADEDVPTSSTPNVSVPDADKDVPTSSTPNAEALLSPSEEESTEEEDQATEETPAPRAPEPAPGLDESNYGTEKSTQSLLPHPDGAKLQFLQKRKEISSSDSDDDVELDVPDIKRAKKSGKKVPGNVPDAPLDNISFHSIGNVERWKFVYQRRLALERELGRDALDCKEIMDLIKATGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYACIGLALQTGYPLIILPLLPQ

SEQ ID NO: 178371 - protein, 44 aa, Glycine max
  Coding DNA Sequence Number=SeqID_86686
VDSRGSPLAASRYLAPFVTQYVKSRDVPKIKRKQAYAIRENSVM

SEQ ID NO: 178372 - protein, 95 aa, Glycine max
  Coding DNA Sequence Number=SeqID_86687
  Subcellular localization annotation: CTP_CleavageSite=67; ConfidenceScore=5.65e-01
NEAHLGLPGSYPKGGAFWRKQPSSLGRAGKSKPRHFRNAFVTFPWVISRRFSTVLHRSSVFNQARLTGALSKGGKMRGVATNVYLWKTSEKPKET

SEQ ID NO: 178373 - protein, 163 aa, Glycine max
  Coding DNA Sequence Number=SeqID_86688
ELERRNWHKSMTKQMDGHIDVALVKEFYANLYDLEEKSPKQVRVRGKLIKFDATSLNAFLETPPVLEPGEQYTAYTRGRALEAPEEGFDYTVLVEGTSTRLFKENKGGPLDPTEWRRKRERRRHFKEKMSLEEAHHHRRPWIRAWRKKEMNEGRGREEHKILC

SEQ ID NO: 178374 - protein, 35 aa, Glycine max
  Coding DNA Sequence Number=SeqID_86689
MYQVTLLQGIEEKTAKLEGSEKALVARHEARQAVV

SEQ ID NO: 178375 - protein, 77 aa, Glycine max
  Coding DNA Sequence Number=SeqID_86690
MQRTESHQKSTDAAIRNLEVQVGQLAKQMAERPTGSFGANTKMNPKEECKVIFTRRESVEKEKRIEEDVHCSALPRC

SEQ ID NO: 178376 - protein, 37 aa, Glycine max
  Coding DNA Sequence Number=SeqID_86691
MVPSKGVVDASDGPWRRWAVAEAVEDDPFLFFDGSTI

SEQ ID NO: 178377 - protein, 96 aa, Glycine max
  Coding DNA Sequence Number=SeqID_86692
IEDFLHRIFEEDSEDSALIKVFLLVWGSNGKQWQLTAATGGLGWWKIRRSAHFLSVVVGLSAALGCSAQFPSVGVALSTPYSLSGRSKLIIFKIPT

SEQ ID NO: 178378 - protein, 60 aa, Glycine max
  Coding DNA Sequence Number=SeqID_86693
MASLLHLPIVRAFHTFELLYVDDIVDMLVELLECWIYKHFPFVGSALAAEDYDEKRPRAC

SEQ ID NO: 178379 - protein, 153 aa, Glycine max
  Coding DNA Sequence Number=SeqID_86694
MAPTRHPLDPDKSNRALGFPALITGLCRSFGVPVAPTKAAGAPPPPHQADQAGAFDIEQYLRHLVRQQAANHRAHVRTHDCLYQMSLSMQSQGSTSFSCPTPDQFRAEVAWPGDWPEAQAGEAPPEAPGDGEEAHEDEEMADLLDFLGGSGDT

SEQ ID NO: 178380 - protein, 86 aa, Glycine max
  Coding DNA Sequence Number=SeqID_86695
IQRLGVAKCPTYVFKKVTRTLRWFVKERGSRQNPCVTHMRKAQHGNWKNGTRRVCFVPLFKGPIWEKAKKVFSDNPQGGHISLDGL

SEQ ID NO: 178381 - protein, 70 aa, Glycine max
  Coding DNA Sequence Number=SeqID_86696
MPISPCRRIAPTRHPVDPEEPNRALGFQLGFRASISPTGCSSPPARDRAPQDTPVDLGEGPQGLGVFSSD

SEQ ID NO: 178382 - protein, 673 aa, Glycine max
  Coding DNA Sequence Number=SeqID_86697
  Gene Ontology: Mol. function=motor activity; Cellular component=cell projection
  Homolog annotation: Hit_ID=P15305; Match level="QueryCoverage=88%, HitCoverage=91%, E-value=4e-29, Identity=21%"; Hit description =Dynein heavy chain
VLTLRRLHALAFRGLHTLNFRGLHAFAFKGQHVLTFRGLHVLAFRGLHALAFRGLHVLAIGGLHALTFRVLHVLSLRGLHILAFRGLHLLPFRGIHVRTFRGLHVLAFRGLQGLHVLTFRGLHALTFKGLHVLGFRGLHVLAFTGLHVHAFRGLHALTFRGLHVLTLRGLHALVFRGLHAVTFRGLHVFAFRGLHVLAFKGLHALPIRGLHALTFRKLHVLAFRGLHVLAFRGLHVLAFRGLHVVPSKEYRSSRLEGYTSLPLERTRPHLQRTTRPHHERTTHPRFQRATRPRLQRITRPPFKGLHVLAFRGLHVLAFRGGQHALAFRGLHVLAIRGVHALTFKGLHVLSFRGLNVLSFRGLHALTFRGLHVLAFRGLHALTFRGLHVLAFRWHHALTFRGLQVLAFRGLHALTFNGLHVLAFRGLHVLAFRGLHGLTFRGLHVLTLIGLDALAFTGLHAVTFRGLHVLAFRGLHVLAFKGPLALPIRGLDALTFRGLHILAFRGLHMLAFRGPHVLAFRGLHVLAFRGLHVLPSKDYMSSRLEGYTSLPLEGLHVLAFRGLHALAFRGLHVLAIRGVHALTFIGLHVLSFRGLHVLSFRGLDALTFKRDYTSLPSEGCMPSPLEDYTFLPTEDYTSSPSEGYTPSPSEDYTSSPIEGITLSPLEDYTFSPSE

SEQ ID NO: 178383 - protein, 36 aa, Glycine max; identical to SEQ ID NO: 103427
  Coding DNA Sequence Number=SeqID_86698
  Subcellular localization annotation: CTP_CleavageSite=23; ConfidenceScore=5.10e-01

SEQ ID NO: 178384 - protein, 253 aa, Glycine max
  Coding DNA Sequence Number=SeqID_86699
MRGAPTEESLSPFLVRDLGAQSLKVIQRVHKAWRSPLRKDKELRGIRSGIIGVIDEENFEAPEEDEEVRALKLELGKARLAKEKFKSAATHIWKECTELQEENAATAIALEQETKRVRKEEHGREKFRGALWGSNNELKLRREERDRSRVHGMILKEELAACARAVQGRVETVCAHEQKLAEDFAQVYAEKEVRGRVIDALHQEATMWMDRFALTLNGSQDLPRLLAKAKAMAEEQMKADLSALKDQMASISE

SEQ ID NO: 178385 - protein, 132 aa, Glycine max
  Coding DNA Sequence Number=SeqID_86700
MKLGLGLLLPTRVHVPVYNGSTFLSPIQSRILIVVTVAVVVANDNGGGCNSDHGGDNNDDECHNDKDNGGDDDDNYSSGNPASQPVGIFCALGRGYVAVAAQSPNCKKTRGGHSTTVLLLFFDFCFTLHDRN

SEQ ID NO: 178386 - protein, 636 aa, Glycine max
  Coding DNA Sequence Number=SeqID_86701
  Gene Ontology: Mol. function=transporter activity; Cellular component= intracellular; Biological process=transport
  Homolog annotation: Hit_ID=Q94FN1; Match level="QueryCoverage=100%, HitCoverage=100%, E-value=0.0, Identity=79%"; Hit description =Phosphatidylinositol transfer-like protein III
  Pfam annotation: Domain name=CRAL_TRIO; Domain location=161-345; Score=149.8; E_value=7.5e-42; Accession=PF00650.11; Description =CRALTRIO domain
  Pfam annotation: Domain name=CRAL_TRIO_N; Domain location=69-144; Score=49.6; E_value=1.1e-11; Accession=PF03765.6; Description =CRALTRIO, N-terminus
  Pfam module annotation: Pfam domain module=CRAL_TRIO::CRAL_TRIO_N; Domain location=161-345::69-144
MSGPLDRFARPCFEGFSGSDEKKERRSDFEYSEDERRTRIGSLKKKALNASSKFKHTLRKKSSRRKSDGRVSSVSIEDVRDFEELQAVDAFRQSLIMDELLPEAFADYHMMLRFLKARKFDIEKAKHMWTDMLQWRKEFGADTIMQDFEFKELDEVVKYYPHGHHGIDKEGRPVYIERLGKVDPNKLMQVTTLDRYVKYHVQEFEKAFAIKFPACSIAAKRHIDSSTTILDVHGVGLKNFTKSARELITRLQKIDGDNYPETLCQMFIINAGPGFRLLWSTVKSFLDPKTTSKIHVLGNKYQSKLLEVIDASELPEFLGGTCTCEDQGGCLRSDKGPWKNPDIFKVICCSWKNPDTFKMVLNGGAWRSKQVVKVLNNERKVIVYAKPGYPTVKGSDTSTAESGSEAEDISSPKAMKSYSHLTLTPVHEEAKIVGKTSYASNLSGYDEYIPMVDIPVDAGWKKQASLQRSYTSKGAPPPLDTQKTPDGLQARMWVALSVFFLTVLTLLRQVAYPVTKKFPALSSNDDKSTSKPLPDTANMDVLPPSSTPTEENLLPSMLKRLGELEEKVDTLQSKPSEMPYEKEELLNAAVCRVDALEAELIATKKALYDALMRQEELLAYIDRQEEAKLRKKKFCW

SEQ ID NO: 178387 - protein, 282 aa, Glycine max
  Coding DNA Sequence Number=SeqID_86702
  Homolog annotation: Hit_ID=A7P8K7; Match level="QueryCoverage=100%, HitCoverage=94%, E-value=2e-60, Identity=48%"; Hit description =Chromosome chr3 scaffold_8, whole genome shotgun sequence
  Pfam annotation: Domain name=DUF241; Domain location=52-282; Score =115.4; E_value=1.7e-31; Accession=PF03087.5; Description=Arabidopsis protein of unknown function
  Subcellular localization annotation: CTP_CleavageSite=38; ConfidenceScore=5.16e-01
MASSPLNSKSGSHGRSNSLPSRPHPLILKCNEHLESLRASNETSSSLSNLRHKVGGLQDLIECVEKLIQLPLTQDVFLHECQENWVDELLDGSLRLLDVCTSAKEALLHTKECTRELQSIIRRKRGGEVELTAEVKKFLTSRKVVKKAISKALANLNSISKSCNFSSTADKDHRTVALISLLQDVEVVTLSTFQTLLQFISGSTRSKSNNWLSISKLIQPKRVGCSLVADESEFAQLDAALQSFVSLQSLLSHNLSSIQCFLSHVENLEMYIQDLEIGVEHL

SEQ ID NO: 178388 - protein, 77 aa, Glycine max
  Coding DNA Sequence Number=SeqID_86703
MIKPAAVVMGTRGRSLIQREVLLSPLLLLFQEKMMEMRQSSSGIVLSQGDDISNLIRLGFYEHIEGLYPTVWNCLYT

SEQ ID NO: 178389 - protein, 72 aa, Glycine max
  Coding DNA Sequence Number=SeqID_86704
  Gene Ontology: Mol. function=DNA binding; Cellular component=nucleus; Biological process=regulation of transcription
  Homolog annotation: Hit_ID=A7P902; Match level="QueryCoverage=70%, HitCoverage=53%, E-value=3e-17, Identity=78%"; Hit description =Chromosome chr3 scaffold_8, whole genome shotgun sequence
MHLQFAKYDKDTPERWYNVAKAVGGKSEDDVKRHCQILLEDLRHIESGHVPIPIYKSTPTTFPLSTTRTGRL

SEQ ID NO: 178390 - protein, 992 aa, Glycine max
  Coding DNA Sequence Number=SeqID_86705
  Gene Ontology: Mol. function=glucose-1-phosphate adenylyltransferase activity; Cellular component=chloroplast; Biological process =glycogen biosynthetic process
  Homolog annotation: Hit_ID=Q84UT2; Match level="QueryCoverage=52%, HitCoverage=99%, E-value=0.0, Identity=89%"; Hit description=Glucose- 1-phosphate adenylyltransferase
  Pfam annotation: Domain name=CBS; Domain location=619-780; Score =29.2; E_value=1.5e-05; Accession=PF00571.19; Description=CBS domain
  Pfam annotation: Domain name=CBS; Domain location=801-958; Score =13.1; E_value=0.0026; Accession=PF00571.19; Description=CBS domain
  Pfam annotation: Domain name=Hexapep; Domain location=414-431; Score =4.4; E_value=43; Accession=PF00132.15; Description=Bacterial transferase hexapeptide (three rep
  Pfam annotation: Domain name=Hexapep; Domain location=467-484; Score =16.8; E_value=0.081; Accession=PF00132.15; Description=Bacterial transferase hexapeptide (three rep
  Pfam annotation: Domain name=NTP_transferase; Domain location=88-366; Score=434.1; E_value=1.9e-127; Accession=PF00483.14; Description =Nucleotidyl transferase
  Pfam module annotation: Pfam domain module=CBS::CBS::Hexapep::Hexapep: :NTP_transferase; Domain location=619-780::801-958::414-431::467 -484::88-366
MASACVTLKANTHLANSEKGFLGERIKGGFNNSALVMNQLAIRSRSHKRVKHGVGVVSSVLTSNNAKESLTLQVPSFLRRRADPKNVVSIILGGGPGTQLFPLTKRAATPAVPVGGCYRLIDIPMSNCLNSGINKIFVLTQFNSASLNRHIARTYFGNGINFGDGIVEVLAATQTPGEAGKNWFQGTADAVRQFTWVFEDAKNTNVENVLILAGDHLYRMDYMDLVQSHVDRNADITVSCAAVGDSRASDYGLVKVDDRGRIIQFSEKPKGDDLKAMQADTSLLGLSSQDALESPYIASMGVYVFKTDVLLNLLKWRYPTSNDFGSEIIPAAVRDHNVQSYFFGDYWEDIGTIKSFYNANLALTEESHKFEFYDPKIPIYTSPGFLPPTKIDKCRIVDAIISHGCFLRECTVQHSIVGERSRLDYGVEVLDTVMMGADYYQTESEIASLLAEGKVPIGIGRNTKIRNCIIDKNAKIGKDVIIANKDGVQEADRPEDGFYIRSGITIIMEKATIEDGTGSCLQCCVTMQKAAEHPIVALGCMNARGKWQCPMPRGKIRAQVTMQSRKIADVLNVSDGGRGLENKEKNLSSNLHNDHDNQNQHVQIDSGSALQQFLDHIPISAIAGIKNSPAGDSIRDAIHALYKKDIFSAAIVDTSDSHAGSIRFSDRYIGLIDFTSMVLWCLEEFDKIKNDTMENHLMDLENDGLFSILDQVPQIGLTKVSELAKSFLWEPFFPVNMDDTVLHALLLLSKHRVHVLPVIQEPQAGLIGYVTQNAVVQHLLQSSELEWFDSIADKNISDFRFESQENPSCVYGDQTVANALDLLWQNQTCAVAVVDRQTKKLVGNVRNGDVYNLVKNNDLLRNRSILTVKEFIHIETDKVVTEQAIEHDHGALLTAGSLRLKNSFIPRMDLPVANKETETLKQIMEHTTETNSSFSFLINDNEQVTGLLTLRDIILQFAPPNMNSSINGGGFFEFALEQSGCQVKNGTMVRNH

SEQ ID NO: 178391 - protein, 1324 aa, Glycine max
  Coding DNA Sequence Number=SeqID_86706
  Gene Ontology: Mol. function=protein transporter activity; Cellular component=Golgi-associated vesicle; Biological process=intracellular protein transport
  Homolog annotation: Hit_ID=A7P925; Match level="QueryCoverage=65%, HitCoverage=99%, E-value=0.0, Identity=89%"; Hit description =Chromosome chr3 scaffold_8, whole genome shotgun sequence
  Pfam annotation: Domain name=Adaptin_N; Domain location=452-962; Score=517.6; E_value=1.4e-152; Accession=PF01602.11; Description =Adaptin N terminal region
  Pfam annotation: Domain name=Gamma-COP; Domain location=1033-1299; Score=377.9; E_value=1.6e-110; Accession=PF08752.1; Description =Coatomer gamma subunit appendage domai
  Pfam annotation: Domain name=HEAT; Domain location=563-599; Score =3.2; E_value=8.9; Accession=PF02985.13; Description=HEAT repeat
  Pfam annotation: Domain name=HEAT; Domain location=680-712; Score =2.4; E_value=12; Accession=PF02985.13; Description=HEAT repeat
  Pfam annotation: Domain name=HEAT; Domain location=713-749; Score =6.3; E_value=3.1; Accession=PF02985.13; Description=HEAT repeat
  Pfam annotation: Domain name=HEAT; Domain location=785-821; Score =1.7; E_value=15; Accession=PF02985.13; Description=HEAT repeat
  Pfam annotation: Domain name=HEAT; Domain location=926-962; Score =12.7; E_value=0.35; Accession=PF02985.13; Description=HEAT repeat
  Pfam annotation: Domain name=HEAT_PBS; Domain location=549-575; Score= 5.8; E_value=14; Accession=PF03130.7; Description=PBS lyase HEAT-like repeat
  Pfam annotation: Domain name=HEAT_PBS; Domain location=697-729; Score= 3.5; E_value=31; Accession=PF03130.7; Description=PBS lyase HEAT-like repeat
  Pfam annotation: Domain name=HEAT_PBS; Domain location=910-942; Score= 12.8; E_value=1.3; Accession=PF03130.7; Description=PBS lyase HEAT -like repeat
  Pfam module annotation: Pfam domain module=Adaptin_N::Gamma -COP::HEAT::HEAT::HEAT::HEAT::HEAT::HEAT_PBS::HEAT_PBS::HEAT_PBS; Domain location=452-962::1033-1299::563-599::680-712::713-749::785 -821::926-962::549-575::697-729::910-942
MNTRDHQMPKKFKALLNQNFEIQSEKILKTKEQILEGSKHDCEKSLVKNTHTTILEDFEPISSVPIYRNDDIYAKEENKVVKNFEPRPNVSAYGDNDVDAKPKKNVIKDFEPRPNVSAYGDNDVDAKPKKNVMKDFEPRPNVSAYGDNDVDVKPKKNVMKDFEPRPNVSAYGGNDVDAKPKKNVMKDFEPRPNVSAYGGNDVDAKPKKSVTKDFDPRPNVSSYNDNDIEAVEEKKIMKDFEPIPKVSTYGDDDVNTKEKKKVMKDFKPRPNVSAYGDNNVSAKEKKKVMKDFEPRPNVSAYGDNNVGAEKKKKIMKDFEPRPNVSAYGGNNVDEEAKKKVTKDFESRPNISAYGNNGVDAKKKKKVVDNDNIDAQGKPPEDFEPRPNISTYDEYGKLTDKSDMFSFGIMLLELVTGWRPVDNTGEYEVDWPLVKKDDDRDDEAEYSPFLGLEKGSVLQEARVFNDPQLDARRCSQVITKLLYLLNQGETFTKVEATEVFFAVTKLFQSKDMGLRRMVYLMIKEISPSADEVIIVTSSLMKDMNSKIDMYRANAIRVLCRITDGTLLSQIERYLKQAIVDKNPVVASAALVSGIHLLQTNPEIVKRWSNEVQEAVQSRAALVQFHALGLLHQIRQNDRLAVSKLVTSLTRGTVRSPLAQCLLIRYTSQVIHESGNTQSGERPFYDYLESCLRHKSDMVIFEAARAITELNGVTSRELTPAITVLQLFLSSTKPVLRFAAVRTLNKVAMTHPMAVTNCNIDMESLISDQNRSIATLAITTLLKTGNESSVDRLMKQITNFMSDIADEFKIVVVEAIRSLCLKMNFLSNILREEGGFDYKKAIVDSIVILIRDIPDAKEVGLLHLCEFIEDCEFTYLSTQILHFLGIEGPKTSDPSKYIRYIYNRVHLENAIVRASAVSTLAKFGAAVDVLKPRIFVLLRRCLFDSDDEVRDRATLYLDTLGGDGSVVETDKDVKDFLFGPFDIPLVNLETSLKNYEPSEEGFDINSVPKEVKSQPLAEKKAPGKKPTGLGAPPSTADAYERMLSTISECANFGKLFKSSAPVELTEAETEYAVNVIKHIFDRHVVFQYNCTNTIPEQLLEHVIVTVDASDADEFSEVFSKPLRSLPYDSPGQTFVAFEKPEGVPTVGKFSNILKFIVKEVDPTTGEAEDDGVEDEYQLEDLEIVAADYVLKVGVSNFRNAWESLGPDFERVDEYGLGPRESLAEAVNTVINLLGLEPCEGTEEVPPNSRSHTCLLSGVFIGNVKVLVRLSFGLDGPKDVAMKLSVRSEDETVSDAIHEITSKYRVGFIAIHLPHNDTSFFGVVNVR

SEQ ID NO: 178392 - protein, 274 aa, Glycine max
  Coding DNA Sequence Number=SeqID_86707
  Homolog annotation: Hit_ID=A9PIK5; Match level="QueryCoverage=74%, HitCoverage=83%, E-value=2e-32, Identity=33%"; Hit description =Putative uncharacterized protein
  Pfam annotation: Domain name=PIG-X; Domain location=81-232; Score= -67.3; E_value=0.0083; Accession=PF08320.3; Description=PIG-X  PBN1
MPTWRCIQLFIYFLAWASLICSPTSSSLADSISSPVHAKPFSPVNKFLMQSYYDRYINLHDLDFEKFMSQEVPYGSCDNLNFVLRLSDLKRTLIGEEFSDIAVFGDTNLELPSFLSNRSAVEIHLLVDPNILQEPTDINMELPLHARYQPLNGSGYSAIEFGAPDMVVRCSTKEKMENHNCFFKLEKDDANLYGAHIVWRIPSGIKAHAGLLYGGRMKTQFGMRLYYKQVAGNGYAVDKSEFWEVVTDSNNDVQKQIVHLGSGSVQLSDFSESK

SEQ ID NO: 178393 - protein, 79 aa, Glycine max
  Coding DNA Sequence Number=SeqID_86708
  Gene Ontology: Mol. function=phosphotransferase activity, alcohol group as acceptor; Biological process=phosphoinositide-mediated signaling
  Homolog annotation: Hit_ID=A7P941; Match level="QueryCoverage=75%, HitCoverage=3%, E-value=2e-15, Identity=66%"; Hit description =Chromosome chr3 scaffold_8, whole genome shotgun sequence
MKGEDEEASLGWFAFEPEWYDTNYTNFAHCEAQSVSLFVQYLSNMKGDTVQVGSKGNGQENGNTLADAVIILCLALTSA

SEQ ID NO: 178394 - protein, 52 aa, Glycine max
  Coding DNA Sequence Number=SeqID_86709
MSSPAQYSTAELHEMLAPAQHSTSKLHEAEKLGLVHIIGLVVSQLEMAKLIN

SEQ ID NO: 178395 - protein, 254 aa, Glycine max
  Coding DNA Sequence Number=SeqID_86710
  Gene Ontology: Mol. function=DNA binding; Cellular component =chromatin; Biological process=regulation of transcription, DNA -dependent
  Homolog annotation: Hit_ID=Q9C9K7; Match level="QueryCoverage=64%, HitCoverage=58%, E-value=3e-38, Identity=52%"; Hit description =Putative uncharacterized protein F14G6.10
  Pfam annotation: Domain name=DUF296; Domain location=71-186; Score =172.3; E_value=1.2e-48; Accession=PF03479.6; Description=Domain of unknown function (DUF296)
MAANYNNNIISAAAAAAAFMTPAALHLQPQSDDDDGEGPFSTQRRPRGRPMGSKNKPKPPVIVTRDSPNVLRSHVLEVSSGADVVESLSNYARRRGRGVSVLSGSGTVANVVLRQPAGSVLTLHGRFEIVSMTGTVLPPPAPPGSDGLSVYLSGAQGQVVGGVVVAPLVASSHVVLVAASFANAMFERLPLPLNQHDDDDQVLQEAPRGVMGTEQVADGRNYPFSASLQGEVFGWGGTGTTSSTSTAPPKTHPF

SEQ ID NO: 178396 - protein, 298 aa, Glycine max
  Coding DNA Sequence Number=SeqID_86711
  Gene Ontology: Cellular component=chloroplast
  Homolog annotation: Hit_ID=A7QPG7; Match level="QueryCoverage=53%, HitCoverage=85%, E-value=6e-67, Identity=72%"; Hit description =Chromosome chr18 scaffold_137, whole genome shotgun sequence
  Pfam annotation: Domain name=PsbP; Domain location=55-251; Score= -47.8; E_value=0.029; Accession=PF01789.7; Description=PsbP
MAFIWRFCGVSLCNFTASNAQKGPSPSLPITLDLEHHITTPSLLSSIEEEEGRAVNRRQLILHTPVAAAAAFAVPNALALNDVSEDVRVYTDDENKFKIEIPEEWQVGTGDGESSGFKSITAFYPTQASNSNVSVVITGLGPDFTRMESFGKVDEFAQTLVSGLDRSWRKPPGVAAKLIDCKSSNGIYYIEYLLQNPGESRRYLYSAIGMASNGWYNRLYTVTGQYVEEDTDKYASKVQKVDEVTSKLCIEIQLPLGFCSLIEYAYQSSVQSSVNQSQPFGSVPILICRIYECLEKDL

SEQ ID NO: 178397 - protein, 252 aa, Glycine max
  Coding DNA Sequence Number=SeqID_86712
YQEWRNGNGMNKLMVKFGNGIDGIVFELLGARAPIGDSISDANAISSGSATAIATNVEAWLQFFNLEHLREEKESGSAVSKQTPWETVVAMATQMKRWRRAGTRRSRDPAALVAARNHQNLTAGWTGGMRSEPGVDAADVEAMSALRKHSDFVSGCELGEADRAVGELDSGFGGGGDLGEGAEDLLLDAFVGGGGRRLGSSVGGGEAEAAETAAAGDGDEAEDADESAEEGGEDDDEVGIDDGGVRGRVSLA

SEQ ID NO: 178398 - protein, 210 aa, Glycine max
  Coding DNA Sequence Number=SeqID_86713
  Homolog annotation: Hit_ID=A7QPE0; Match level="QueryCoverage=63%, HitCoverage=79%, E-value=1e-50, Identity=76%"; Hit description =Chromosome chr18 scaffold_137, whole genome shotgun sequence
MSMSMSMLYMCLFTLTLVVGMLSMLSDAVDDKCAACKAVAEELEIGLSTERPRNHLDMRHRLDSKGQREGKLIDYRVSELRVVELLDGLCEKMQDYTLKIDTNTYEWFKVDSWDNLTTNKQEARAYSKDISSYCGRLLEETEDEFAELIKKGSVKVGGVSKVLCQDLSKHCSQMRLYVLKIILLFIDCEHSNMLLAFTEVTFLLAYPPSI

SEQ ID NO: 178399 - protein, 106 aa, Glycine max
  Coding DNA Sequence Number=SeqID_86714
MERLPTMNAHHSMSSLSLEAKACGLLCLSFWQMKKFAVEEPSLDSPSYALRKLCSINTTILDMVLNIDFCKPYPCICKEAVSGFEPMTNKSPRHNFTAASGLALDY

SEQ ID NO: 178400 - protein, 158 aa, Glycine max
  Coding DNA Sequence Number=SeqID_86715
  Gene Ontology: Mol. function=DNA binding; Cellular component =chromatin; Biological process=regulation of transcription, DNA -dependent
  Homolog annotation: Hit_ID=P26585; Match level="QueryCoverage=48%, HitCoverage=50%, E-value=3e-27, Identity=80%"; Hit description =HMG1/2-like protein
  Pfam annotation: Domain name=HMG_box; Domain location=50-119; Score =115.8; E_value=1.3e-31; Accession=PF00505.10; Description=HMG (high mobility group) box
MAVVSIEEGEKWKKENEKKVVRLAVNKKGAATKARKPAGKGKAAKDPNKPKRPPSAFFVFMEEFRKVFNKEHPENKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 178401 - protein, 890 aa, Glycine max
  Coding DNA Sequence Number=SeqID_86716
  Gene Ontology: Mol. function=zinc ion binding; Biological process =regulation of transcription
  Homolog annotation: Hit_ID=Q7X9C1; Match level="QueryCoverage=98%, HitCoverage=99%, E-value=0.0, Identity=69%"; Hit description=NIN -like protein 1
  Pfam annotation: Domain name=PB1; Domain location=796-879; Score =88.8; E_value=1.7e-23; Accession=PF00564.15; Description=PB1 domain
  Pfam annotation: Domain name=RWP-RK; Domain location=574-625; Score =99.6; E_value=9.5e-27; Accession=PF02042.6; Description=RWP-RK domain
  Pfam module annotation: Pfam domain module=PB1::RWP-RK; Domain location=796-879::574-625
MMGDGGVISSAATMMEAPPPDGTTTTSMDFDYMGELFLDGCWMEASADGSDFLLQSPSFSNTLFDPSFSWPALETNHNESQVAAFGSQQESHNNNMVSVVAGGIRRWWFAPTHTPTPSPGPGPSIMEKLIRALMWIKDYNRNKDMLIQIWVPVHKEGRPILAADDLLFSLESKSLNLAKYREISVTYKFSAEESDSKELAWGLPGRVFRDKVPEWTPDVRFFKIDEYPRVDHAQEYDVRGTLAVPIFEQGSKTCLGVIEVVMTTQQINYGPELESVCKALEAVDLRSSKQLSIQNVKACNRSYEAALPEIHEVLRSACEMHKLPLAQTWVPCVQQGKEGCRHSEDNYLLCISPVEHACYVGDPSIRSFHEACTEHHLLKGEGVAGGAFMTNQPCFSDDITSLSKKDYPMSHHARLFGLRAAVAIRLRSIYNSTDDFVLEFFLPVDCNDIEEQRKMLTSLSNIIQRVCRSLRVIREKELEEANLSVNEVIALADSGFTRDEICSEPQQKGMVASLDTEEKSSETMGRKFSEPRQQQESPILKGNLDCVRECSTSVEGNLSSPGTSKTGERRRVKAEKTITLQVLRQYFAGSLKDAAKNIGVCTTTLKRICRQHGIKRWPSRKIKKVGHSLQKLQLVIDSVQGASGAFQINSFYSNFPDLASPNLSGTGFFSTLNQSDNPNSTSTQPEHGSLSPEGASKSPSSSSSQSSISSHSCSSMSELQQQHTTNIASDKDPATVGEYSADVVLKLIRNEAKLKSLSQDRAKLLPRSLSQETLGEHPKTQYQLPLLKTSSSKVDSHRVKVTYGDEKTRFRMLKNWVYEDLLQEIGRKFNVSDMSKFDVKYLDDDCEWILLTCDADLEECIDVCQSSESGTIKLSLQPSSHSVRSSLEFR

SEQ ID NO: 178402 - protein, 543 aa, Glycine max
  Coding DNA Sequence Number=SeqID_86717
  Gene Ontology: Mol. function=hydrolase activity, hydrolyzing O -glycosyl compounds; Cellular component=chloroplast; Biological process=carbohydrate metabolic process
  Homolog annotation: Hit_ID=Q9XIS4; Match level="QueryCoverage=93%, HitCoverage=67%, E-value=0.0, Identity=71%"; Hit description=Starch branching enzyme
  Pfam annotation: Domain name=Alpha-amylase; Domain location=106-399; Score=-91.9; E_value=0.00035; Accession=PF00128.15; Description =Alpha amylase, catalytic domain
  Pfam annotation: Domain name=Alpha-amylase_C; Domain location=460 -532; Score=43.3; E_value=8.4e-10; Accession=PF02806.9; Description =Alpha amylase, C-terminal all-beta do
  Pfam annotation: Domain name=Isoamylase_N; Domain location=7-73; Score=38.2; E_value=2.9e-08; Accession=PF02922.9; Description =Isoamylase N-terminal domain
  Pfam module annotation: Pfam domain module=Alpha-amylase::Alpha -amylase_C::Isoamylase_N; Domain location=106-399::460-532::7-73
MAPLPTFHLKEAQIIGDFNGWDGSNHQIKNQFGVWSIKIPDTDGNSAIPHNSRVKFRFRHGDGVWVDRISAWIKYATPYDGVYWDPPLSERYQFKYPRPPKPKTPRIYEAHVGMSSSEPRINSYREFADEILPHIWANNYNTVQLMAVMEHSYYASFGYHVTNFFAVSSRSTPEDLKYPIDKAHSLGLQVLMDVIHSLASNNVTDGLNGFDVGQTSQDSYFHTGDRGYHKLWDSRLFNYANWEVLRFLLSNLSNRCGAVVYLMLANCLIHSILPDATVIAEDVSGMPGLGQPVSDGGIGFDYRLAMAIPDKWIDYLKNKNDYAWSMKEISWSLTNRRYTEKCVSYAESHDQASPIVEQGIYLQKMIHFITMALGGEGYLNFMGNESGLISQEKAMDGVMRSAGVSGIGGYRSLEIQAVCCLSEIYVIILFLELVQFMNAFDRAMNLLDDNFSFLASTKQIVSSADDDDKRGDLIFVFNFHPENTYEGYKVGCDLPGKYRVVLDSDAWEFGGHGRVRSPNLSGGQLVLVSSSEIWGVWMGLGNN

SEQ ID NO: 178403 - protein, 145 aa, Glycine max
  Coding DNA Sequence Number=SeqID_86718
  Subcellular localization annotation: CTP_CleavageSite=44; ConfidenceScore=5.05e-01
MKQKIEGAVFQSYLSLFVALHPQPNHQQKFHSLTGGNTEFERVRKRSTKVPLGGLESPALAGLELSLLEESYASTLRPNLPLGFKFLEKLIDETERDGKDTREIEEDEVEVEEEETKLAMTETERFQTWPLKWSGILHRDDEVHT

SEQ ID NO: 178404 - protein, 139 aa, Glycine max
  Coding DNA Sequence Number=SeqID_86719
MARTRGLGRAIGRFVGRDRAAGEDAGDVPERRRPTASARRLRVHQMTTEGRDMAEDVADMTDDVPEQPTEAPEMRADAQGADSGEGSDGDDAAEGFPGGPRDPSVLTSFAEHVAHAVWSGQERPDLKLVSHGRKLSGIL

SEQ ID NO: 178405 - protein, 602 aa, Glycine max
  Coding DNA Sequence Number=SeqID_86720
  Gene Ontology: Mol. function=phospholipase D activity; Cellular component=membrane; Biological process=phosphatidylcholine metabolic process
  Homolog annotation: Hit_ID=A7NVP6; Match level="QueryCoverage=95%, HitCoverage=96%, E-value=1e-114, Identity=75%"; Hit description =Chromosome chr18 scaffold_1, whole genome shotgun sequence
  Pfam annotation: Domain name=PLDc; Domain location=27-62; Score=34.9; E_value=2.9e-07; Accession=PF00614.13; Description=Phospholipase D. Active site motif
  Pfam annotation: Domain name=PLDc; Domain location=448-475; Score =39.7; E_value=1e-08; Accession=PF00614.13; Description=Phospholipase D. Active site motif
  Pfam module annotation: Pfam domain module=PLDc::PLDc; Domain location=27-62::448-475
MKKLESFSSIHQLDVCCHQDMPAVVGTLFTHHQKCVIVDTQAHGNNRKITAFIGGLDLCDGRYDTPEHRILRDIDTVYQDDYHNPTFCAGTKGPRQPWHDLHCKIEGPAAYDILTNFEQRWRKATKWSELGRKLKRVSHWNDDSLIKLERIFWILSPSESTPVDDPELWVSKEDDPENWHVQVFRSIDSGSLKGFPKDVVVAETQNLVCAKNLVIDKSIQTAYIHAIRSAQHFIYIENQYFIGSSFAWPAYKEAGFGRILMLTHSKSVGVHKVRGSFRCTRSEPTGCRILGEERNQIFPRVQWGVFFSKDSIYALQPRLYLSFLNLFFSCAYCADNLIPVELALKIVSKIRSKERFTVYIVIPMWPEGSPSSTSVQEILFWQGQTMKMMYEIIALELKSMQLDSHPQDYLNFYCLGNREQLTTEVSSSSNSPSDNGETVSASQKFRRFMIYVHAKGMIVDDEYVILGSANINQRSLAGSRDTEIAMGAHQPHHTWSQKKRHPHGQVYGYRMSLWAEHMETIEACFKEPESLECVKSVNKIAEDNWKKYTADDYTPLQGHIMKYPVCVNAYGKVKSLTGFESFPDVGGKVLGSRSTLPDALTT

SEQ ID NO: 178406 - protein, 644 aa, Glycine max
  Coding DNA Sequence Number=SeqID_86721
  Homolog annotation: Hit_ID=A5B2F2; Match level="QueryCoverage=98%, HitCoverage=98%, E-value=1e-113, Identity=52%"; Hit description =Putative uncharacterized protein
  Pfam annotation: Domain name=DUF630; Domain location=1-60; Score =80.2; E_value=6.6e-21; Accession=PF04783.3; Description=Protein of unknown function (DUF630)
  Pfam annotation: Domain name=DUF632; Domain location=227-535; Score =355.5; E_value=9e-104; Accession=PF04782.3; Description=Protein of unknown function (DUF632)
  Pfam module annotation: Pfam domain module=DUF630::DUF632; Domain location=1-60::227-535
MGCNTSRLDRLPAVALCRDRCKFVDEALRQSYALADAHVAHMEALKTLGPALLCFFDGFDDSDETSVRIKETKVPVATKSPPPRSPSSLSSDSDDANVLLHSESETEDAEKEEFQLFTRARYDYAHSARYPPFSPPRGYSGSKPPSPPPPSGSAWDFLNFFEPYEKYHVPYFPSGGDADGAEKDKGKVEKRDEFKSKGENEEVKKKKGDSKEKKVVSEKEEVVSVSEQCSDSARVKSGKGFSEAMKEIQVLFEKASESGNPVLEMLDVGKLRYHRKFDLNPESSLLGRRMGSGYEGDKGHSYGNLCSTLKKLCMWEKKLYHEVKAEEKLRMLHQKKCKQLRRMKQKDANAQKIDSVQTFVGILSTKMKISIQVVDKISITISKLREEELWPQINRFFLKFLGMWKDMQECYKCQYQQIVEAKTLDASSLNTKPGNAHIDATIKLKSEVQKWNLSFLDWIHAQKSHVKALNGWLVRCLLYEPEEVPDDSTPFSPSKIGAPPVFVICHKWSQAVDNLSEKNIIEAVNGFMLRVNELWEKYILDLQQKLTLDKEFERKVKMLEREEQKMHKVMRAHEKKMVTVGREESDALLRGDAVHHADVVDTTNLQSGLKQIFGAMEKFTDSTVRLYEELCQQIKQEEKPTKIN

SEQ ID NO: 178407 - protein, 155 aa, Glycine max
  Coding DNA Sequence Number=SeqID_86722
  Homolog annotation: Hit_ID=A7NSQ2; Match level="QueryCoverage=81%, HitCoverage=88%, E-value=8e-50, Identity=59%"; Hit description =Chromosome chr18 scaffold_1, whole genome shotgun sequence
MSTINKDHIVDESNRSETKLVEEEEEEEDLQKLLVPDVQNLPLIPPSAVETNFATYFALDFMKPAHDQYVYRHANGLCVIGLAPSHVAFKDEGGITAVDFNVGKSDRSGMKVTGKRKKAYREGYIAIIMPKPADWLKVKASLVSLQEYKKLREVN

SEQ ID NO: 178408 - protein, 241 aa, Glycine max
  Coding DNA Sequence Number=SeqID_86723
  Homolog annotation: Hit_ID=Q8S901; Match level="QueryCoverage=100%, HitCoverage=100%, E-value=2e-89, Identity=69%"; Hit description =Syringolide-induced protein 14-1-1
MKSKILKALPKAVSAVTVTFQNHPFSPGRDHKSKPIVSMIPHEARRKTHDRGNNNDIDEIYSQEPTSPKISCMGQIKHKKKQIEKSKSKSKSMTKEARNVASKQTSSASRDIEPKSDGRKSNASAPGDINKDRALADAARAPRVSQMRRFSSGRDALGDFDWKVAQVAPDEEEIDYYSDHYRVDSDGDEEEQIIIPFSAPLLVGVGVGHGGVLNLKPRIEINLWKRRTMAPPRPLQLDRAN

SEQ ID NO: 178409 - protein, 44 aa, Glycine max
  Coding DNA Sequence Number=SeqID_86724
MWEFASQRKLEKDQWLDISLAFVGLMSHESHHIFPWKLEMDSAV

SEQ ID NO: 178410 - protein, 217 aa, Glycine max
  Coding DNA Sequence Number=SeqID_86725
  Gene Ontology: Mol. function=hydrolase activity, acting on ester bonds; Biological process=lipid metabolic process
  Homolog annotation: Hit_ID=A7NSR6; Match level="QueryCoverage=91%, HitCoverage=55%, E-value=5e-71, Identity=64%"; Hit description =Chromosome chr18 scaffold_1, whole genome shotgun sequence
  Pfam annotation: Domain name=Lipase_GDSL; Domain location=44-216; Score=21.7; E_value=0.00016; Accession=PF00657.13; Description=GDSL -like LipaseAcylhydrolase
MDSLMASPLPLGILVLRCFMLLLMVSCKAKGLVELPPNVTVPAVLVFGDSIMDTGNNNNNMQTLAKCNFPPYGRDFEGGIPTGRFGNGKVPSDLVAEELGIKELLPAYLDPNLQPSDLVTGVCFASGGSGYDPLTSKLASAISLTGQIDLFKEYIRKLKGLVGEDKTNFILANGIVLVVEGSNDISNTYFLSHAREVEYDIPAYTDLMVKSASNFLK

SEQ ID NO: 178411 - protein, 173 aa, Glycine max
  Coding DNA Sequence Number=SeqID_86726
  Gene Ontology: Mol. function=protein disulfide oxidoreductase activity; Cellular component=mitochondrion; Biological process=cell redox homeostasis
  Homolog annotation: Hit_ID=A7NSS2; Match level="QueryCoverage=36%, HitCoverage=19%, E-value=2e-15, Identity=65%"; Hit description =Chromosome chr18 scaffold_1, whole genome shotgun sequence
  Subcellular localization annotation: CTP_CleavageSite=67; ConfidenceScore=5.55e-01
MRGVKRAMFVGRALRSNSNSGVSPHGHGCLTPSNPNPNPNPSVSVTGFRYLSAYAAATSLVQDALTKAFKPKELASFNTRPVNPINKKEIKWSDYKKVPILTVDGQQMVDSSDIIDKLIKRIHPDYDLNAQEENKPIHHLKSGRDIIEHALIGKWFSEMDLAVGQSSRVSEHS

SEQ ID NO: 178412 - protein, 65 aa, Glycine max
  Coding DNA Sequence Number=SeqID_86727
MATEVKTHSGERGRGAEVSRPWRWRDRREGVVPPLELAGQVREGGTATGGCGTGGERIPPFELAG

SEQ ID NO: 178413 - protein, 332 aa, Glycine max
  Coding DNA Sequence Number=SeqID_86728
  Homolog annotation: Hit_ID=A5C545; Match level="QueryCoverage=75%, HitCoverage=55%, E-value=8e-08, Identity=28%"; Hit description =Putative uncharacterized protein
IPEHKGWVVPVWFRLCNGFYKDSGNLKWPIPLKIIEATRSNTGYETFHAQSSSEPSVGQFDEEEPILVTSCMQLDSENSDREVLSLSKPEHQSALQESFHARSSSEATLDQSDEEPTLDTSCSRLDSEKSDREISTSLSKVEGHNALEVEAGSKIQSESFHAHSFSEATLDQSEEEPTLSTSCTQLDSEKSYGEISTSLLKAEYHNAFGVEAGSKIPNESFVSSSLTKDDILDPLSPQDVSSTKTRNLVGDSRGKIGVDSSRKPPKPKRTLVPSSSMLSRDLSTFDLCDESEKLKGNRGTRKLPAPDPKRSNGSISLLHLLQSRKSNLHRLA

SEQ ID NO: 178414 - protein, 53 aa, Glycine max
  Coding DNA Sequence Number=SeqID_86729
MSSISNQPHLYPSMSHACRADSQRLYKIYASEEFVTIAHYKSLLLGNSNLDTN

SEQ ID NO: 178415 - protein, 280 aa, Glycine max
  Coding DNA Sequence Number=SeqID_86730
  Homolog annotation: Hit_ID=A7NSW1; Match level="QueryCoverage=67%, HitCoverage=97%, E-value=5e-45, Identity=53%"; Hit description =Chromosome chr18 scaffold_1, whole genome shotgun sequence
  Pfam annotation: Domain name=DUF827; Domain location=109-240; Score= -34.9; E_value=7.3e-08; Accession=PF05701.2; Description=Plant protein of unknown function (DUF827)
MVFAPGFCPMQSDDLPKMLVQHQQYQEHPPTAFALKHNRILVKWTRRNEASNLISKPSPLSNPSHSSLPLSHIHYQPAILVRCFHFGRNTNMNMEDGVMLVRKAEIDTRAPFRSVKEAVSLFGEKVLAGEVYASANKLKKIQSGANENGVEFSRIESVEAELDETRENLQRAKEESMEELERTKQELRQLKQRETQKHPEESEIEDVKFVENLTTFGVKSSRFDEDKMEFQKKRCVTFANPQHGVEKLERHPSLRKKNKKSLIPFIGAIFSRKKGTQEIP

SEQ ID NO: 178416 - protein, 50 aa, Glycine max
  Coding DNA Sequence Number=SeqID_86731
MEMEMRPPMGKSKTPLSSLYNRDYFAKHYKFLLHVTMEIIDPNRPRGTRS

SEQ ID NO: 178417 - protein, 480 aa, Glycine max
  Coding DNA Sequence Number=SeqID_86732
  Gene Ontology: Mol. function=protein binding; Cellular component =chromosome, pericentric region; Biological process=cell division
  Homolog annotation: Hit_ID=A7NT00; Match level="QueryCoverage=69%, HitCoverage=62%, E-value=1e-124, Identity=65%"; Hit description =Chromosome chr18 scaffold_1, whole genome shotgun sequence
  Pfam annotation: Domain name=RCC1; Domain location=108-151; Score =8.8; E_value=0.082; Accession=PF00415.9; Description=Regulator of chromosome condensation (RCC1)
  Pfam annotation: Domain name=RCC1; Domain location=154-206; Score =14.2; E_value=0.021; Accession=PF00415.9; Description=Regulator of chromosome condensation (RCC1)
  Pfam annotation: Domain name=RCC1; Domain location=254-305; Score =17.7; E_value=0.009; Accession=PF00415.9; Description=Regulator of chromosome condensation (RCC1)
  Pfam module annotation: Pfam domain module=RCC1::RCC1::RCC1; Domain location=108-151::154-206::254-305
MGERMECTAEASVPNLELVELKNRSLTLSFYIHLLSFLLIKIVNDNLIFFHALSCAEIESSPVRCLVSDVKHTACGGDFTVWLSSVEGASILYGFWIKIAFSFLDSRTAGLPQYGQLGHGTDNEPRPRAIAALAGETIVKVACGTNHTVAVDKNGFVYTWGFGGYGRLGHREQKDEWVPRRVEVFQNRNVLPPDSVISAGSVNSSCTAGGGQLYMWGKLKNTGDDWMYPKPLMDLRLYTCTLFHGNMHHFVGADSSCISWGLAQNGELGYGPTGQKSSAVPKKVDLLEGMHVISVACGMGHSMVIVDRANVADRLDQLDIYDGKAVGEGNEAVNTTPVPKQAAKKGAKGAADNSKKRKQLKDSSESEEEEDAEESEDSEDEINGEVEAKRPRSSGKGRGKAPKKAGAKGKGAKEKGSGRGRGGTAANKSSSKSPQVKTVGYIVLNTCTCDTAQSGESSLAIQNGSVRDEKGSKFQKHSVT

SEQ ID NO: 178418 - protein, 527 aa, Glycine max
  Coding DNA Sequence Number=SeqID_86733
  Gene Ontology: Mol. function=hydrolase activity, hydrolyzing O -glycosyl compounds; Cellular component=extracellular region; Biological process=carbohydrate metabolic process
  Homolog annotation: Hit_ID=A7P7X9; Match level="QueryCoverage=95%, HitCoverage=94%, E-value=0.0, Identity=74%"; Hit description =Chromosome chr3 scaffold_8, whole genome shotgun sequence
  Pfam annotation: Domain name=Glyco_hydro_9; Domain location=28-519; Score=807.6; E_value=7.2e-240; Accession=PF00759.10; Description =Glycosyl hydrolase family 9
MALPKSNAKLTLVLLFLVFIINSGSAHNYKEALSKAILFFEGQRSGFLPQDQRQTWRANSALGDGWTYKLDLTGGYYDAGDNIKFGFPMAFTTTMLSWSVIEFGDMMPPNEHRNALLAIRWATDYLLKTVSQPNRIFVQNAKFHLFSIWIPNPDEYITDAPRMAVGDPISDHNCWERPEDMDTNRTVYAVDAPNPASDVAGETAAALAAASMAFRSSDPSYSETLLRNAAKAFQFADTYRGAYSDNANVRSGVCPYYCDFDGYQIDLKEVYKDELLWGAAWLRRATQDENFLNYIQSNGKTLGAEDNINEFGWDNKHAGLNVLVSKEVLDGNVMSLESYKTSAESFLCTLIPETSSSHIEYTPGGLIYRPGGSNLQHATSIAFLELVYANYLSRTSQTINCGNVYVNAQTLRQHAKKQVDYILGDNPMGMSYMVGYSNKYPQHIHHRGSSLPSIKDHPQFIACKEGSIYFNSSNPNPNVLVGAIVGGPGEDDVYEDDRADFRKSEPTTYINAPFVGILAYFVANPNP

SEQ ID NO: 178419 - protein, 63 aa, Glycine max
  Coding DNA Sequence Number=SeqID_86734
MVIKKWCFNSERVSHCGVLEFIADEGTIYMPYWVGPEELKHYEYLVTSRMVVQVSSFLMHASF

SEQ ID NO: 178420 - protein, 84 aa, Glycine max
  Coding DNA Sequence Number=SeqID_86735
MAKANNLQVKPCTTSYQIWTRPSQHWAFSHFSLWAFHLIVPSITGLKEVKSYTRHLKVQVPKEEVLFILGLDGPVLPIEDALVG

SEQ ID NO: 178421 - protein, 630 aa, Glycine max
  Coding DNA Sequence Number=SeqID_86736
  Gene Ontology: Mol. function=protein binding; Cellular component =integral to membrane; Biological process=regulation of translational fidelity
  Homolog annotation: Hit_ID=A7QE27; Match level="QueryCoverage=95%, HitCoverage=96%, E-value=1e-150, Identity=48%"; Hit description =Chromosome chr4 scaffold_83, whole genome shotgun sequence
  Pfam annotation: Domain name=DUF726; Domain location=263-612; Score =315.1; E_value=1.3e-91; Accession=PF05277.3; Description=Protein of unknown function (DUF726)
MEESSSTLSRTHRHAAASLFALAFHRSQIHQIRISGTASVSNNPELWIKHNSDLLCPIFRFLGVDDQSWHGLEATATSSSQLGHHLGSFLQLLSEEGDATTPEGLDKESALSKAIDASAMSMNDTTPIADSPSGDHGLNTRSQDDVCEIMETSALLPLKKQPSNTLEIARFEQPLAEANLIGYEKKMAVLYALVAACVADTDKSRQGYDARHRVALRLLAVWLDVKWNEMEAMESMVAFSVMNSVNKKGAKEEESVGSETSWDKWKRGGIIGAAAVTGGTLMAITGGLAAPAIAHGLGALAPTLGGIVPAIGGGFAAAATATGSAVGSVAVAASFGAAGAGLTGSKMATRIGSLEEFELKGVGGINEGHLAVRISISGLAFKEKDFIEPWEGLNDNMERYVLQYESKNLIALSTAIQDWLTSLIAIQLMKDGAMLTVLSSLLTALAWPATLVASFDIIDSKWAIAVDRSDRAGKVLAEVLLHGLQGNRPVTLVGFSLGARVIFKCLQCLSESKGDNAGIVERVVFLGAPISIGEENWEAARKMVAGRFVNAYSSNDWTLGITFRASLLSHGLAGIQPVDVPGVENVDVTQLIEGHSSYLRMTQKILEQLELDNCCAVFKSGQENPQEEKS

SEQ ID NO: 178422 - protein, 440 aa, Glycine max
  Coding DNA Sequence Number=SeqID_86737
  Gene Ontology: Mol. function=hydrolase activity; Cellular component =lipid particle; Biological process=proteolysis
  Homolog annotation: Hit_ID=Q650U5; Match level="QueryCoverage=57%, HitCoverage=81%, E-value=1e-65, Identity=46%"; Hit description=CGI -58 protein-like
  Pfam annotation: Domain name=Abhydrolase_1; Domain location=73-327; Score=16.5; E_value=0.00024; Accession=PF00561.11; Description =alphabeta hydrolase fold
MGMSRAQAHRNDRHVFFCGDGRRRGRRRCCYGGEADGNGRSKRGGSGTGYVQEHVNIGSDPPGSKVRWFRSSKSLLLINMDGVDQADLISHAKAQAWFIDSFDEWRKAKNLSNFILLGHSFGGYVAAKYALKHPQHVQHLILVGSAGFSSESDAKSEWITRFSTTWKGTVLNHLRESNFTPQKLVRGLGPWGPNIVPKYTSTRFGTHSTGEILTEEESALLIDIWDKCAHHFHIWFPRLDELSRCPRSSQAYEGSMRNHQGSSGWALCVLDNPTAFHSAVFYACGRFLTPDPDNESLPQRANLCIEPFGSDENDEDEEEEGVVEICVPDRGNTHNRKGEESAWCLLTGRWEVVMGRGGNVVSAVGGGGVVSAVGGGLAEEEVGLFVLGSRGGMGGDFAEAEDGERCLGTMVFNIRIMVSSLEVMEVWSAAMEVWSAAMEV

SEQ ID NO: 178423 - protein, 698 aa, Glycine max
  Coding DNA Sequence Number=SeqID_86738
  Homolog annotation: Hit_ID=A5AN29; Match level="QueryCoverage=72%, HitCoverage=60%, E-value=1e-49, Identity=31%"; Hit description =Putative uncharacterized protein
MGALASFAPWISEDDLLLKNSVETSAIFLFKAGASLESLAKGAVQFSRKYSIKEIQDRWYSLLYDPVISAEAAANMTNLELSALPLPSKFYRFGHSKERKVVSATRKSDSVRNLYYARRKRIRNSMLTSMDLSFLVDSENGNYAAHGSDPLSGNCMPEGGTSNHFSSLDPSQYAFPENVMDDNVASDRVAAGVFCHGVDKAVAENFPAKLKSVLKEEPQIFEGNMPLDGVVEDLDVPNELAIDGWIGDDGLERMPLSALNHINNDPGNMCPEFDENNVFDSELECGTSFNLSSRPEMSVWGTDESIQEHDLPCDGFSDPIACGDAYLEELSNSLLHFSSEEEQILMDVDGEEGIEKSYFGGLTSLLQNSTNDVNSDQISEKDETESLMASQAHVINQSVSCHKELDDNLGSSSSGLQVVPKLEFQMSSSVAATDPQFPDLINESMSCSINTEHQEIPENDDVFLPFDVPPVIFPPSSKLIFKVSNKPISSSVIKHRDSERGKTLMHVEKKDSVESHASFQMMESPCFPGPVGGSKVECELPANHAPHTVSRSSVTVSGGLGGNEAANTTDAFLHANKKEEATNVGLAKDPNNHVANSFMKKSAVDSKDFRNHPQPNGFSMKTEQDLALPLQDYQLQRAELGSSDVLESELVANPPTLDEEEQYIESDEELPSYSDVEAMLLDMDLDPDDHQDSYYNEE

SEQ ID NO: 178424 - protein, 171 aa, Glycine max
  Coding DNA Sequence Number=SeqID_86739
  Gene Ontology: Cellular component=integral to membrane
  Homolog annotation: Hit_ID=A7NT25; Match level="QueryCoverage=88%, HitCoverage=44%, E-value=2e-30, Identity=47%"; Hit description =Chromosome chr18 scaffold_1, whole genome shotgun sequence
  Pfam annotation: Domain name=C4dic_mal_tran; Domain location=52-171; Score=-48.2; E_value=0.00015; Accession=PF03595.8; Description=C4 -dicarboxylate transportermalic acid transport protein
MATQALRPEIELVVDDTTTSNVISHSNHEPTSLMVAKRSLTSLNSILTKFHAGYFRISLSLGGQALWWKTLIESPTHDVTSALRRLLCTLPSSAFLALWMVKADFLHPVRVNYLFAPWISWLLLLQSAPFVAPKTPTYLVMWWVFAVPVVVLDVKFYGQVVHESEEAFYRR

SEQ ID NO: 178425 - protein, 114 aa, Glycine max
  Coding DNA Sequence Number=SeqID_86740
  Subcellular localization annotation: CTP_CleavageSite=56; ConfidenceScore=5.32e-01
MGSCYVHPALLLGHPANSEVAKLPFSNYSSGRRFFRKNNLCLPEKLTDNFRKNVIRNVSGRSFFRKNSSVFRKKLLPEAVFYCAFFLSSSVCFVSSSVCCCFGGGPFSSLLVVQ

SEQ ID NO: 178426 - protein, 252 aa, Glycine max
  Coding DNA Sequence Number=SeqID_86741
  Gene Ontology: Mol. function=hydrolase activity; Cellular component =membrane; Biological process=proton transport
  Homolog annotation: Hit_ID=A7NT28; Match level="QueryCoverage=96%, HitCoverage=29%, E-value=2e-56, Identity=52%"; Hit description =Chromosome chr18 scaffold_1, whole genome shotgun sequence
MARRLRLFKEQMTKAGVSPSTWSTRDNHFDLEHLEVKLEELEAELLEINANNEKLQHTYNELLEYKLVLEKVGEFFSSAKNKAVAQQKELEFQTTVEGSIDSPLLLEQEETTTKQIKLRFISGLVHREKSIPFERIIFRATRGNVFLKQAVIQHPVLDPLSGEKVHKNVFVVFYSGERVKSKILKICDAFGANRYPFSDDLSKQFQTIREVYVIFPFRFLISFKLLLSAKCFRLLHLENFLSNIKKNYIFDM

SEQ ID NO: 178427 - protein, 350 aa, Glycine max
  Coding DNA Sequence Number=SeqID_86742
  Gene Ontology: Mol. function=molecular_function; Cellular component =membrane; Biological process=auxin mediated signaling pathway
  Homolog annotation: Hit_ID=A9P9F1; Match level="QueryCoverage=96%, HitCoverage=97%, E-value=1e-136, Identity=67%"; Hit description =Putative uncharacterized protein
  Pfam annotation: Domain name=DUF6; Domain location=175-304; Score =59.7; E_value=1e-14; Accession=PF00892.11; Description=Integral membrane protein DUF6
  Pfam annotation: Domain name=TPT; Domain location=166-304; Score= -32.1; E_value=0.044; Accession=PF03151.7; Description=Triose -phosphate Transporter family
  Pfam module annotation: Pfam domain module=DUF6::TPT; Domain location= 175-304::166-304
MADSASASASSSRMWCSIPERFQLHAAMLALQFGYAGFHVVSRAALNMGISKLVFPVYRNIIAFLLLVPFAYFLEKKERPAITLNFLLQFFLLALVGIEQVRLNRKDGISKVAGTIFCVAGATVITLYKGPTIYSPTPPLHSERPAVVDFGTLSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASIALGEEFYLGGIIGAVLIVVGLYFVLWGKSEERKFAKEHAAITSTPEHSGIRSSSHAKTSLTQPLLPSSTENV

SEQ ID NO: 178428 - protein, 247 aa, Glycine max
  Coding DNA Sequence Number=SeqID_86743
  Gene Ontology: Mol. function=microtubule motor activity; Cellular component=microtubule associated complex; Biological process =microtubule-based movement
  Homolog annotation: Hit_ID=A5AWC9; Match level="QueryCoverage=91%, HitCoverage=22%, E-value=2e-96, Identity=78%"; Hit description =Putative uncharacterized protein
  Pfam annotation: Domain name=Kinesin; Domain location=1-64; Score= -201.3; E_value=0.06; Accession=PF00225.14; Description=Kinesin motor domain
VIGKLSEGKASHVPYRDSKLTRLLQSSLSGHGHVSLICTVTPASSNTEETHNTLKFASRAKRVEIYASRNKIIDEKSLIKKYQREISVLKVELDQLKKGMLVGVNHEEILTLKQKLEEGQVKMQSRLEEEEEAKAALMSRIQRLTKLILVSSKNAIPGYLTDVPNHQRSHSVGEDDIENESQKDSSAVSSDQFHDGRHKRSSSRWNEEFSPASSTVTESTQAGELISRTKLTVVNHHPFSITKSVIC

SEQ ID NO: 178429 - protein, 90 aa, Glycine max
  Coding DNA Sequence Number=SeqID_86744
  Gene Ontology: Mol. function=metal ion binding
  Homolog annotation: Hit_ID=A9NKF8; Match level="QueryCoverage=58%, HitCoverage=25%, E-value=1e-11, Identity=57%"; Hit description =Putative uncharacterized protein
MILTRVMFHPACIDMTVEEAKRLDHFFCESCSAEGQKKLQNSHSASRHSDTKVDTKRRRRGQTNTETKLSSKVGNDLEFLYTDNGAVLLA

SEQ ID NO: 178430 - protein, 258 aa, Glycine max
  Coding DNA Sequence Number=SeqID_86745
  Homolog annotation: Hit_ID=Q70I38; Match level="QueryCoverage=65%, HitCoverage=76%, E-value=2e-43, Identity=52%"; Hit description =Putative uncharacterized protein
  Pfam annotation: Domain name=DUF702; Domain location=74-204; Score =191.0; E_value=3e-54; Accession=PF05142.3; Description=Domain of unknown function (DUF702)
MPLTGRVAAVRVTGTKIFMLVMYDKEKTAAHLKLKYLKYDEEQVGGGAGPERVVFSDMSLGVKDQMQRVRQGEEEVASGGSKCQDCGNQAKKECSYLRCRTCCKNKGFHCQTHIKSTWTPVDHRRRHFQGQGGDHHIPQNQNQINPYSGLELRFPAATNSMATFRCIHVRSMDDAVNEIAYQTSVNIGGHVFSGLLYDQGPEYQRGHQGESSTGFVDKQQNNNNNNLDSSGASATHQEYPFPLSSFRPGMPYLTYPRS

SEQ ID NO: 178431 - protein, 256 aa, Glycine max
  Coding DNA Sequence Number=SeqID_86746
  Gene Ontology: Mol. function=inositol or phosphatidylinositol phosphatase activity; Cellular component=cytoplasm; Biological process=carbohydrate metabolic process
  Homolog annotation: Hit_ID=A7P8W4; Match level="QueryCoverage=92%, HitCoverage=82%, E-value=1e-114, Identity=81%"; Hit description =Chromosome chr3 scaffold_8, whole genome shotgun sequence
  Pfam annotation: Domain name=Inositol_P; Domain location=9-253; Score= 191.3; E_value=2.4e-54; Accession=PF00459.16; Description=Inositol monophosphatase family
MAPHSSPLELNHFAEVGNKVADAAGEIIRKYFRKNFDVIHKHDLSPVTIADQSAEEAMVSIILDSFPSHAIYGEENGWRCKEKNTDYVWVLDPIDGTKSFITGKPVFGSLVALLQNGTPILGIIDQPVLRERWIGITGKRTTLNGQEISTRTCADLSQAYLYTTSPHLFSGDAEKAFIRVRSKVKIPLYGCDCYAYALLSSGFVDLVVESGLKPYDFLALIPVIEGAGGVITDWKGDKLFWEVSPLSIPTCMAPLL

SEQ ID NO: 178432 - protein, 79 aa, Glycine max
  Coding DNA Sequence Number=SeqID_86747
MEEMLLRANVRDYGRFDPPPRLVRPPGIPGGSDAKKPPPDALRQENWFQHDTRKAYETFGNGFFMVTFDHDDDRMKALG

SEQ ID NO: 178433 - protein, 244 aa, Glycine max
  Coding DNA Sequence Number=SeqID_86748
  Gene Ontology: Mol. function=hydrolase activity; Cellular component =integral to membrane; Biological process=proteolysis
  Homolog annotation: Hit_ID=A7PUU1; Match level="QueryCoverage=89%, HitCoverage=69%, E-value=9e-84, Identity=71%"; Hit description =Chromosome chr4 scaffold_32, whole genome shotgun sequence
  Pfam annotation: Domain name=Abhydrolase_2; Domain location=50-225; Score=-79.7; E_value=0.077; Accession=PF02230.7; Description =PhospholipaseCarboxylesterase
  Pfam annotation: Domain name=PGAP1; Domain location=58-216; Score= -87.4; E_value=0.057; Accession=PF07819.4; Description=PGAP1-like protein
  Pfam module annotation: Pfam domain module=Abhydrolase_2::PGAP1; Domain location=50-225::58-216
MVNLVAAQRPLLHGLMKMAGVRPYTVEIEPGTVMSFWVPSETLTKPKKKNEKPRISSKPSRPAVVLVHGFGAEGIMTWQYQVGALTKKYAVYVPDLLFFGGSTTDKPHRSPAFQAQCVVAGLRKLGVEKCIVVGYSYGGMVAFKMAEMYPEVVEALVITGSILAMTDSISATSLQELGFSSSSELLLPTSVKGLKALLTVASHKKQWYPNRLLKDYLEVYVYLCNPYSWIFIFTTTYSLYKSTN

SEQ ID NO: 178434 - protein, 222 aa, Glycine max
  Coding DNA Sequence Number=SeqID_86749
  Gene Ontology: Mol. function=sugar:hydrogen symporter activity; Cellular component=integral to membrane; Biological process =carbohydrate transport
  Homolog annotation: Hit_ID=Q93YP9; Match level="QueryCoverage=98%, HitCoverage=47%, E-value=2e-44, Identity=43%"; Hit description=Sugar transporter ERD6-like 4
MGMIEKFEASLQTLRGPNVDITMEAQEIQVGIGLLVLQQLSGINGVFFYSSKIFASAGISSSDAATFGLGAMQVAITGIATSLLDRSGRRMLLILSSSIMTLSLLLVAAAFYLEGVVTDDSNVHEVLAMLSVMGLVALVIGFSLGVGPIPWIIMSEQPDDRSCAFQILPPNIKGFAGSAATFLNWFTASVITMTANLLLHWSSSGPLSLSVFIYSIACMHAI

SEQ ID NO: 178435 - protein, 414 aa, Glycine max
  Coding DNA Sequence Number=SeqID_86750
  Pfam annotation: Domain name=Chromo; Domain location=244-294; Score =17.7; E_value=0.0036; Accession=PF00385.15; Description='chromo' (CHRromatin Organisation MOdi
MAAFHGCHSLYRASMDAFHSCHSPKEASMAAEDRLEAALANLAARSTPPRILTGCLSPKIASATRPPLPFFLPAITTVAALAVQANSVTHAYRTHDHANSAATPAAHESPVLLRTTTPTSAPPPLAVFRHPKLKTVAPIAPLPLPRFHLNNRHIRLNHPLPLSLRTAHRCYRHVHCRDIPYSNDIILLDDAAVKHQIRPPPHPPPHPKYTLTMFRYSMLRPHHGSLELPTSSLPLDTFYNQPIMKPLTILHSHMDSSTNPPTRFVLMQWVGLAPEASTWEKWDDFCHSHHFEDKAQMKPQSVPTSTLVRWIPLPPQFVKVNTNGSSFGNPGPSGFGGVVIYHPHATIIAAIRSLIHTNWNLTLNQTLRQGNTVANYLAKEGAKSIAQFSSLHACPAGLYHSVATDVVGTMYPRQ

SEQ ID NO: 178436 - protein, 185 aa, Glycine max
  Coding DNA Sequence Number=SeqID_86751
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=97%, HitCoverage=100%, E-value=8e-68, Identity=70%"; Hit description =Anaphase-promoting complex subunit 10
  Pfam annotation: Domain name=APC10; Domain location=1-171; Score =219.4; E_value=8.6e-63; Accession=PF03256.7; Description=Anaphase -promoting complex, subunit 10 (APC10)
MAAESSEGEEETKLSGGNQLLIVDDDLTEMGKKAAWSVSSCKPVTLSVFAFRSDGGQPHLVNIQFQKKVRLQLIVLYVDFKLDESYTPSKVSIRAGDGFHNLKEIKTVELVKPTGWVYLSLSGVDPRDTFVNTFMLQIAVLSNHLNGRDTHVRQIKEPYPTSAIPIYFKGIHHLLFYKMRVYGRI

SEQ ID NO: 178437 - protein, 94 aa, Glycine max
  Coding DNA Sequence Number=SeqID_86752
MIIRGGDGGTTSRSGEEGGFTTGDCGLAGSGSTYKANSCILCMIINYPRNKLCSIVTKVSELWTSCPMATDGGAGVDDEGMSSILALFPDAICN

SEQ ID NO: 178438 - protein, 160 aa, Glycine max
  Coding DNA Sequence Number=SeqID_86753
  Homolog annotation: Hit_ID=A5B939; Match level="QueryCoverage=40%, HitCoverage=54%, E-value=8e-14, Identity=54%"; Hit description =Putative uncharacterized protein
  Subcellular localization annotation: CTP_CleavageSite=36; ConfidenceScore=5.43e-01
VDSRGSPLFNSLPTLETAQPEVGSSGWKSTARRVVSASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 178439 - protein, 84 aa, Glycine max
  Coding DNA Sequence Number=SeqID_86754
MVAGNTTIEKPREEWSEEEKRLVQYNLKAKNIIASALGMNEYFRVSNCKSAKDMWDTLQDMQKRFTHIINHLASLGNFFPNEDL

SEQ ID NO: 178440 - protein, 100 aa, Glycine max
  Coding DNA Sequence Number=SeqID_86755
  Homolog annotation: Hit_ID=Q6WAY4; Match level="QueryCoverage=75%, HitCoverage=13%, E-value=7e-09, Identity=41%"; Hit description =Putative uncharacterized protein
MGSCQTPSLKKRFYQVKVKSLGITSLKELGQLMGQLQRRAFCKAYGKIWDLTMAEVSTEAIASLAQYYDQLLRCFTFGDFQLSPMVEEFEEILGCPLGGK

SEQ ID NO: 178441 - protein, 45 aa, Glycine max
  Coding DNA Sequence Number=SeqID_86756
AHSGASGVLKATSADPWSASFMVETRTDEEAGRTGRRGQSPPSRR

SEQ ID NO: 178442 - protein, 209 aa, Glycine max
  Coding DNA Sequence Number=SeqID_86757
  Subcellular localization annotation: CTP_CleavageSite=36; ConfidenceScore=5.10e-01
MAFLGEISSQTVVNSTLGFIFPNGSIVHNDSGVSFQASTPVPIRVPNGCDFQTLKTRIHNTLKLTDKQFLDEIYYRQPFTYAGNQFRFQCMQLKDDADVNTMLMCNHEFSFVGPIELLCSIAKTPDGILNLLQATMTPTYDALLYYNGRWNMSRQNEFVGYSFTGKNLKKFDIPTGCTMDELKDLIKQVAPTEIPPYFLESGKIKRIST

SEQ ID NO: 178443 - protein, 109 aa, Glycine max
  Coding DNA Sequence Number=SeqID_86758
TETNMLAIVSKYQEELNLATTHEHKVADKYARVYAEKEARGRVIDSLHQEATIWMNRFALTLNGSQEIPRLLAKAKAMADTYSAPEEIHELLSYCQHMIDLMAHIIRNH

SEQ ID NO: 178444 - protein, 232 aa, Glycine max
  Coding DNA Sequence Number=SeqID_86759
MEQNMLAIIRQYKEELNQSLNHEQKLVEDFAQAYAEKEARRRVIDALHQEATMWMDRFSLTLNRSQDLPRLLAKARAMAEGVQEQMKANMSALKDQMASITKAMLKIQKSIEDNATAATSNIAREAELVLQPAMNLGRDRSVTGFNRRYSPQAYPYGLPPNFTPCTAPDDLSQAPTFEGQLPPHADFPLQEDDEEDAHLGPLLPPRESAPHELPQPNIIRHAPSQSTPVKEL

SEQ ID NO: 178445 - protein, 75 aa, Glycine max
  Coding DNA Sequence Number=SeqID_86760
MSARVQSIAFLCFLRTDNNFSSCSSARETDIITGKLLLSSKGKTPPPGMQSIFTLRFTLSIKFRHMIKYNFRLNA

SEQ ID NO: 178446 - protein, 128 aa, Glycine max
  Coding DNA Sequence Number=SeqID_86761
  Subcellular localization annotation: CTP_CleavageSite=52; ConfidenceScore=5.18e-01
MSCLVIKTPTFLCRSVSWCMPPTRHPLNPDKSSRALGFPTLITGLCQSFGVPVMPSKVIRPPITRGFIDKYSTPRQAQGDASQAADVLPPTGGQPPGAGADTPVSLPAQPQSAGPGFRSFCMPYSRSV

SEQ ID NO: 178447 - protein, 199 aa, Glycine max
  Coding DNA Sequence Number=SeqID_86762
MARRDKIWSFCTLCHPEASGPMTCGDKIWSFRTPLPFRHSRVRWRAETKIDTAVSDGAQRQKLVIMHPLSSRGGGPDDTRRQNLVIPHPFATQTQSCPMARRDKIWSFCTLLSSRGGGPDDTQRHLTVIRTLLSSRGSGPDDTWRHLMVICTLLSSRGGGPDDKQRPMWSFCTLRQSRPTSPLTRGDLHHLPHSQDLSY

SEQ ID NO: 178448 - protein, 166 aa, Glycine max
  Coding DNA Sequence Number=SeqID_86763
AVHVSSIIKREASGDWETRSSVVFRIGSFAKYKKKEGVETRVVITERAGRTKSVSYLCFPLISDESPETCQKSKGSRLAQSVKFRNVAEIEKSKKGGVQIAIWPTWAFQILPPEGCCFWRKQPCSPGRAGKSKPRRFRNVSVSNYAKILDRSSTFIVRSSFSSVFN

SEQ ID NO: 178449 - protein, 134 aa, Glycine max
  Coding DNA Sequence Number=SeqID_86764
  Homolog annotation: Hit_ID=P03851; Match level="QueryCoverage=62%, HitCoverage=100%, E-value=4e-44, Identity=98%"; Hit description =Uncharacterized 9.4 kDa protein
STLEDPSGDNAGKNMTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 178450 - protein, 17 aa, Glycine max
  Coding DNA Sequence Number=SeqID_86765
MGTNPNGKRGLPNGAKY

SEQ ID NO: 178451 - protein, 204 aa, Glycine max
  Coding DNA Sequence Number=SeqID_86766
MDNEEGMQEQMKADLSALKDQMASISKVMLKLQKTIEDKVTATASSTVREVEPMLQPALNPGRDRNTAVFGRRYIPQAYPYGLPPDFTPRATSEDLSQAPTFEGQLPPYDDYPGQDDKEGDTHLGPLLHLKDSSPCELPKPNIVRHIQTSPTPVKESVPFVEDKGKIEALEERLRAVEGLSNYPFSDLADLCLVPNIVIPPKFK

SEQ ID NO: 178452 - protein, 88 aa, Glycine max
  Coding DNA Sequence Number=SeqID_86767
MSPDFMGQDDKGAEDDVSLCLSTAIVCADNSLGIFASHPTSRVRMTQTVCTDNRLGISDMSPDFMGQDDKGAEDDVSLCLSTGLLAPD

SEQ ID NO: 178453 - protein, 70 aa, Glycine max
  Coding DNA Sequence Number=SeqID_86768
MPHQKRKTLDEVSLSSSESETQHDHISTSTPYSSHRPRYRAQYLKVCTKSMGVICERSNIRITQPYLQNY

SEQ ID NO: 178454 - protein, 143 aa, Glycine max
  Coding DNA Sequence Number=SeqID_86769
  Homolog annotation: Hit_ID=Q2N2B2; Match level="QueryCoverage=86%, HitCoverage=24%, E-value=2e-07, Identity=30%"; Hit description=RPGR ORF15 isoform
MRTLSPLKARTLSPYKGEGEDFEPSKGEDLESFDGEDFEPSKGEDLESFDGEDFEPSKGEDFEPSKGENFESSKGENFESSEGENFESFDGEDFEPSEGENFESSDGKDFESSEGENFESSKCKNFESSDGEDFEPSKGANRY

SEQ ID NO: 178455 - protein, 127 aa, Glycine max
  Coding DNA Sequence Number=SeqID_86770
MTRGNPGDLQPFDPEIDRTFHILVRHSVHPDYPEHFVPFEHPEHSVIGESEHSVVGNFEHPDFEHYNFEHSDFEHSENMAHPPPRERTIRKMAAPDFTYENLCIQYPDEDVPYVLKTGLIHLLPKFH

SEQ ID NO: 178456 - protein, 42 aa, Glycine max
  Coding DNA Sequence Number=SeqID_86771
MDKSLKEGENEWREREKRSTKFCASNKPTNPRSSPRFSTKCA

SEQ ID NO: 178457 - protein, 114 aa, Glycine max
  Coding DNA Sequence Number=SeqID_86772
GRSLPRSSPRRARLLPPEATTFWRKNLEGPTFEEVTKTHGLRKIPPSISVTSRNFHGSRKSHLGQGKLAQASQLLSSEGISLPRRAGYLRLKIFHGPGELDASLGELGPENSIK

SEQ ID NO: 178458 - protein, 172 aa, Glycine max
  Coding DNA Sequence Number=SeqID_86773
MARGGHWWSVGVEEELGGVGGGFRGRGGGRRWLFYVAGRAKSLDSCPPIQMKLGGGNIEDSEHAHGAIVKGYLYMKIVKNAIIRIEIIPQRNHLSNLFGTKMKMTKIVINKGVPVEADPAQTLMDYLTPTLRESNTITLPNLPKEVTFDLKHGFLQMLENNPFNGVAHENPM

SEQ ID NO: 178459 - protein, 195 aa, Glycine max
  Coding DNA Sequence Number=SeqID_86774
  Pfam annotation: Domain name=Transposase_23; Domain location=30-100; Score=3.5; E_value=0.00049; Accession=PF03017.5; Description =TNP1ENSPM transposase
MPQEPLVGASGPQVSTKKSYVDPSGNDPETTDSDRCGLYIEANPACLVALGRVYEGSTVVHNTPLFPGQAKVGVEEVKDPDALVPVPTDEVSLVGQAIHTFLAWPTHLVKSLSQQATVSPAKPPQKPDPEVDDPLYLMTLTIPELFLRPYQVTWDATMFRVFNPNFSLYIKHEDLSEIAHGGQCLSISVLQLWIL

SEQ ID NO: 178460 - protein, 121 aa, Glycine max
  Coding DNA Sequence Number=SeqID_86775
MTGVCVGVEMRGVGVVEKEGAAVSSGAEVVGTSDFLPPAFLGPLNVTVGSSRFQQFFLIYAKLMAGLRLSRDLEYDWTPLALHRAMIKAGNPTLDESCYVVRKIWWEIRYPTFISIFIIMP

SEQ ID NO: 178461 - protein, 97 aa, Glycine max
  Coding DNA Sequence Number=SeqID_86776
MGPKSTLRLIRTLGPSLASLAQSTWSFLSNALAGDPPIIRITSSDENPKAAQIQGPMTRGRTKQSKDTLQQMVAAILDKAQVEKDEGSEALPKILIA

SEQ ID NO: 178462 - protein, 230 aa, Glycine max
  Coding DNA Sequence Number=SeqID_86777
  Gene Ontology: Mol. function=oxidoreductase activity, acting on the CH-NH2 group of donors, NAD or NADP as acceptor; Cellular component =chloroplast; Biological process=nitrogen compound metabolic process
  Homolog annotation: Hit_ID=Q93WZ7; Match level="QueryCoverage=93%, HitCoverage=9%, E-value=9e-56, Identity=59%"; Hit description=NADH glutamate synthase precursor
  Subcellular localization annotation: CTP_CleavageSite=33; ConfidenceScore=5.75e-01
MSNAVSFTLPSLNNPQLNALNSPNKARLRLGLRSRVVASCIERKRFLGTRFRPIGSDRIRLLQSCRLPKPRVAVRSAFSAVPEKPLGLYDPAMDKDSCGVGFVAELSGESSRKTVRSGLGWVWFGFWWMWCGVAFMNEGDGRAGNVGADDAQRCMRMRSQHWRWCRVLMKVVDFELPPQEKYAVGMFFLPKSEKRREESKRIFSKFSFAVNSTALRCCPCMAAFPTPFCW

SEQ ID NO: 178463 - protein, 122 aa, Glycine max
  Coding DNA Sequence Number=SeqID_86778
  Subcellular localization annotation: CTP_CleavageSite=21; ConfidenceScore=5.24e-01
MAESSKRHKGLSSSSTTADLCCHSPSGDLPAPPNPSFSSLHSLTLFSTDVQRERYYSSFSNRDIIDPKYLDSELFEGENIDCYQVFQNSEQVDFMIKKLPYYPELVRVFYNNLEIHEGVIFS

SEQ ID NO: 178464 - protein, 242 aa, Glycine max
  Coding DNA Sequence Number=SeqID_86779
  Homolog annotation: Hit_ID=UPI00006A2D9E; Match level="QueryCoverage =47%, HitCoverage=57%, E-value=7e-09, Identity=15%"; Hit description =UPI00006A2D9E related cluster
MTHQLHVLAFKGLHALAFRGLHVLAFKGLHVLAFRGLHALTFRWLHALAFRGLYILAFRGLHILAFRGLHALAFRGLHTLFFKGLHVLALRGLHVLAFRVLHVLAFRGLHIYAFRELKFLGHPPDLGGGPTARAQPEEETIAQLLCILGKDFTQPLQGDECGSCAPTYGRCCYFATFFPATTSPISPCQSVNWDRARKTPSGLEKVQQGPGVLALITGLFRFYGVTTTPISPCRSVSWFMPS

SEQ ID NO: 178465 - protein, 51 aa, Glycine max
  Coding DNA Sequence Number=SeqID_86780
EKERRSLPPSSPRRAQLAQASSVASSRRRCLLENFLEGPSGSGCYLHPPVY

SEQ ID NO: 178466 - protein, 482 aa, Glycine max
  Coding DNA Sequence Number=SeqID_86781
  Homolog annotation: Hit_ID=Q8CWJ1; Match level="QueryCoverage=97%, HitCoverage=52%, E-value=7e-38, Identity=26%"; Hit description=FOG: Ankyrin repeat
MNLEKLESVLNGKATAELKSDFVVQISTRHAIPSMQVIRQQLKIARMTQDGYERLLKYLCPNTQVDCTDPNQNKLIQIFGLFETIYNLTIDAYQQAPGSVHEQEVYFDSKLSPWDKTDLLMSIAPSMRGKIDQYFPKRLTKKFFNLTPTSPLENLVVWDEESANTIIPKRLKSIKTDFEEDKRIDDLRKRIRVTSPWRALLSEDNYWVLSQLAHQPDFTPKIKNMVLKRMREIEETESQKVGTNTIELGLILNAVTKERVVDAKSRVQFLLDESISSSSYDEWKAPLLRLSAKHKLFQNDIEGALKDFKQALKACDECAFGGLRGEIARDGFATELILKGFIQNNQEIYYRNMLAFMEWPEGHVSFENAAVECEEFFWDTLYQPYSGIAPIVCISKKQYQLIIEETTEIIFQADWNGLNEWFKKNAKQYRKLNIKDARRNSILLSWLKLYQNLNKNKYRLSLEIAHELASELEKYEAMLENW

SEQ ID NO: 178467 - protein, 166 aa, Glycine max
  Coding DNA Sequence Number=SeqID_86782
  Gene Ontology: Mol. function=transmembrane receptor activity; Cellular component=intrinsic to membrane; Biological process=innate immune response
  Homolog annotation: Hit_ID=Q6F810; Match level="QueryCoverage=68%, HitCoverage=32%, E-value=1e-24, Identity=47%"; Hit description =Putative uncharacterized protein
SGIPFSLPTEAQWEYAARNRGQYVVIATDDGTLRVNEKSGKGENFATDEDREQAGEPNGILPSLINFPVDKYSPSPLGLYNMADNGKEWVMDWYDPDYYSKSPKKDPQGPTQPVIKSKSKNQYLKVLRGGDNPVPGVKFGGKEVSCLGDKVSCPEHGDTYIAEGDE

SEQ ID NO: 178468 - protein, 194 aa, Glycine max
  Coding DNA Sequence Number=SeqID_86783
  Homolog annotation: Hit_ID=Q2R0G4; Match level="QueryCoverage=54%, HitCoverage=11%, E-value=1e-07, Identity=36%"; Hit description =Putative uncharacterized protein
  Pfam annotation: Domain name=DUF1723; Domain location=109-158; Score =40.1; E_value=7.8e-09; Accession=PF08330.1; Description=Protein of unknown function (DUF1723)
MSQGQAVPFAGKWHRFTVRNDGEKVVPEPQGDAEHTEIWESEVMIPFAVERTVYAFGGPLPDQESLSSSMNKPIGITYLGLDRVEQAYEDFWKTYGIFDLIQFSRSGPEYRPEMLIAAMHFFESSTNTFQFKCGMMTPTLLDVAALTGLRPSGETYDPTNSSDNIKLVSKENTFSKYIAEHKGSVEEEVSDEEH

SEQ ID NO: 178469 - protein, 257 aa, Glycine max
  Coding DNA Sequence Number=SeqID_86784
  Gene Ontology: Mol. function=oxidoreductase activity; Cellular component=cytoplasm; Biological process=amino acid metabolic process
  Homolog annotation: Hit_ID=A8GEN4; Match level="QueryCoverage=99%, HitCoverage=64%, E-value=1e-124, Identity=83%"; Hit description =Glu/Leu/Phe/Val dehydrogenase
  Pfam annotation: Domain name=AlaDh_PNT_C; Domain location=44-227; Score=-58.6; E_value=0.051; Accession=PF01262.12; Description =Alanine dehydrogenasePNT, C-terminal domain
  Pfam annotation: Domain name=ELFV_dehydrog; Domain location=40-253; Score=286.8; E_value=4.3e-83; Accession=PF00208.12; Description =GlutamateLeucinePhenylalanineValin
  Pfam module annotation: Pfam domain module=AlaDh_PNT_C::ELFV _dehydrog; Domain location=44-227::40-253
HPAPDVGTNAKVMAWMMDTYSMNHGTTITGVVTGKPIHLGGSLGREKATGRGVFVTGSEVAKRLGVQIEGAKVAVQGFGNVGSEAARLFVGVGARVVTIQDHSATLFNADGIDLAALTEYQTKHKQIAGSPGASEIESEAFWSVDMDILIPAALEGQITRERAEILSAKLVLEGANGPTFPEADDILRSRNITVVPDVICNAGGVTINAKMDRIMTDAIVHVCDKAAEKACSLRTAAYIVACERILLARKDRGIYPG

SEQ ID NO: 178470 - protein, 75 aa, Glycine max
  Coding DNA Sequence Number=SeqID_86785
DNVGSVGFERRQYGFSGSVGGSVGSNEDNVDFPAVLGVLWVRPTTMWVSRERFPADFRREEKENNNFRQEDDKEK

SEQ ID NO: 178471 - protein, 153 aa, Glycine max
  Coding DNA Sequence Number=SeqID_86786
MDNEEGVQEQMKADLSALKDQMASISEVMLKLQKTIEDKATATASSTVTEAEPMLQPSLNLGLDRNTTVFGRRYSPQAYPYGLPPDFTPRATPEDLSQAPTFEGQLPPYKDYPGQNDGEGDTHLGPLLHLKDPSPHELPQPNIVRHIPASPTP

SEQ ID NO: 178472 - protein, 143 aa, Glycine max
  Coding DNA Sequence Number=SeqID_86787
MACTKKTGQMTSEAAKEIAEKIASQEHPGRVRAAGVGVTIKQYFGSAPQSSCSSSSMPPEELEQLTQQIRDQLEESIIEKPDVVPVAITDPITETSLPPEPEVGPSAARVSTKGSCVDPSSTVLETGDSNKCGLYIEDNPSRL

SEQ ID NO: 178473 - protein, 145 aa, Glycine max
  Coding DNA Sequence Number=SeqID_86788
  Subcellular localization annotation: CTP_CleavageSite=32; ConfidenceScore=5.72e-01
MGSPPDSTPPPPPPPPPSDASASPSVVKRTCKASRLRSLSTRPPGAERPVVHVDPATGKADGPHRKKLRTYLGIVVRDKVDITYENWKEVPTAQDVLAATIGRPEHPGRVRAAGVDVTIKQYFGLAPRTSRNASSLPPDELQQLT

SEQ ID NO: 178474 - protein, 39 aa, Glycine max
  Coding DNA Sequence Number=SeqID_86789
MGVLFTLPSRYYFTIGHPEYLALQGGPADHTDHVPHATR

SEQ ID NO: 178475 - protein, 71 aa, Glycine max
  Coding DNA Sequence Number=SeqID_86790
  Homolog annotation: Hit_ID=Q84VH5; Match level="QueryCoverage=45%, HitCoverage=4%, E-value=2e-08, Identity=93%"; Hit description =Envelope-like protein
MQVLEATIKATTEKKMELERLIKRLSESGIDDGEAVEEEVEAAEEEEDAAAEEEEDAAEDTESDDDSEATP

SEQ ID NO: 178476 - protein, 88 aa, Glycine max
  Coding DNA Sequence Number=SeqID_86791
  Pfam annotation: Domain name=G-patch; Domain location=1-42; Score =17.6; E_value=0.0014; Accession=PF01585.14; Description=G-patch domain
MVAQEMLRHGYEPGMGLGNDSHGNADVVDIRGNPYKYGLGYELGKPRRRNTPSRLRVDRAWPGHASQCFTSARIMFEEEVAAIGEESP

SEQ ID NO: 178477 - protein, 82 aa, Glycine max
  Coding DNA Sequence Number=SeqID_86792
MGKSLFHIKNIKINRKNKFTNPNQHILYETCGVSNTSVEEKLHDDDKGDDKKLKDQSKNNSSESKINQRTTQVNQEQFKSSR

SEQ ID NO: 178478 - protein, 373 aa, Glycine max
  Coding DNA Sequence Number=SeqID_86793
  Homolog annotation: Hit_ID=Q6WAY6; Match level="QueryCoverage=78%, HitCoverage=54%, E-value=5e-20, Identity=26%"; Hit description =Putative uncharacterized protein
MGNWRTALRNKLRGAPDSKRYAITSRGSRLEGGGHMNSARQLNSWILALASKYFLGIPTTPFIDVLAVLIFGGVFFPNVDGLVDLAAIDAFLAYHDHKQSLIVTMLADLHLRPKVRHACSLESHRSCIEKGGVNWDQLLANKEGASIIWFPRWKEGRIEVLISCGGFLNVPLMGTRGCISYNLVLAIRQLGYPIRGAPLEEEIAPIISRGFNKTNVETLQKVRKAWEVVRKKDKELRGSNNGSISGYRKWLRAHVQGLDWLPSLIPAKREEVEAPEEDEEVQTLRTVLQQAQTVKERFKSAALKIRKENVELRDINTATTKALEQETKRARREEHDQNKFRGDLWGSNSELKLRREERDQSRVDSLILKDESK

SEQ ID NO: 178479 - protein, 132 aa, Glycine max
  Coding DNA Sequence Number=SeqID_86794
MRLLLHLPLVKSEEAKGEESSEEIYPQEEGQPLMVKEECKETLVSIATSLRLEFIPQVKELLDEGLVSKRLNPCALLVPKIGVPMNPKRIKVIPEWPTPPSRSYPARVLGRRLQVDWARDPREGPRVLMSLR

SEQ ID NO: 178480 - protein, 124 aa, Glycine max
  Coding DNA Sequence Number=SeqID_86795
MAAQLIHDRVVMECLEGVWETLEGNERCRFRGTIRLTATSLVHPEEPALEPVQVIEVSSSEENLEEDLEELPPEPAMDALDLPEDDEDPLLNVDSSEDIMSASEADSTEEGGPGGTANSDDSSS

SEQ ID NO: 178481 - protein, 63 aa, Glycine max
  Coding DNA Sequence Number=SeqID_86796
MGEVEEVQEQIKADMEAMKEQMATMMEAMMSMKKIMEANAVAVAATRAVAKCPKTNPESIYLG

SEQ ID NO: 178482 - protein, 256 aa, Glycine max
  Coding DNA Sequence Number=SeqID_86797
VDSRGSHLPMDYKEIEATLCIPGRGFILNTEGHHGKILRKDLTTLAQVWNVLSYSNLAPTSHTSNLTVDRARLIFGLVSRMDMNIGALIFRQITFIAQSNTSRLGFPTLIIALCRARGVVSDNLTFERLSPVVEPPGSIPSVEQFREMVAWPGTQPSLRREGEGSTTQEGETHVRQVAAATPERSLEATSEPPAPVVDLPSPQRTADPSTPILKILEDPTTPVLAMDTSPPATPVLHLTDEEDVQTQDTQDQSQEF

SEQ ID NO: 178483 - protein, 280 aa, Glycine max
  Coding DNA Sequence Number=SeqID_86798
MEAIKEQMATMMKAMMSMKKIMEANAVIVAAISAVAKVNPMLPSGLKQMNHLTSNMAHISQTMGETHEIPHHNLADFEPWLGYATEGQAVGGIPFENTLEGPQFRPQPQPLHFAVGRAPPAMAEKGKVDHLKERLRAIEGGEDYAFANLEKVVPNTQTWSFPSSKVLDFDKYKGTTCPKNNLKMYCQKMGEYAKDEELGETFLPRKSYWGSCNLGDGSFKEHAQKVEGSGGPSGTPNDGKGDDDRDGRHIIDTLLWKDGGLRTLKALQIWSSPVKGSMWV

SEQ ID NO: 178484 - protein, 73 aa, Glycine max
  Coding DNA Sequence Number=SeqID_86799
MFMQRSPTGTLVPLDLEIEATLRTSRVERRRKLLQDKIVVSIVEEETHFSDSLSHDSPSSRESANHHSEVVTM

SEQ ID NO: 178485 - protein, 167 aa, Glycine max
  Coding DNA Sequence Number=SeqID_86800
  Gene Ontology: Mol. function=structural constituent of ribosome; Cellular component=intracellular; Biological process=translation
  Homolog annotation: Hit_ID=Q32703; Match level="QueryCoverage=22%, HitCoverage=90%, E-value=4e-11, Identity=84%"; Hit description =Putative uncharacterized protein
RRETVRSISGVGVRALRGPFPSTRGPGRTHLWCASYRAHEPPVAQPRQRWVLCPSGDGAKEVLRIQEKEPHQSIPNLVVKLYCGDDTVGEAGERKCSHFLGYSGEQISSGDDGVGPVAQRIRARGYEPRCRGFESLLAHNRPKKGRIFPSGGRKIMIGLADPKLWNL

SEQ ID NO: 178486 - protein, 146 aa, Glycine max
  Coding DNA Sequence Number=SeqID_86801
DAGSRQARQGASAGVGGCRGWLNYAASEQIVLRVHHMRAIGAGLFAITPAGERGMCCKAIKLGNARVFPVTTFVEKGFPKSGKCECNCYYTHLSSFQHFRLAERCTKCSRLASIPDRTSSIKRERVGLLMEACLWAFYGGWIFELQ

SEQ ID NO: 178487 - protein, 90 aa, Glycine max
  Coding DNA Sequence Number=SeqID_86802
MDILMILQNPHQKDEWQRNGEGRERGDATSRRMSLEEAHHHRRPWIRAWRKKEMNEGRGREEHEILCSKRALKSEPTNPRSIPRFSTKCA

SEQ ID NO: 178488 - protein, 335 aa, Glycine max
  Coding DNA Sequence Number=SeqID_86803
  Homolog annotation: Hit_ID=O44238; Match level="QueryCoverage=20%, HitCoverage=21%, E-value=9e-07, Identity=37%"; Hit description=mRNA, endostyle-specific
MVTTRSGLKRESLLENFNPPPTTMIDNDTLHQLQVRIAKMVHHHKEELRKLKADHNKLEAYVRRPQEDEHCKFMDSSSIAYARNLPAAWTSYENKPNVTFRWKKCQGSKMKFHRLDKSVRKEKVVQGPITQVEQMAQIGATRGSRVRLPRKKNARSRHQCWGDKHPVGLTEACNQSWKPQGPQPHPYLSKSGHVGAQDPHSSRCSGTGEILPQYALWLHDSLPLVVLAQLALLRDQGGDQGIDKGKLLAPHLGAQAQMWSPRKARTFSPLKERTCSPLKARACNPLMARTCSPPMARTCRPLKAKACSPLMARMCSPPKMRTCSPLKARTCSPLK

SEQ ID NO: 178489 - protein, 52 aa, Glycine max
  Coding DNA Sequence Number=SeqID_86804
MIMNNWFNDLPDAILPRKGPVTRTMSKRLQEDWARAAEEGPRVLMNLRGSIL

SEQ ID NO: 178490 - protein, 141 aa, Glycine max
  Coding DNA Sequence Number=SeqID_86805
MDEDPLATRWNPLRGIWCDLPIKEKPNELQMNIVIWCPYEEHKHVRPFVGQTLYFGFIRCKTNLRPYLLERVLRQFGHPYIIPLGNVVSLGGPWACSSNYMPWFYKLSHQVETMYQVETTLARKKDDKDGGKGDKKDAKDG

SEQ ID NO: 178491 - protein, 168 aa, Glycine max
  Coding DNA Sequence Number=SeqID_86806
  Gene Ontology: Mol. function=nucleic acid binding; Cellular component= nucleus; Biological process=cell redox homeostasis
  Homolog annotation: Hit_ID=A9PJ87; Match level="QueryCoverage=39%, HitCoverage=26%, E-value=6e-29, Identity=86%"; Hit description =Putative uncharacterized protein
  Pfam annotation: Domain name=zf-U1; Domain location=53-89; Score =27.9; E_value=1.4e-05; Accession=PF06220.3; Description=U1 zinc finger
MTGKGRRMEELGRGLEGGEKVGGGGGVGSGGRKEEEGGVENFEMRDRRYWVSQGNKWCDFCKIYISNNPGSIRNHELGQRHKDNVSKRLAAMRKDNIAKEKEQKETARAIEQIEAVRVSHLFYINHADAAFFILIHDNDITGIIMNNSFIHSVLPSLFTPQSLLKLLK

SEQ ID NO: 178492 - protein, 66 aa, Glycine max
  Coding DNA Sequence Number=SeqID_86807
MDVKHFEVVKRRSHADKQWSSDEIRDELRDFYKAKKLEKQPRILLPNSSRKLVISCGLYSSNITLF

SEQ ID NO: 178493 - protein, 125 aa, Glycine max
  Coding DNA Sequence Number=SeqID_86808
MAYFSSKTPKEINKSSFTYPVLGRFDKLHSDREAQMIEGEDSKSDEDLIKAKDATNDHKQFEAPNETDQDLQIHPQHQNLAPVEGTNWTSQNYPKQPKTTTPKRHKDKSKLLKDMALIYCLMHYK

SEQ ID NO: 178494 - protein, 513 aa, Glycine max
  Coding DNA Sequence Number=SeqID_86809
  Gene Ontology: Mol. function=nucleoside-triphosphatase activity; Cellular component=integral to membrane; Biological process=transport
  Homolog annotation: Hit_ID=A7QBF4; Match level="QueryCoverage=96%, HitCoverage=34%, E-value=0.0, Identity=68%"; Hit description =Chromosome chr13 scaffold_74, whole genome shotgun sequence
  Pfam annotation: Domain name=ABC2_membrane; Domain location=306-512; Score=178.8; E_value=1.4e-50; Accession=PF01061.15; Description=ABC -2 type transporter
  Pfam annotation: Domain name=ABC_tran; Domain location=24-205; Score =84.3; E_value=3.9e-22; Accession=PF00005.18; Description=ABC transporter
  Pfam module annotation: Pfam domain module=ABC2_membrane::ABC_tran; Domain location=306-512::24-205
MKKQGIEENRLQLLRDISGAFRPGILTALVGVSGAGKTTLMDVLAGRKTGGYIEGSISISGYPKKQATFPRISGYCEQNDIHSPNVTVYESLVFSAWLRLSNDVNKETQKMFIEEILELVELHPVRHFIVGLPGISGLSTEQRKRLTIAVELVANPSIIFMDEPTTGLDARAAAVVMRTVRNTVDTGRTVVCTIHQPSIDIFENFDERGGQVIYGGPLGRNSQNLIEYFEAIAGVPKIKDGCNPATWMLEISSPVVESQLNVDFAELYTKSDLYQKNQEVIKELCTPVPGTKDLHFPSKYSQSFVTQCKACFWKQNCSYWRNPQYNAIRFFTTIVIGIIFGLIYWDKGKKTQKEQDLLNLLGAMYAAVFFLGASNTNSVQPVVAIERTVLYRERAAGMYSELPYAIGQVAIEVIYVAIQSLAYTILLYWMIGFEPRVENFLWFYYFIFMCFMYFTLYGMMTVALTPNYQIAALVMSFFINFWNLFSGFVIPRTGQANGKGMLKIKEYRVTTWS

SEQ ID NO: 178495 - protein, 93 aa, Glycine max
  Coding DNA Sequence Number=SeqID_86810
MGTNQIGKRFYQVKIKGLDVTSLKELGRLMGPVATYPSAGGRRVTRGMRVPRKEYARSRHQRLFEENVGKTGKDAIYELLSESSGVVFTHGKY

SEQ ID NO: 178496 - protein, 222 aa, Glycine max
  Coding DNA Sequence Number=SeqID_86811
MDNEEGVQEQMKADLSALKDQMASISEIMLKLQKTIEDKAMATASSTVREAEPVLQPDLNSGRDRNTAVFGRRYSPQAYPYGLPPDFTPRATPEDLSQAPTFEGQLPPYDDYPGQDDEEGDTHLGPLLHLKDPSPHELPQPNIVRHIPASPTPVKEYVPFAEDKGKIEALEERLRAVEGLGNYPFSDLADLCLVPTSSSLPSSKYQTLISTKGRHVQKGISG

SEQ ID NO: 178497 - protein, 136 aa, Glycine max
  Coding DNA Sequence Number=SeqID_86812
MADQQATKSKAKDKQKYYVRDKQVIRRPAQDVKEALLGGNLGENVNPYPRKQKKKGRKFPVKEWEKAKRKERKFPVKEWEKAKRKERKFPIKKWEKIKREKGKFPIKEKREERKFPIKDRKKTEEMCRKVVGPDNI

SEQ ID NO: 178498 - protein, 79 aa, Glycine max
  Coding DNA Sequence Number=SeqID_86813
  Homolog annotation: Hit_ID=B0HC01; Match level="QueryCoverage=35%, HitCoverage=59%, E-value=6e-08, Identity=100%"; Hit description =Putative uncharacterized protein
MSSAYPLILWITVLPPLSELIPLAAAERPSAARNSYDHDYEFELGTRQQSYFMVQQEAELCVPIYCRSRVLQQEAAVHN

SEQ ID NO: 178499 - protein, 109 aa, Glycine max
  Coding DNA Sequence Number=SeqID_86814
MSSGPPPLDDTRVRITGQYDKDYGAVDKSKALALTYPPMRNSDLQDAYISGKGADDHIGLRLSITLEVRIIVRCLRGLPALGSWQQKAVWSTKGGSCSYVSSNEELRPT

SEQ ID NO: 178500 - protein, 120 aa, Glycine max
  Coding DNA Sequence Number=SeqID_86815
RRYQILSSSVAVVRPPLQELCSTPTYLALLILLPVAAASGDKSCLTGATLPEGRKADRYPVSGRVGTGERTRELPGGNACLWKNASNAAFLRFLAFCWPFAHMFFPALSPDSVDNRITAF

SEQ ID NO: 178501 - protein, 192 aa, Glycine max
  Coding DNA Sequence Number=SeqID_86816
MAPKKLSAKRSRRDAVTEGTNAVPEFDSHYFQSAEHQQRFEAIKGWSFHRERCIQLREDEYTDFQEEIARRHWTSLVTPMAKFDPEVVLEFYANAWPTEEGVRAMQWIPFDADALSQFLGDSLVLEEGQECEFSQRRNRADGFDEEAIAPLLCAPGQDFARTAAGRRVWIMHTSMTTFDPDVDDIAAQQCLA

SEQ ID NO: 178502 - protein, 89 aa, Glycine max
  Coding DNA Sequence Number=SeqID_86817
ESIDEEDPRPTSSNGAYIKAFPLVALLGFPSIREKENGLEPQFYCLCARGIFFSTNIILQIPTVGICGNEFRRGRSDNEFERKKERRDV

SEQ ID NO: 178503 - protein, 202 aa, Glycine max
  Coding DNA Sequence Number=SeqID_86818
  Gene Ontology: Mol. function=ribonuclease activity; Cellular component=integral to membrane
  Homolog annotation: Hit_ID=A4WFU4; Match level="QueryCoverage=94%, HitCoverage=56%, E-value=3e-87, Identity=85%"; Hit description =Putative ribonuclease
  Pfam annotation: Domain name=Ribonuclease_BN; Domain location=45-198; Score=-98.1; E_value=0.095; Accession=PF03631.6; Description =Ribonuclease BN-like family
METGPEEAKAPGTVSKALGTVTGIAARIQQFPMVAHLIRATERFNDRMGNQFGAAITYFSFLSMIPILMVSFAAAGFVLASHPTLLQDIFTKILNNVSDPTLASTLKSTINTAVQQRTTVGIVGLLIALYSGVNWMGNLREAIRAQSRDVWERKPQDQEKIWVKYLRDFVSLIGLLVALIVTLSITSVAGSGAADDYLRALS

SEQ ID NO: 178504 - protein, 368 aa, Glycine max
  Coding DNA Sequence Number=SeqID_86819
  Homolog annotation: Hit_ID=A4WFU6; Match level="QueryCoverage=100%, HitCoverage=60%, E-value=1e-175, Identity=75%"; Hit description=AsmA family protein
  Pfam annotation: Domain name=AsmA; Domain location=1-368; Score =110.1; E_value=6.7e-30; Accession=PF05170.5; Description=AsmA family
MTKTTRVISWTAGIFLLLIVVVVIIIATFDWNRLKPTINQKVSTELNRPFAIRGDLGVVWEPTLAPLALFTKTVYLPWIKLQQPDARLIRLSEKNNNWTFNLASDGEKDPHARPSPWSFRLDNILFDRGRIAIDDKVSKADVEILVDPLGKPLPFSEVTGTKAKGDTASVGDYVFGLTAKGRYNGQPLSGKGKMGGMLALRSEGTPFPVQADFRSGNTRVAFVGTVNDPMNMGGVDLQLKFAGDSLGELYELTGVLLPDTPPFETDGHLVAKIDSEKSSVFNYRDFNGRIGDSDIHGSLTYTTGKPRPKLEGDVESRQLRLADLGPLIGVDSGKGTKSKEVKKDLQPAGKVLPYDRFETDKWDVMDAD

SEQ ID NO: 178505 - protein, 78 aa, Glycine max
  Coding DNA Sequence Number=SeqID_86820
MAARKVKLSGKPGPLCPMKYKRLEKEIHFDQWTPIWCGDNIGLRYEVHMPKKNRRRSVDEDNVTGHRLKRKLVEFTCG

SEQ ID NO: 178506 - protein, 63 aa, Glycine max
  Coding DNA Sequence Number=SeqID_86821
MACTHISDSTSNSPQISASPHQLDLAPYASGPYNAQWNAPGLLHDKHTLRSSRILEKMEIEDT

SEQ ID NO: 178507 - protein, 281 aa, Glycine max
  Coding DNA Sequence Number=SeqID_86822
  Gene Ontology: Mol. function=quinate dehydrogenase (pyrroloquinoline -quinone) activity; Cellular component=outer membrane-bounded periplasmic space; Biological process=quinate metabolic process
  Homolog annotation: Hit_ID=A7MLR4; Match level="QueryCoverage=98%, HitCoverage=34%, E-value=1e-137, Identity=85%"; Hit description =Putative uncharacterized protein
  Pfam annotation: Domain name=PQQ; Domain location=145-183; Score=8.4; E_value=1.1; Accession=PF01011.12; Description=PQQ enzyme repeat
  Pfam annotation: Domain name=PQQ; Domain location=206-244; Score =39.3; E_value=1.3e-08; Accession=PF01011.12; Description=PQQ enzyme repeat
  Pfam module annotation: Pfam domain module=PQQ::PQQ; Domain location =145-183::206-244
MPQGHIPNEQYTKTQPHSVEMPNIGNQKLTESDMWGATPFDQLACRIAFKGMRYDGLFTVPDTDVSLSFPGSLGGMNWGSISFDPNNQYMFVNDMRLGLWVQMIPQDTTKSAASNGGEAINTGMGAVPLKGTPYAVNKNRFMSPLGIPCQAPPFGTLSAIDMKTRQIVWQVPVGTVQDTGPFGIKMHAQMPVGMPTLGGTLATQGGLVFIAGTQDYYLRAFDSSTGKEVWKARLPVGSQGGPISYVSPKTGKQYILISAGGARQSPDRGDYVIAYALPDSK

SEQ ID NO: 178508 - protein, 137 aa, Glycine max
  Coding DNA Sequence Number=SeqID_86823
GLCKSFGVPVTPSKVIRPPITRAFIEKYCTPRQAQGGAQQAPDTPSPPHQANPAGSFDMEQYLRHLVRQQAANHRAHGFAPFPWPTPDQFRAEVAWPGDWPEPQAGEASVEAPGDGEEVRMDEVTDLFDFLGGSGAT

SEQ ID NO: 178509 - protein, 56 aa, Glycine max
  Coding DNA Sequence Number=SeqID_86824
MLIMARTRGLGCAIGRLVGRDRHDDHDAADVPERRRPTTSAHRQRVHQMAAEDVIC

SEQ ID NO: 178510 - protein, 124 aa, Glycine max
  Coding DNA Sequence Number=SeqID_86825
MSSSPSTAPVDEEVGDRIEDMLRDHNYLFSTQGKTRAMKTITSSFEGMSNQGAPRWVEPKTNVQSGGFECGYYVMHWMWCIVTAGLKDDWHKWFSDGSSLDVEAITSVRQKWATYFLSFRKRSC

SEQ ID NO: 178511 - protein, 172 aa, Glycine max
  Coding DNA Sequence Number=SeqID_86826
  Homolog annotation: Hit_ID=A6X1W4; Match level="QueryCoverage=79%, HitCoverage=18%, E-value=9e-52, Identity=76%"; Hit description =Exopolysaccharide transport protein family
MPVIAAAAEAAAVPPSRAEGGDAVSNETIVASRRSWNMPFAARPPVSDARKTVEEFPMIRRDKTSQRETRQHNPNGVEAVADLIASGKEKRIVVVSPEGDKASAGTVRLLREFADRGKRAILVDMTAQGTVGLAMLNDRAHCRWTCFGGDEHCRSGRQGRRARRARPRPGWL

SEQ ID NO: 178512 - protein, 176 aa, Glycine max
  Coding DNA Sequence Number=SeqID_86827
MGGTASIPINQGSTALPPVEFRTEPPQPRSSLAGRGESVSTNQLPLDESDYHTPRDISIRSRFDPFGKVIYCHKNEVVTIRCFGLDGPNDIYSPHGKRPRSRHNIQRMWRNIDIVLVCLTFMTLPYMSAAIAFHSESVITGPKDFSGHSMPIGMCPKGTLVDLLNHEVHLFGIYAS

SEQ ID NO: 178513 - protein, 55 aa, Glycine max
  Coding DNA Sequence Number=SeqID_86828
MESHNFPEKCAILLNLSTTIKIESTPLWVLGSPRTKSILLSTQGVDGMGKGVYSP

SEQ ID NO: 178514 - protein, 69 aa, Glycine max
  Coding DNA Sequence Number=SeqID_86829
MSQPTLRREGNARLTGASSKKGIRGVATNVYFEENVGKTGKDVVYELLGFLNPRLTNKSEKDHFKALDL

SEQ ID NO: 178515 - protein, 998 aa, Glycine max
  Coding DNA Sequence Number=SeqID_86830
  Gene Ontology: Mol. function=transcription regulator activity; Cellular component=nucleus; Biological process=transcription
  Homolog annotation: Hit_ID=A5AV48; Match level="QueryCoverage=100%, HitCoverage=100%, E-value=1e-158, Identity=39%"; Hit description =Putative uncharacterized protein
MTLEDFFTLSEMKDGLTAPSRVQELVSVMQKEKDSEVKNAADVTRQWAAVASTIAATENKDCLDLFIQLDGLCFINRWLKDAQDFGVDANDSFVEESITAMLRAVEKLHIDSEKSMSSGIRITVSNLLGHHSARVQDRARTLFDSWKGVGNGDTESHDVELAKVDNSSDKIVREETQPSAANEAGNDNDPASGLIGSEKSLLKSSDNLPVHSSDNVLQLSASVECIDIKVGSENHVAGVPSSAQEVAPAHEGLPICTTGETTSAGTCNFPIPNQSSFEGQSDVVQLSDLAKVEKQEQNINDPPEKLGAPEICSVSSNKPESEPVSMVACEAKAPESVKNPALEQNVEHNEDDVCRNLTNSASMRTPASDRSGEDDVTSITQVFKATENDNDCCSNALQGASVSDSNLGKTEVLDVSVFGTEYVTASKEGKGHEEDTSIGSDSSKPGIDFRSSNIIDKRGSDNELDCGIVDALEFARKIAQEVNREVSCSSEKVSEHRIRQPCSPDSVRKEDELTPVPPKEVSSRQSHATEACSMEGHVSILDNNEAEPECRPYVVSLEVTEKAQDSGGNSEKRLCGFDLNEVGADDMDVSVNTMSTPIPVVSASRPAPTPGLTGAPLQFEGTLGWKGSAATSAFRPASPRKNCDNDRNLSVDMNFDTSKQRQDWLDFDLNVAEGEEGNVKPTAESSGRPSGQSSFEFSPKKSSRLEFDLNSTGDDGDTQPSDQRMEGQLFLGRNGCWSPSPASSSSSMQPSVRNIDLNDRPCLQTDLVDQGPIKSAHLINAFGSKSSNAPVISLLGAKVEVGKKECVPQRLSLQNGKATEPAIELTMSRAGSVLGMTPTVPFNHSSVFGYNGVASASVTPAMSFSSAMYGSGGTIPYMVDSRGAPVVPQVGGSSSTVLSSYSQPPIFMNMAGTQLGLNGFGPSRPNFDLNSSFMIEGGNRDTLAARQFFFPVQGRAVEEQVRSMPQPSSSGVSGKRKEPDSGLEPYPFIYKNPQPPWK

SEQ ID NO: 178516 - protein, 308 aa, Glycine max
  Coding DNA Sequence Number=SeqID_86831
  Gene Ontology: Mol. function=protein disulfide oxidoreductase activity; Cellular component=mitochondrion; Biological process=cell redox homeostasis
  Homolog annotation: Hit_ID=A7NSS2; Match level="QueryCoverage=98%, HitCoverage=99%, E-value=1e-110, Identity=63%"; Hit description =Chromosome chr18 scaffold_1, whole genome shotgun sequence
  Pfam annotation: Domain name=GST_C; Domain location=206-301; Score =1.2; E_value=0.083; Accession=PF00043.16; Description=Glutathione S -transferase, C-terminal domain
  Pfam annotation: Domain name=GST_N; Domain location=78-149; Score =15.4; E_value=0.024; Accession=PF02798.11; Description=Glutathione S- transferase, N-terminal domain
  Pfam annotation: Domain name=Glutaredoxin; Domain location=80-136; Score=40.3; E_value=6.9e-09; Accession=PF00462.15; Description =Glutaredoxin
  Pfam module annotation: Pfam domain module=GST_C::GST_N::Glutaredoxin; Domain location=206-301::78-149::80-136
  Subcellular localization annotation: CTP_CleavageSite=58; ConfidenceScore=5.25e-01
MRGVKRAVFVGRALRSNSNTAVYGVGATLHRDRMAPHGCLTPSNPNPSVSVTGFRYLSASAAATSLAQDAQTKAFKPKELVLFQYQACPFCNKVAAFLDYYDIPFKVVEVNPINKKEIKWSDYKKVPILTVDGEQIVDSSDIIDKLIKRIHPDYDLNAEEEKKWRQWVDNHLVHVLSPNIYRNVPEALESFDYITTQGNFSFSERLVAKYGGAAAMYFVSKKLKKKHNITDERAALYGAAEQWVDALKGRKFLGGLDPNLADLAVFGVLRPIRHLKSGRDMLEHTRIGKWFSQMDRVVGQSSRVSEQS

SEQ ID NO: 178517 - protein, 368 aa, Glycine max
  Coding DNA Sequence Number=SeqID_86832
  Gene Ontology: Mol. function=hydrolase activity, acting on ester bonds; Cellular component=cellular_component; Biological process =lipid metabolic process
  Homolog annotation: Hit_ID=A7NSR6; Match level="QueryCoverage=94%, HitCoverage=93%, E-value=1e-121, Identity=61%"; Hit description =Chromosome chr18 scaffold_1, whole genome shotgun sequence
  Pfam annotation: Domain name=Lipase_GDSL; Domain location=36-359; Score=180.4; E_value=4.5e-51; Accession=PF00657.13; Description=GDSL- like LipaseAcylhydrolase
MELWNVVFVCCVLCYSFCHTAEAIVKLRGNETIPALILFGDSIVDTGSNNNLITGLKCNFPPYGRDFEGGIPTGRFSNGKVPADFVGIYASHSFVYEAEELGIKEYIAPYTSPALQPGDLLRGVNFASGGTGYDPLTAQLVSVIPLSEQLEQFKEYIGKLKGNFGEAKTNFILSKSLVLVVSSSNDIANTYFATGVRKLNYDVPNYTDMLVQQASSFVKELYGLGARRIGVFGAPPLGCLPFVRALFGGLRRLCSEEINMASKLFNSKLSSELHKLNQSLPQAKVVYIHIYDSLLNIIQNPTKYGFEVADKGCCGTGTVEAAFLCNMLDPTTCSDDSKYVFWDSYHPTQKTYQILVGEILNKYTSNFS

SEQ ID NO: 178518 - protein, 640 aa, Glycine max
  Coding DNA Sequence Number=SeqID_86833
  Gene Ontology: Mol. function=hydrogenobyrinic acid a,c-diamide synthase (glutamine-hydrolysing) activity; Biological process =cobalamin biosynthetic process
  Homolog annotation: Hit_ID=Q1GXH7; Match level="QueryCoverage=45%, HitCoverage=67%, E-value=5e-77, Identity=54%"; Hit description =Hydrogenobyrinic acid a,c-diamide synthase (Glutamine-hydrolysing) / cobyrinate a,c-diamide synthase
  Pfam annotation: Domain name=GATase_3; Domain location=167-304; Score= 58.0; E_value=3.1e-14; Accession=PF07685.5; Description=CobBCobQ-like glutamine amidotransfe
  Pfam annotation: Domain name=Nitroreductase; Domain location=310-469; Score=92.0; E_value=1.8e-24; Accession=PF00881.15; Description =Nitroreductase family
  Pfam module annotation: Pfam domain module=GATase_3::Nitroreductase; Domain location=167-304::310-469
IAERFGIPVALVINAKAMAQTFAAIAYGLYAFRPALKRAGVIANQVGSDGHAKMIKEALPADIPWLGAMKFDAQLSLPERHLGLHLAQEITDIDQRIEAAAQLLGPDIPLPPAVQFSAPEQPAITPLLQGKTIAVAKDAAFCFTYQANLDLLTTLGANITFFSPLHDAQLPAADAYWLPGGYPELHLEQLQHNHSMRESLHATAVAGKPILAECGGMLALGERLNGQPVFGLLPGHSDIQPKLQGLGTQHATFATTDDNAASIGAHTFHYGKFETDLPVIAQGKGKYGMVFPAMSFAYPDADKAAIYKVIAERRDMRHFLPTPIAPELLQKLLQAAHHAPSVGLMQPWRFIRISDATLRQAIHALVDEERKHTAQAIGEYENTARMAEFMRLKVEGILDCGELLVATLCDQREKYIFGRRTLPEMDLASVSCAIQNLWLAARAEGIGMGWVSLRHFVPGLCEYVLQIAHAGRRGLGDGKATQRDADGKRLAATRKHTGVKRWPQRIVCLTTETVEVLYLLGEQDRIVGISGFTTRPAIARKEKPKISAFTSANIEKILTLQPDLVLCFSNLQADIAASLIKAGCQVHVFNQRSLDETLQMILTVGDLVGASDKAEKLVGTYQAQLTAARQQAAAWSRKPK

SEQ ID NO: 178519 - protein, 233 aa, Glycine max
  Coding DNA Sequence Number=SeqID_86834
  Gene Ontology: Mol. function=motor activity; Cellular component=cell projection
  Homolog annotation: Hit_ID=UPI00016621D1; Match level="QueryCoverage =98%, HitCoverage=40%, E-value=8e-20, Identity=35%"; Hit description =UPI00016621D1 related cluster
GLDVLAFRGLDVLAFRGLDVLGFRGLHVLAFRGLHALAFRRPHTLAFRGLHTLTIRGLHVLTFIGLHALTFRGLHVLTFRGLHVLTFRGLHVLAFRGQHVLAFAFVGLHALTFKGLHVLAIRGLHALTFKGLHILQFRGLHVLAFRWLHVLAFRGLHSLAFRGLHVLVFRGLHVLIFRGLHVLIFRGLHVLAFKGLHVPTFRGLHVFAFRGLRALAFSGIHIRTLREFKVLYP

SEQ ID NO: 178520 - protein, 56 aa, Glycine max
  Coding DNA Sequence Number=SeqID_86835
GDQSGSRCFGENAQIMRDRHRLKGALKLSVFTPKAYTPKSLLGSLPPDSGPTQKTF

SEQ ID NO: 178521 - protein, 299 aa, Glycine max
  Coding DNA Sequence Number=SeqID_86836
  Pfam annotation: Domain name=Transposase_23; Domain location=135-205; Score=4.0; E_value=0.00043; Accession=PF03017.5; Description =TNP1ENSPM transposase
MVRTKKTEEMTTEATKEIAEKIDSFEEQATQGSFVPHGHQDVLTVAIGRPEHPGRVHAAGAGVTIKQYFGSAPRMSRSSSSLPPEELQQLTQQIRDQLEESITERVTRQVMASFSQIQSQMQSQGLAPSGNDPEIGDSDRCGLYIEADPARLVAMGRVYEGSTVVHNTPLLPGQVKVNVEEVTDADAPVPVPTDEVSLVEQTLHTFLAWPTHLVKSLSQQLAVSLTKPPPKPDPEVDDPLYLMTLTIPKLFLRPYQVRWDATVFGVFNPDFPLYIKHEDLSEIAHGGQCLSISVLQLWI

SEQ ID NO: 178522 - protein, 126 aa, Glycine max
  Coding DNA Sequence Number=SeqID_86837
  Gene Ontology: Mol. function=transferase activity, transferring glycosyl groups; Biological process=metabolic process
  Homolog annotation: Hit_ID=A4F1R6; Match level="QueryCoverage=84%, HitCoverage=21%, E-value=4e-28, Identity=62%"; Hit description =Putative glycosyltransferase
MTNANCPQESLHLVSNGNLRLWKSIHYCFKSEGPCYCEGEDGTFSAGITVMSAEQLLEFAWGLANNKKPFLWIIRPDLVIGGSVIFSSEFVNETKDKSLIASWCPQEQVLNHPWWILDLLWMELNH

SEQ ID NO: 178523 - protein, 223 aa, Glycine max
  Coding DNA Sequence Number=SeqID_86838
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=A8GD86; Match level="QueryCoverage=62%, HitCoverage=13%, E-value=1e-63, Identity=80%"; Hit description =Glycoside hydrolase family 2 TIM barrel
  Pfam annotation: Domain name=Glyco_hydro_2_N; Domain location=121 -223; Score=46.9; E_value=7.1e-11; Accession=PF02837.9; Description =Glycosyl hydrolases family 2, sugar binding domain
AGHLPRRFQQPVGLPVRESDVAEPEWLSAGAAGGDRFDRDRRAARAARTRHSGAEADRADQRQRHSHRPLYFPRLVHGVGRRDVNNWENIEKQSEHRLAPRASFFSYADAGQALSFDRNASRRFQLLSGRWRFRFFEHPAQVPAAFYREPMNDWGDMAVPGMWQLEGHGHLQYTDEGFPFPIDVPYVPTNNPTGAYQRHFTLDAGWQDQQVLIKFDGVETYFE

SEQ ID NO: 178524 - protein, 97 aa, Glycine max
  Coding DNA Sequence Number=SeqID_86839
  Gene Ontology: Mol. function=electron carrier activity; Cellular component=integral to thylakoid membrane; Biological process =electron transport
  Homolog annotation: Hit_ID=P49161; Match level="QueryCoverage=58%, HitCoverage=17%, E-value=7e-20, Identity=91%"; Hit description =Apocytochrome f precursor
  Pfam annotation: Domain name=Apocytochr_F_C; Domain location=1-70; Score=10.6; E_value=7.5e-10; Accession=PF01333.10; Description =Apocytochrome F, C-terminal
MVKKIIRKEKGGYEITIVDALDGREVIDIIPPGPELLVSEGESSNCDVQHLTSNPNVGGFGSGGCGNRSFECGAVLILPEGFELAPPDRISLRLRRR

SEQ ID NO: 178525 - protein, 258 aa, Glycine max
  Coding DNA Sequence Number=SeqID_86840
  Gene Ontology: Mol. function=motor activity; Cellular component=cell projection
  Homolog annotation: Hit_ID=UPI00016621D1; Match level="QueryCoverage =99%, HitCoverage=40%, E-value=3e-19, Identity=31%"; Hit description =UPI00016621D1 related cluster
PTALRGLHALAFRGLHVLAFKGLHVLALRGFHVLALRGLHVLAFRGLHVLDFRGLHVLAFRGLHALTFRGLHTLTFRGLHVLALRGLHVIAFRGLHALTFRGLHAFPFRGLHALPFKGLHALTFRGLHVLAFRGLHVLAFRGLGLHVFTFRGLHILAFRGLYILTFRGLHALAFRGLHTLAFIGIDALTFKGLHVLAFRGLHALAFKRLHILTFRGLHVLAFRGLHAFAFRGLHVLTFRGLHALTFRGLHALAFSGIL

SEQ ID NO: 178526 - protein, 174 aa, Glycine max
  Coding DNA Sequence Number=SeqID_86841
VDSRGSHIIMSEGTIVDDWKFDYSSHDACRMVYNDQAEMTGRLLAGSLTFDNRIMHYIIIDWAHLVRYRMHKALRANAPLPYPHLITLFLRHFQIPLDDEPFVQVKRSFAIGAGAVTSFGYRKDRNGQWLKKDALPPQDEREMLAAQLAQASQVASSRSNNLLEESSGGPKWAW

SEQ ID NO: 178527 - protein, 466 aa, Glycine max
  Coding DNA Sequence Number=SeqID_86842
  Gene Ontology: Mol. function=binding
  Homolog annotation: Hit_ID=A5FJM6; Match level="QueryCoverage=100%, HitCoverage=69%, E-value=0.0, Identity=76%"; Hit description =Putative uncharacterized protein
MDNQIHIENYKIQKPESWAGSVDDQQLIEKIRESDFSNKQINEGRDYCYFLDKIYYTSNAESNEYVCMAYTLNEPSNLERASVIDVVVEENEVYHIHRISVLREGVLIDKIPDTKIKVLDSENQSSGGILSSNKKINITIKDLRLYDILILEDSRVKAFTDRDFLRKEFSKYVWVSPDNYWAYGSYQFTFVNEREEPVAYKKVFFRDEQGNVLKPETHHLKKGERFVIREENYINPVDASREIFPFIDFATESNWKDLSNYIAPIYEEIYNKSSLKDFAPKLVEKLDAISNQDEKLQFAIEYVQNNIYYIFNADEMNGHKPQEPSVTYENKQGDCKAKCVLLKVVLDYIGVDSSVVLVNYHTDYYIKYYLPSLLSFNHVVVKINYKGEEYFIDATIRDEFGMIENRGFIYFMHYLEVKRDQELQQRKPFRYPYYCIDEKVEFNAENKTGKLKLTTVYKGNRANAMR

SEQ ID NO: 178528 - protein, 121 aa, Glycine max
  Coding DNA Sequence Number=SeqID_86843
MARAGDNGGVYHQLDESHRLFLDAWTTQMQRLLNRNKEEPYRRIAKSSSFTLKPLSPREVCDDQIRMREKREQEKENSEAPQRNMKKTSDTPEEKSDTQERENLKMSFPRRFLMDCHLQEA

SEQ ID NO: 178529 - protein, 137 aa, Glycine max
  Coding DNA Sequence Number=SeqID_86844
MSCPMIITPTSLCRSVSWCMPPTRHPLDPDKSIRALGFPALITGLCQSFGFPVTPSKGVVHIHECLYQLSLSQQSQGFAPFACPTPDQFRAGVAWPGDWPEAQAGEALVEAPGDAEEARMDEEMTDLLGFLGGNGAI

SEQ ID NO: 178530 - protein, 79 aa, Glycine max
  Coding DNA Sequence Number=SeqID_86845
MTPKQVTYNIIILQPMPVNILVLIKQHHKLLPFSVTPSYGRTVSLYYPLLSQAINKNEALPQTPVLVSDLIIMATNPMS

SEQ ID NO: 178531 - protein, 147 aa, Glycine max
  Coding DNA Sequence Number=SeqID_86846
  Homolog annotation: Hit_ID=Q6UUU1; Match level="QueryCoverage=40%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPGNYRLESNPERHAKAPLAAAT

SEQ ID NO: 178532 - protein, 149 aa, Glycine max
  Coding DNA Sequence Number=SeqID_86847
MAPKKLSMKRSRRDAAAEGPSAIPEFDSHRFRSAEHQQRFEAIKGWSFHRERRVQLREDEYTDLQEEMGRRCWTSLVTPMAKFDLEIVLEFYANAWPTEEGLRDMCSWVRGQWIPFDADALNQFLGDPLDLEEGFRPDCRREAGADHAY

SEQ ID NO: 178533 - protein, 334 aa, Glycine max
  Coding DNA Sequence Number=SeqID_86848
EIAPKKLSAKRSRRDAAAEGTSAAPEFDSHRFRSAEHQQRFEAIKGRSFHKERRVQLRDDEYTDFQEEIARRHWTSLVTPMAKFDPDIVLEFYANAWPTEEGVRDMRCPQPFLGDPLVLEEGQECKFSQRRNRADGFDEEAIAQLLCTPGQDSPGPLQGGGHPLDPDKSNRALGFLALITGLCQSFGVPVTPSKVIRLSITRAFIEKYCTPRQAQGDAPQAADAPPPPHQADPAGSLGMEWYLQHLVRQQAANHRGQVQIHECLYQLNLSQQGQGFTPFACPTPDQFMVEVAWPGDWPKAQAGEAPTGAPGDAEEARMDKEMMNLLGFLGGSGA

SEQ ID NO: 178534 - protein, 214 aa, Glycine max
  Coding DNA Sequence Number=SeqID_86849
  Subcellular localization annotation: CTP_CleavageSite=74; ConfidenceScore=5.42e-01
MAEPSKKRKGTSSRSQRHSGSQETPIPSSIPSGSLFSSKEQRIQYTNLFSSRSIINPKFIDMDFFSNESFECFQAFENSNLIPFMSLKLPIYSDLVKVFYSNLEIQEGTLMSEVYGIKMVIDQSLFYDLTQLPSEGVPFEGALIDDWKFEFSVHDVRRLVCTNQENMTGRLLSGSLAFESRILHFLIVHILLPRSSNLAQVSEEDLIVMWAFHK

SEQ ID NO: 178535 - protein, 191 aa, Glycine max
  Coding DNA Sequence Number=SeqID_86850
MTQELVARGDTLRLSAPRHSVTPSVIDEQRPIWSSAPFPEMSSISDGDFSSLTSYPELRRSEFLIGGYVGARASLLSTIPPFVAMTQELVARGDTRPIWSSAPFPERHHFPMIRGDFSVSSYPELRSLVPFSFQRRRPDDKQRPSLVILHRLVSSRGGGPDDTRRYPSGYPYKHSFAICKTRTLDSMQRLT

SEQ ID NO: 178536 - protein, 136 aa, Glycine max
  Coding DNA Sequence Number=SeqID_86851
  Homolog annotation: Hit_ID=A5BZH4; Match level="QueryCoverage=74%, HitCoverage=16%, E-value=1e-09, Identity=39%"; Hit description =Putative uncharacterized protein
  Pfam annotation: Domain name=zf-CCHC; Domain location=93-110; Score =20.1; E_value=0.0014; Accession=PF00098.14; Description=Zinc knuckle
MELTSSGVARVILFVATPLFTVHNIRDAILPRKVEQQLKRKSTSKFYGSHSYPKKDQGQGILGVTPSKPKDDKGKTIEKQLLKASMQEKTSSMECFKCLGRGHITSQCPTKKTMIMRGQDIYSNQDDVTTSPSSSE

SEQ ID NO: 178537 - protein, 72 aa, Glycine max
  Coding DNA Sequence Number=SeqID_86852
  Subcellular localization annotation: CTP_CleavageSite=19; ConfidenceScore=5.35e-01
MGASSKKGKCAELPPTFIRGKRRNNRKDRRTMKNERRTMKNGEESSRNRSLKRLRSVTEALRLRENPKYQKG

SEQ ID NO: 178538 - protein, 75 aa, Glycine max
  Coding DNA Sequence Number=SeqID_86853
MSSILCFVGLQGPLFVFGTGCSARPRGRSGLMIDCQIRKQKPQGKWQNGYFLELSRPKLTQANIWLTWAMGKLQP

SEQ ID NO: 178539 - protein, 65 aa, Glycine max
  Coding DNA Sequence Number=SeqID_86854
MKLFGGPSELEASLGELRSRKTKEKTLLPPFFEGGRIIVTGTSFPAGDATEGCTLPRRREELGSL

SEQ ID NO: 178540 - protein, 175 aa, Glycine max
  Coding DNA Sequence Number=SeqID_86855
DFQLVPTVKEFEEILGCPLGGRKPYLFSGFYPSTTRVAKEREKAWQIKANGLSFIDILALLIFGVVLFPNMEGLVDLAAIDAFLAFHHGKESPVVAILAMILSSCEGCPMRGVPSDESIMPFIARGFSDHNARVLQGVRKAWDAAAAIVSSSSEEVKGIITGQRHDLEGRAKGLP

SEQ ID NO: 178541 - protein, 343 aa, Glycine max
  Coding DNA Sequence Number=SeqID_86856
  Gene Ontology: Mol. function=hydrolase activity
  Homolog annotation: Hit_ID=A8AH86; Match level="QueryCoverage=73%, HitCoverage=89%, E-value=2e-96, Identity=69%"; Hit description =Putative uncharacterized protein
  Pfam annotation: Domain name=Lactamase_B; Domain location=36-218; Score=55.2; E_value=2.3e-13; Accession=PF00753.18; Description =Metallo-beta-lactamase superfamily
MKMKSLALLVTLAAAPAFAAPLQLDVYNPQEQGIFPVSSTLVSGPHEAILFDAQFSPKDGEKLVELIKARGKQLTHIVITSGDPDFYFGLEPLVQAFPQAKIVASPLVVEHIEATKDAKLQYWGPQMNGAAPHQLYAPQITHQTRFSVDGERIELRHAAEKSAYVWIPSSKAILGGTVVDSGIHVWTADTQTAASRAEWRQVLREMQQLKPQVVIPGHYLGARPAGDKAVTFTLDYLQSFERALQQHKGSAAVIQAMKQAWPTLADVSSLELSAKMGFQLFRRLANRGADRRHLAQRIEQAVVMNQTVIARHGDIHTGGIQFATKGFTLITQHIQFCRLNQRW

SEQ ID NO: 178542 - protein, 92 aa, Glycine max
  Coding DNA Sequence Number=SeqID_86857
MEEAEKEILETFRKVEVNIPLLDVIKQIPRYAKCRNLTFGGRATRESRVRLPRKENAWSHHQLLFEENVRKTEQEIRPTCLLTAIAVSLAVP

SEQ ID NO: 178543 - protein, 106 aa, Glycine max
  Coding DNA Sequence Number=SeqID_86858
MVRYAPSSFVDLVFIDERIEVGLKRGKFNHPAWMNEKIGVNEEGENEGETHATIVVPTWKLPTSQTMSLLSQYQPFSLPTTQSFTKAIPKSTTKPVYHTSNHEHHL

SEQ ID NO: 178544 - protein, 76 aa, Glycine max
  Coding DNA Sequence Number=SeqID_86859
MRSLLDRFKGKEGRANSFNPPGIWDSLKISEKNCFREENPSRGASVTLSRHIRGRFREGFPPFFIVLHSFFIVLRS

SEQ ID NO: 178545 - protein, 59 aa, Glycine max
  Coding DNA Sequence Number=SeqID_86860
PVSIELEALICGFTFDLNCTIRKNDQADVLMMPKDHMRLKALFKTKKLKIFKMDDQDSF

SEQ ID NO: 178546 - protein, 41 aa, Glycine max
  Coding DNA Sequence Number=SeqID_86861
MAFVDNWVVGKEEEWQSQHGFLPLSHPLHLPQFSQSSKQDD

SEQ ID NO: 178547 - protein, 153 aa, Glycine max
  Coding DNA Sequence Number=SeqID_86862
MAFQRRGDRGRHGCRIGTRLAGVHEDHRNLDVRQCRHAQAQVADQADHEQADGQQRGADRAADEGAGQVHHHRRGVQGHQLRQQQAADDGDAQRAAQLRADAGAQRQRQRAEHCRGGGHHDRTEAQQAGPADRFMRIGTGAARLDREVHHHDR

SEQ ID NO: 178548 - protein, 104 aa, Glycine max
  Coding DNA Sequence Number=SeqID_86863
MTTSHRIWSLAFVVKTIKVPLSSRDKKVRWHARTMMFLLLSGDNQVQWHADTNIVIYFPCRKTQCLSTKATRVSPAILRQASPVAYGDHHGYPFLSILRHQGFC

SEQ ID NO: 178549 - protein, 93 aa, Glycine max
  Coding DNA Sequence Number=SeqID_86864
  Gene Ontology: Mol. function=protein serine/threonine kinase activity; Cellular component=cytoplasm; Biological process=protein amino acid phosphorylation
  Homolog annotation: Hit_ID=Q9M6N2; Match level="QueryCoverage=100%, HitCoverage=28%, E-value=6e-42, Identity=84%"; Hit description =Abscisic acid-activated protein kinase
SSVLHSQPKSTVGTPAYIAPEVLLKQEYDGKLADVWSCGVTLYVMLVGAYPFEDPNEPKDFRKTIQYSIPDGVQISPECGHLISRIFVFDPAE

SEQ ID NO: 178550 - protein, 141 aa, Glycine max
  Coding DNA Sequence Number=SeqID_86865
  Gene Ontology: Biological process=transposition, DNA-mediated
  Homolog annotation: Hit_ID=Q1J7G7; Match level="QueryCoverage=29%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPAGKLAGGGTPRHLRNKHN

SEQ ID NO: 178551 - protein, 122 aa, Glycine max
  Coding DNA Sequence Number=SeqID_86866
MGEVEEAQEQMKADTEALKEKMTTMMEAIMSIKEIMEVSAAYQTRARARVMSEVEEVQEKMKADMEAMKEKMATMVEAMMSMKKIMEANTIVVAATSAVVKCLCLYVLGRSRNSGGKIYGIG

SEQ ID NO: 178552 - protein, 159 aa, Glycine max
  Coding DNA Sequence Number=SeqID_86867
  Subcellular localization annotation: CTP_CleavageSite=68; ConfidenceScore=5.59e-01
AFPPGGSLVRSPVPAFRFTGVIPLLWPRLSHSTPDTQFRVGSSLQAGLYARTPRSVRPLRLIRHAPVKAKLKGQVLVTALPPSQLPRFKELGAQRTFEKPPCKAETAGNRRGIHSRAMKTFQFAHGKRCNKGEHYPISPAHRLSLPYEIPDEHSSGGQE

SEQ ID NO: 178553 - protein, 118 aa, Glycine max
  Coding DNA Sequence Number=SeqID_86868
  Pfam annotation: Domain name=G-patch; Domain location=15-59; Score =13.8; E_value=0.0041; Accession=PF01585.14; Description=G-patch domain
MPRRSSLATLPADMTMMMAREMLGNGYEPGMGLGKNNGGRTSLISTRGNRGKFGSFISVRLRHEGQVVAICEDDFPNGSDLVIIPGNRSSISSKKRIRRRVKRTKMWDFPGVGEDSRP

SEQ ID NO: 178554 - protein, 59 aa, Glycine max
  Coding DNA Sequence Number=SeqID_86869
MNWVRWKQIYSTDVSNAFGEVVEVIGLAPNDEPDRGFDVEGAEEGRVEGVGGGDGMPPI

SEQ ID NO: 178555 - protein, 155 aa, Glycine max
  Coding DNA Sequence Number=SeqID_86870
  Homolog annotation: Hit_ID=A5BKB8; Match level="QueryCoverage=62%, HitCoverage=23%, E-value=4e-30, Identity=72%"; Hit description =Putative uncharacterized protein
MGGGAWPFLVGGAICLVNSVNERDLSLLNSYVEVTLHGQLLRGTMARLGHGKFEAITGIPSKRESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 178556 - protein, 70 aa, Glycine max
  Coding DNA Sequence Number=SeqID_86871
MEGTSYVVQVEGTSTWVFKENKGGYIPCGSLACNGFHKVERNLKNQLVAWGLDKVFAFNDGNFKDGVEPK

SEQ ID NO: 178557 - protein, 148 aa, Glycine max
  Coding DNA Sequence Number=SeqID_86872
MERKVLADGWDATDGTGTKRGEAGAGTAGSSGSMAEAGTGGANAKPAVGATSTAGVGGSTGGSKTVPACVSTTHAAGGGYASMGSGLFLSIFLPHEALDPEGQKHDHEDTSGGASSGSDAAGSETGSGGVSWVLVMKDRNLSKGGIST

SEQ ID NO: 178558 - protein, 198 aa, Glycine max
  Coding DNA Sequence Number=SeqID_86873
  Subcellular localization annotation: CTP_CleavageSite=72; ConfidenceScore=5.80e-01
MSTPPPMLPPSPMPTPSPMPTPSPMPPPPSMLPPLPMLTAPSCPAPVQPFLPPLSGPLHITVLHLPNLGLVRTTISFNKLFSIVPLYGTAMAAYKLQLVAFALCTIAKPGAISRNRPWDPGLISLIPLEALIPRKPDILGTKHLTFDSNSGVQSKVNQQEAHIVRSKPKRNNNTLAYLKDFAEYAFESSFPAPESAVP

SEQ ID NO: 178559 - protein, 144 aa, Glycine max
  Coding DNA Sequence Number=SeqID_86874
  Gene Ontology: Mol. function=protein dimerization activity; Biological process=DNA integration
  Homolog annotation: Hit_ID=A3BRV8; Match level="QueryCoverage=91%, HitCoverage=18%, E-value=6e-15, Identity=38%"; Hit description =Putative uncharacterized protein
  Pfam annotation: Domain name=zf-C2HC_plant; Domain location=18-76; Score=5.0; E_value=0.011; Accession=PF07567.3; Description=Protein of unknown function, DUF1544
MSASSTSQAKEQDDDTKPLWTYVTKIKSVVGGGNYEIKCNICDFTFNGSYTRVRAHLLKMTGKGVRVCQKVTVAKLIDLKKIDNEATLRVERSKTKYVSLPPVSTQHQMDTNTLGVDPKTRKTSSVENAFNLQARETLDHEIAR

SEQ ID NO: 178560 - protein, 105 aa, Glycine max
  Coding DNA Sequence Number=SeqID_86875
MEALVGRRRRRHRTAEEVSSCSTASGDGGGDGHRVAPESYAHACLEATFSELAHDAEAVLVDPNITSAVHGVGARRGAVGGGVDVVLVVVDDFFDCWYRVEKNAA

SEQ ID NO: 178561 - protein, 88 aa, Glycine max
  Coding DNA Sequence Number=SeqID_86876
  Gene Ontology: Mol. function=transition metal ion binding; Cellular component=chloroplast; Biological process=cellular iron ion homeostasis
  Homolog annotation: Hit_ID=Q94IC4; Match level="QueryCoverage=70%, HitCoverage=25%, E-value=1e-23, Identity=89%"; Hit description =Ferritin-2, chloroplast precursor
MELALSLEKLTNEKLLHVADRNNDPQLADFIESEFLYEQVKSIKKIAEYVTQLRLVGKGHGMQISSSSSQKVCGTLIKGFFMMKIYNL

SEQ ID NO: 178562 - protein, 261 aa, Glycine max
  Coding DNA Sequence Number=SeqID_86877
MAQVVLKSPTINEYIVKEDDDEPTEVGKEAMSEGLSRYGSKHSHPVSVLNDEAEAGYGDRSKISVPLELDEGLEPLNTDDHIGTTNGQYVEDYLLFICNEEKHVRGTLMPAMEPLIAAKEKKGALLTATREWRTIDHDPGSICQEASPPEVGLTSKHRWDRHTRTVRNASIELGGKLAKNGVVLEELVDLKDPTKGICAIKTDGVAVEDEGEGKEASGGASLWIYSPSFRVMVCKVSLNDNWWVLSLAMASSKLSKETFDL

SEQ ID NO: 178563 - protein, 225 aa, Glycine max
  Coding DNA Sequence Number=SeqID_86878
  Gene Ontology: Mol. function=protein binding; Biological process =protein amino acid phosphorylation
  Homolog annotation: Hit_ID=A5ATA1; Match level="QueryCoverage=60%, HitCoverage=15%, E-value=2e-33, Identity=55%"; Hit description =Putative uncharacterized protein
  Pfam annotation: Domain name=LRR_1; Domain location=1-24; Score=7.5; E_value=13; Accession=PF00560.24; Description=Leucine Rich Repeat
  Pfam annotation: Domain name=LRR_1; Domain location=100-122; Score =7.9; E_value=10; Accession=PF00560.24; Description=Leucine Rich Repeat
  Pfam annotation: Domain name=LRR_1; Domain location=124-147; Score =10.2; E_value=3.9; Accession=PF00560.24; Description=Leucine Rich Repeat
  Pfam annotation: Domain name=LRR_1; Domain location=75-98; Score=2.6; E_value=1e+02; Accession=PF00560.24; Description=Leucine Rich Repeat
  Pfam module annotation: Pfam domain module=LRR_1::LRR_1::LRR_1::LRR _1; Domain location=1-24::100-122::124-147::75-98
MLQIVDIAFNNFSGKLPGKFFGTWKRNVTHNKDEAGPNFIEKKYLLYTNVYYQDSASVTVINKGQEMELVKILTIFTSIDLSSSNHFEGPIPDDLMDLKILHIFNLSNNDLSGEIPSSINNLKQLESLDLSQNSLSVNLKLKSFEKWNAPEENCREGRRGRLKFFSEKENQETQQPHPREEPSLCRRGVAREGRRGPSISFVVVVLSEHKPVEAARHRVEKTMKW

SEQ ID NO: 178564 - protein, 95 aa, Glycine max
  Coding DNA Sequence Number=SeqID_86879
PYGLHNHPFFAFRNVTKLYGLRTNTSFEFLACHGTSRVVLQCFSFGFLHVSELHKLPNDGCQIPRSGQNEGRIPTTDGPRMKLGYDKYQQIQSNW

SEQ ID NO: 178565 - protein, 163 aa, Glycine max
  Coding DNA Sequence Number=SeqID_86880
MWAFHTGRQIDWAHLVRYRMHKALRLNAPLPYPHLVTLFLQHFNIPLNYEPYVPIKRSFLIGAAVIASFGYRKERDDSWVKKGAQPNDDEGHLPVGEDSSLLQSILDRFDGLQTYVGERFDALEQQVDMQFDEMDSRITKVEGDVTFIRTCFDLPPPPTAASS

SEQ ID NO: 178566 - protein, 183 aa, Glycine max
  Coding DNA Sequence Number=SeqID_86881
  Gene Ontology: Mol. function=RNA-directed DNA polymerase activity; Biological process=RNA-dependent DNA replication
  Homolog annotation: Hit_ID=Q5NRP4; Match level="QueryCoverage=55%, HitCoverage=6%, E-value=6e-09, Identity=34%"; Hit description =Putative gag-pol polyprotein, identical
  Pfam annotation: Domain name=zf-CCHC; Domain location=149-166; Score =18.6; E_value=0.0024; Accession=PF00098.14; Description=Zinc knuckle
MSHHSSSVNGEGTSHKDPLSRILDELSSLKLWKEKLEKRKRKRDGRHRSHLRPHSHRREKEIKPQEANINLPYFHGKDNVEAYLDWEIRVEQQLKRKSTSKSYDSHSYPKKDHGQGILRVAPSKPKDDKGKTIEKQPPKASMQDNTGSIKCFKCLGRGHITTRCPTKKTMIMRGQGIYSSQDE

SEQ ID NO: 178567 - protein, 163 aa, Glycine max
  Coding DNA Sequence Number=SeqID_86882
  Homolog annotation: Hit_ID=Q6UUU1; Match level="QueryCoverage=42%, HitCoverage=47%, E-value=9e-26, Identity=82%"; Hit description =Putative uncharacterized protein
MAYERGGDFLEDARKILNREVRGPRQSRFSIGSAPLTSITKSDAQISGGETRQDYKDTRRFPLAAPSCALLFLPFGFTGCHSAVMAAFVSFHGPDTQFRVGSSLQAGLYARTPRSVRPLRLIRELSSWSPNPGKTCKSTTGQQQLVFDLEELVLKSCARFRLY

SEQ ID NO: 178568 - protein, 101 aa, Glycine max
  Coding DNA Sequence Number=SeqID_86883
  Subcellular localization annotation: CTP_CleavageSite=63; ConfidenceScore=5.69e-01
LSLLSATDGVVRNGKSTAGHQPLASVAVTLRVTTTPAALNAPLQGASHSPFRLRNCWEGRSVRASSLLRQLAKGGCAARRLSWVTPGFSQSRRCKTTASEL

SEQ ID NO: 178569 - protein, 109 aa, Glycine max
  Coding DNA Sequence Number=SeqID_86884
DVRKKAQAIQKQNTAPHILSRGGYDYLEQKLLVEKMKKKLEEAAQLGTVDGIIDPPSPDSFEEQAIKGSFVPHGRQDVLAAAIGCPEHPGRVRAAGVGVTIKQYFGSAP

SEQ ID NO: 178570 - protein, 99 aa, Glycine max
  Coding DNA Sequence Number=SeqID_86885
MENNDGFWWLMVVVGDGESAWNIRNGFGRKKEEEMTFFLSYTKAKAEIVAKCLVKLQTKFREDPTVKEGWVVFLPRQLHVASSRSFIKRLLQEASPWLL

SEQ ID NO: 178571 - protein, 66 aa, Glycine max
  Coding DNA Sequence Number=SeqID_86886
MEDCLEGPHLGNHVTQLQTRKWRTHERKRNSWALKKGRMEDFLEVPLLGNHETQLQTRKWRTHEQP

SEQ ID NO: 178572 - protein, 91 aa, Glycine max
  Coding DNA Sequence Number=SeqID_86887
  Subcellular localization annotation: CTP_CleavageSite=15; ConfidenceScore=5.17e-01
MVATPRVFLSWNTHPASHASPSRRRVSDLLDYSEPSSRVFLFENILLLVVPTAAVCSSKGMIPLETIKRDMTTLGVITKSLVSSLPYRSLK

SEQ ID NO: 178573 - protein, 64 aa, Glycine max
  Coding DNA Sequence Number=SeqID_86888
  Subcellular localization annotation: CTP_CleavageSite=20; ConfidenceScore=5.38e-01
MRVSSSTVSDPSFLGDPTVPPSEGKDGNSHPRSRFMVSSDFGSRLVERLDMMYVRVLVWPTFQG

SEQ ID NO: 178574 - protein, 156 aa, Glycine max
  Coding DNA Sequence Number=SeqID_86889
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
  Subcellular localization annotation: CTP_CleavageSite=28; ConfidenceScore=5.34e-01
MTMITPSSKLTLTKGNKSWYRAPPRAARCTRDRDRAGSRCAAWCQPSNSCSPGDPLVLERPPPRWSSNSPYSESYYNSLAVVLQRRDWENPGVTQLNRLAAHPPFASWRNSEEARTDRPSQQLRSLNGEWDAPCSGALRGGGCGGYAQRDRYTCQR

SEQ ID NO: 178575 - protein, 209 aa, Glycine max
  Coding DNA Sequence Number=SeqID_86890
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=42%, HitCoverage=75%, E-value=3e-24, Identity=67%"; Hit description=LacZ protein
MDTICSCPAFNAGRSIWLPGWLNAVNENSNSLFLTIGPGDFLVHHAIALGLHTTTLILVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRAVLLPLRTTPSVAEQEGQLIETEATGAPQKHHHTLNQ

SEQ ID NO: 178576 - protein, 127 aa, Glycine max
  Coding DNA Sequence Number=SeqID_86891
GWHKKSVEPREYLPMLRWHDLAGGEWAPGGTDKGPQPELETPGHCWTSPGPLGVLWAGRSALWSPGGMLLSSNVIYICVRVVMLVRMIHTRLFAAAQVKSCPGMHSSYAIASSSGCARTIGTPQGSE

SEQ ID NO: 178577 - protein, 120 aa, Glycine max
  Coding DNA Sequence Number=SeqID_86892
CQRLHRLVLLHFASIHDTGPAIRSSGRWSCYVAQSCHSGSRHRYPSDHGANSTVDICKVRCGRAETCNEACHAIAERLESHLNLGVVTPDTSTHELIAKSVTQDQLVYVRSRCKRHTDQS

SEQ ID NO: 178578 - protein, 89 aa, Glycine max
  Coding DNA Sequence Number=SeqID_86893
MEVYNYESDENISQERKTRRKNMILIFEDLDTLILKKNHRRRGKALQVGVSGILGHRKPQFLPPFPLDHCSHQRNSVYGTETSFPLVPL

SEQ ID NO: 178579 - protein, 100 aa, Glycine max
  Coding DNA Sequence Number=SeqID_86894
  Homolog annotation: Hit_ID=A5C1F2; Match level="QueryCoverage=54%, HitCoverage=8%, E-value=6e-10, Identity=53%"; Hit description =Putative uncharacterized protein
MKIMSFVAGNRLQTYGNRLHVENSNSKPFSTAISQPCLLVIDYTSWFTRAWILRFIGGVLFVNKSSSRVSLRYLQFLRDFEQCSTYAWGPAVLVYLYREI

SEQ ID NO: 178580 - protein, 83 aa, Glycine max
  Coding DNA Sequence Number=SeqID_86895
  Pfam annotation: Domain name=zf-CCHC; Domain location=20-37; Score =29.3; E_value=1.4e-05; Accession=PF00098.14; Description=Zinc knuckle
MERSHNFNNGKRSQEVSPTLKCYKCDQLGHIKANCPSNESWPEKNEKKSYKERRSKKAYIAWDDNDSSDSSEKEINLLYKDYE

SEQ ID NO: 178581 - protein, 99 aa, Glycine max
  Coding DNA Sequence Number=SeqID_86896
MRGYLMVTRTFCHPGANEPIDARRLISSSAPFVIQGQRVRWFYSRRPKTFKPNDARDSSLLARDDRVQWRREVSWLSNFVAFKTLKFVDASDAFSFLSE

SEQ ID NO: 178582 - protein, 99 aa, Glycine max
  Coding DNA Sequence Number=SeqID_86897
MGENTCHTHFRTSCNPMALYPKGEPSPKPLLTYSRRSTANQNQQTEPQGPPQDNSLAADPVEEPEPAPPRRSSRIIKPPDRYIHSMTASLSSIPIPFLL

SEQ ID NO: 178583 - protein, 140 aa, Glycine max
  Coding DNA Sequence Number=SeqID_86898
MEGEQDTQWGENGPRDSRWTSNSMGFGSSAACKQALVLSAQHALSTKTCIYAERAERAKQADEDEEEGEEGEVGGAWLAAKGGVGEGNEERGDRWKDNEGVKVGMAEEIGVGKDGEIKDECGGEEFFGNGEDEGVVVEKP

SEQ ID NO: 178584 - protein, 151 aa, Glycine max
  Coding DNA Sequence Number=SeqID_86899
MTFDVAPLTAAETRFARCFGIGVFEKDLEIMRGLGLRHQGGHFIRESGEENTIYKAVLSTPGLVSRILSCYRKKRSIWILEEIIAIKESFNLLFPIRIIVGKKFGDIGESDASKGFGWLMGVGNEGVVVGHGRQGWGTTSLIEEIGNGWIV

SEQ ID NO: 178585 - protein, 600 aa, Glycine max
  Coding DNA Sequence Number=SeqID_86900
  Gene Ontology: Mol. function=protein binding
  Homolog annotation: Hit_ID=A7NUC4; Match level="QueryCoverage=96%, HitCoverage=94%, E-value=1e-101, Identity=63%"; Hit description =Chromosome chr18 scaffold_1, whole genome shotgun sequence
  Pfam annotation: Domain name=QLQ; Domain location=154-190; Score =76.3; E_value=9.7e-20; Accession=PF08880.2; Description=QLQ
  Pfam annotation: Domain name=WRC; Domain location=224-269; Score =99.4; E_value=1.1e-26; Accession=PF08879.1; Description=WRC
  Pfam module annotation: Pfam domain module=QLQ::WRC; Domain location =154-190::224-269
MDLGVVGLEGVVGSESGCVFGSSLVSDPETKHKWYGSGLLKQERSAIATEDDEWRISKVAKTDHDMSSASKAMLFQQRNNSLLRSNNATLFSDGHHQSQMLSFSSPKSDSLLIDKASSNATLPFSSHQLSSYTRNTGYNSGSISMHGALASVRGPFTPSQWMELEHQALIYKYITANVPVPTHLLIPIRKALDSVGFCNFSAGLLRPNSLGWGGFHLGFSNNTDPEPGRCRRTDGKKWRCSRDAVVDQKYCERHMNRGRHRSRKPVEGQSGHALTTTTSNTPNASSNSVVPGNNNNTFAHNNVHHPIPPHSSPVNTITRMFTSNKENNNSTSERMQDPALPMLPPTLELKPKENNPFMIHKHQIPSDEYSSRNNNEFGLVTSDSLLNPSEKRSFTSSQKNDSSESQQQHSLRHFIDDSPKPQSNHHHRSSSIWPELDNMQSDRTQLSISIPISSSDHFMSFTTSLPSNEKLTLSPLRLSRELDPIQMGLGVGSAPNEANTRQANWIPITWESSMGGPLGEVLNLSNNNNSNASDQCGKNNNNTSALNLMKDGWDNNPPSGSSPTGVLQKSAFGSLSNSSAGSSPRGAENNKEGATLCNAL

SEQ ID NO: 178586 - protein, 29 aa, Glycine max
  Coding DNA Sequence Number=SeqID_86901
MGNIQHVTRKELKNQGRHENHPSISNMAR

SEQ ID NO: 178587 - protein, 78 aa, Glycine max
  Coding DNA Sequence Number=SeqID_86902
YRTFIVLLNGIIDVLFSCMQGRSTAEAVATPEEEPRSSEASSSFPIAGHSHIEPIEDPIMAEEPRRVTLEDYSSSTVP

SEQ ID NO: 178588 - protein, 81 aa, Glycine max
  Coding DNA Sequence Number=SeqID_86903
FYGVPVAPKKVIRPRTNRAFIKKYCAPRRAQGNTPQQPGDDRQQAINAPPPPLDPFSSSTKAGALPKTHGRPTGDQVQSQR

SEQ ID NO: 178589 - protein, 258 aa, Glycine max
  Coding DNA Sequence Number=SeqID_86904
  Homolog annotation: Hit_ID=Q6WAY6; Match level="QueryCoverage=99%, HitCoverage=41%, E-value=2e-10, Identity=24%"; Hit description =Putative uncharacterized protein
MGTRGCIDYNPILAIRQLGYLMRGAPLEEELALVISRGFNETNVETLRKVRKAWEVVQKKDKELRGSNNGPIGGYCEWLKAHVQGLDWLPSLRTAKREEVEAPEEDEDVQALRTELKQAQVVKERFKSAALKIRKENAELRDINIATTKALEQETKRARREEHGRNKFRGALWGSNSELKLRREERDQSRVDSLILKDELKVCSRSKRNLSQRLCETETHMLAIVSKYQEELNLATAHEHKVADEYARVCAEKEAKRK

SEQ ID NO: 178590 - protein, 127 aa, Glycine max
  Coding DNA Sequence Number=SeqID_86905
  Homolog annotation: Hit_ID=Q6UUU1; Match level="QueryCoverage=47%, HitCoverage=40%, E-value=1e-18, Identity=78%"; Hit description =Putative uncharacterized protein
MNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWP

SEQ ID NO: 178591 - protein, 222 aa, Glycine max
  Coding DNA Sequence Number=SeqID_86906
  Gene Ontology: Mol. function=motor activity; Cellular component=cell projection
  Homolog annotation: Hit_ID=UPI00016621D1; Match level="QueryCoverage =98%, HitCoverage=40%, E-value=8e-19, Identity=32%"; Hit description =UPI00016621D1 related cluster
ALESIAFRGLHVLAFRGLHVLAFRGLHALTFRGLHDLTFRGLHVLAFRGLHPLAFRGLHVLAFRGLHAFAFRGLHALAFKGLHILAFRRFHVLTFRGLHSLAFVGLHALTFRGLHALAFRGLHTLTFRGLHVLAFRGLHVLAFRGLHILAIRGLHALAFRGLHVLTFRALHILAIRGLHALAFRGLHVLTFRGLHVLTFKGLHALAFRALHPLAVKGLHVLT

SEQ ID NO: 178592 - protein, 86 aa, Glycine max
  Coding DNA Sequence Number=SeqID_86907
MVMRGQDIYSSQDEATTSPSSSESEKAKGEESSCHTLISSEDHCLMACNLCLTASRYLAPFVSQYVKFRDMPGIKRKHCYKIREFP

SEQ ID NO: 178593 - protein, 20 aa, Glycine max
  Coding DNA Sequence Number=SeqID_86908
MAPKTCSLLASAPDRTISIK

SEQ ID NO: 178594 - protein, 101 aa, Glycine max
  Coding DNA Sequence Number=SeqID_86909
  Subcellular localization annotation: CTP_CleavageSite=42; ConfidenceScore=5.03e-01
MGFSFILTLFICPSFLIRPSRMIKFASFQTRFDPFSGEANPQSFEVASYPEPYQNCTDDVSSIGACRPRIFFINGFLCFLEDEWQQNGEGRERGDATSRRR

SEQ ID NO: 178595 - protein, 235 aa, Glycine max
  Coding DNA Sequence Number=SeqID_86910
  Homolog annotation: Hit_ID=A5B939; Match level="QueryCoverage=22%, HitCoverage=33%, E-value=6e-15, Identity=76%"; Hit description =Putative uncharacterized protein
MSRRARRSLQNPGREPGRSGRRCRSWCLPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERALRGLFPGRRTVNSELCSECQSEEIQPSAGKRGSNYDSLKVAKCPRHLISDAHEWINEIPTVPVYYPAKHSQGNGLGGISGERKTLLSLTLVRLCEMT

SEQ ID NO: 178596 - protein, 144 aa, Glycine max
  Coding DNA Sequence Number=SeqID_86911
MTKKSMRAGNVDVYGFLEPQSIQRYGQLQFESESYIKNWMQKLKRDVYLGAYLNGAHWEMVVILPMENIVIWFCSLHNRPDNYLKGIINGALKGLDDTPQSKSKAGVRWIVVKYFNDARPLEPERLKAFRIQWTKYYFKVKNET

SEQ ID NO: 178597 - protein, 223 aa, Glycine max
  Coding DNA Sequence Number=SeqID_86912
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=100%, HitCoverage=19%, E-value=5e-82, Identity=71%"; Hit description =Functional candidate resistance protein KR1
  Pfam annotation: Domain name=MotA_activ; Domain location=111-205; Score=-4.1; E_value=0.026; Accession=PF09114.1; Description =Transcription factor MotA, activation
  Pfam annotation: Domain name=NB-ARC; Domain location=1-163; Score= -128.8; E_value=0.047; Accession=PF00931.13; Description=NB-ARC domain
  Pfam module annotation: Pfam domain module=MotA_activ::NB-ARC; Domain location=111-205::1-163
LQAIIGNPDWFGRGSRVIITTRDEHLLALHNVKITYKVKELNEKHALQLLTQKAFELEKEVDPSYHDILNRAVTYASGLPLALEVIGSNLFEKSIEEWESALNGYERIPDIKIYAILKVSYDALNEDEKSIFLDIACCFKDYELAEVQDILYAHYGRCMKYHIGVLVKKSLINIHRLHKVIRLHNLIEDMGKEIVRRESPTEPWKRSRLWFHDDINQVLQENK

SEQ ID NO: 178598 - protein, 174 aa, Glycine max
  Coding DNA Sequence Number=SeqID_86913
  Pfam annotation: Domain name=G-patch; Domain location=4-45; Score =28.0; E_value=3.4e-05; Accession=PF01585.14; Description=G-patch domain
MAVMVARVMLGNGYEPGMGLGKDNGGITSLISAKGNRGKFGLGYKPTQANIRKSIAGRKSGSQGSRLRQEDEGGPPCHISRSFISAGLGDEGQVVAICEDDSPSGSELVRPCPPGFRLGNWRVEERLDIYATSIIARSDDEFFEGTNTWDPTIDSEQETNQTEDEEDEDVGLLP

SEQ ID NO: 178599 - protein, 181 aa, Glycine max
  Coding DNA Sequence Number=SeqID_86914
  Gene Ontology: Mol. function=chitin binding; Cellular component =extracellular region; Biological process=chitin metabolic process
  Homolog annotation: Hit_ID=UPI00006A17C9; Match level="QueryCoverage =86%, HitCoverage=100%, E-value=6e-12, Identity=29%"; Hit description= UPI00006A17C9 related cluster
  Subcellular localization annotation: CTP_CleavageSite=73; ConfidenceScore=5.29e-01
GEIGIAVAGQNLARVKSCPGMHSSCVIASLSGCARTVGRPPISGGGPGTVRMWSTLKMRTRSPLKVRACNPLKARMYSPLEACSPLLARTCSPLKVRACSPTKVRTCSPLMARACNPLKVRTCSPLMTRACSPLKVRTRSPLMARACSPLKVRTCSPLKVRTHSPLKVRACSPLLARSVVL

SEQ ID NO: 178600 - protein, 138 aa, Glycine max
  Coding DNA Sequence Number=SeqID_86915
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSGGGCGVTRSVTATLASADVRRCFCRYAPPRQ

SEQ ID NO: 178601 - protein, 55 aa, Glycine max
  Coding DNA Sequence Number=SeqID_86916
MVYQKGVIATLMNMVRSLYKWIQRHLLNCGQIGHFKASASMFGVAANNSLSERIE

SEQ ID NO: 178602 - protein, 137 aa, Glycine max
  Coding DNA Sequence Number=SeqID_86917
  Subcellular localization annotation: CTP_CleavageSite=54; ConfidenceScore=5.42e-01
MQMADRGRGGGRRTFNRGTRRGFSLGVSITTNPSPSSIHISTSKSMSIPTTPVRDASPSTPDDSVTPEYPPDPNCEHIVDERPFIRAYKGEFQPTYGCSNIISNIIRAKFDEPASSLSIPSTSRGGPVPAFVPFSEG

SEQ ID NO: 178603 - protein, 89 aa, Glycine max
  Coding DNA Sequence Number=SeqID_86918
MAKFDPEIVLEFYANAWPTEEEVQDMCSWVRAIGGTGPTVSMRKPSPNCRHTGAGFRPNRCREANADHTHQHDHFDPDMDDTAAQQCLA

SEQ ID NO: 178604 - protein, 120 aa, Glycine max
  Coding DNA Sequence Number=SeqID_86919
MLVLTPTHFPFWKTLLWLFARIPVKGESEEAKEEESSEEIYPQEEGQPLMVKDECKEVSVSSKRLAKKESHFALKTNIKETSPLRQPPHLRLCKKTLVSTATPVGLGVIPQVKELLDKSL

SEQ ID NO: 178605 - protein, 194 aa, Glycine max
  Coding DNA Sequence Number=SeqID_86920
  Gene Ontology: Mol. function=RNA-directed DNA polymerase activity; Biological process=RNA-dependent DNA replication
  Homolog annotation: Hit_ID=Q0ZCD0; Match level="QueryCoverage=94%, HitCoverage=16%, E-value=2e-09, Identity=23%"; Hit description =Integrase
MERSMIDAASGGALGDMTPVEARNLIEKMASNSQQFSARNDAIVIRGVHEVATNSSSSAETKKLEGKLDALVNLVTQLAMNQKSALVARLCGLCSSTDHHTDLCPSVQQSEAIEQPEAYAVNIYNRPPQPQQQNQPQQNNYDLSGNRYNLGWRNHPNLRWSNPSQQQQQQQPYFWNVVGPSRPYVPPPIQQQQQ

SEQ ID NO: 178606 - protein, 321 aa, Glycine max
  Coding DNA Sequence Number=SeqID_86921
  Subcellular localization annotation: CTP_CleavageSite=42; ConfidenceScore=5.44e-01
GSSGNTPKKGSSGKVFRNFETSSGSARLPEEVFFRKTFGYFRKNTSSGNFPENVLPELPEEPLTGSIAMLRFHCYANSDAHYKLRVRGRGTNLFAEKKKKALARLAEKKLHGEEKKQVPGEEEAVPGEKKLAKWYFQSIAGCTSNIAGVTPTVTNVGPPSTYVVNTHGPKGIKVLVQPCPLTFKRRVMLGAPSNSLKAFSLFTSLFCESFFPSLFRDELLLREASPAALGPICIREDAGKNGDSVVTVAPSGRPVRDSSKTSETTETSSRSTGLPERFRKKWFFRKHSGRRVLPDDLSVVPEALSRRPLLPECFRKNHFCR

SEQ ID NO: 178607 - protein, 191 aa, Glycine max
  Coding DNA Sequence Number=SeqID_86922
MTTFTWIWMTLLFSNILPGDHNANLPLQMYWLGSCPQDAQWARRSPTGSWGFQLWLRASESHPQRHPVDPEKSNRALGFPALVTGLCSPTGCPFPPARSRHHRNHAHKNTQWTRRSPTGPWGFQLWLRASVVLQGARSPRQGHVIIGIAPARHPVDPKKSNRVLELPSSNYEPLSILRSACHLQQGHQAPY

SEQ ID NO: 178608 - protein, 153 aa, Glycine max
  Coding DNA Sequence Number=SeqID_86923
MIEKKMMLGDKSKNLSKMLVVKLRGCVEHQDIVKKDYETFAQKWSKNVIHGRRALPNTYNDHHECENSSLECHGSDSRLMEAQGWKLGGRIFGPKHAGHLGQNYSTKHLSYAESNRPLFLVMGWIPHRLKMATTHPKSCLCGLSRSFMTITKK

SEQ ID NO: 178609 - protein, 34 aa, Glycine max
  Coding DNA Sequence Number=SeqID_86924
VEGRSPEYEESQDLRSNPFQGGGNDTILAHKGIR

SEQ ID NO: 178610 - protein, 147 aa, Glycine max
  Coding DNA Sequence Number=SeqID_86925
MGAHLEYEFMYMVEGVPKKWFLQFRDLIYLEFNHVDGGCLVMSMTVDFKHAWSKIAVVLENGVAFEDAVIEDDAVANIAIFRVSVLFSGEFEGLKVAGSSGGREDREGREEYPQREERRWYGERRGGEYEHRVSTSRFLGEFHMTQF

SEQ ID NO: 178611 - protein, 89 aa, Glycine max
  Coding DNA Sequence Number=SeqID_86926
  Gene Ontology: Mol. function=NADPH:quinone reductase activity; Cellular component=flagellum; Biological process=negative regulation of transcription
  Homolog annotation: Hit_ID=Q8L5Q7; Match level="QueryCoverage=77%, HitCoverage=33%, E-value=2e-20, Identity=71%"; Hit description =Putative quinone oxidoreductase
MVPETLPSEELAKLRALPKSIVPIIHPNQLPEADSFIFGFPTRFGMMAAQFKAFLDSTEELCKTQRLAGKSAGIITSTSSQGGGQETTV

SEQ ID NO: 178612 - protein, 90 aa, Glycine max
  Coding DNA Sequence Number=SeqID_86927
MATMAEWHDEDFANRHRKRSEVGHINAQCRLEMYLRAWELAFGGRMKEEKRRPLSLSLRFMNSATAKESRTDAGGVHSDLQWSRTQIKTL

SEQ ID NO: 178613 - protein, 116 aa, Glycine max
  Coding DNA Sequence Number=SeqID_86928
  Gene Ontology: Mol. function=phosphoprotein phosphatase activity; Biological process=intracellular signaling cascade
  Homolog annotation: Hit_ID=A5C1K9; Match level="QueryCoverage=45%, HitCoverage=3%, E-value=5e-14, Identity=66%"; Hit description =Putative uncharacterized protein
  Pfam annotation: Domain name=DUF1723; Domain location=46-95; Score =34.8; E_value=3.2e-07; Accession=PF08330.1; Description=Protein of unknown function (DUF1723)
MEMFYRCNLNMFQNMFGMRNPDRKLHIKRAVPIYQGQEEIPEEIIPLLRQSGFYWIMKMGPETHTFHLRCGETTITLQDVSVLLGLRTDGAPLIGQTNLDWAELCEELLGVPPIGR

SEQ ID NO: 178614 - protein, 106 aa, Glycine max
  Coding DNA Sequence Number=SeqID_86929
  Subcellular localization annotation: CTP_CleavageSite=42; ConfidenceScore=5.16e-01
MYPPLGLIHKRCTLSCSQSTTQVDVPSTCTTKDVPSNVLRRRSQAVKPLILAEWEYKRILRWEKGDTKEFRRLVLCSFGKGRRETQKEFRWLVLGEFFLSKGYEKE

SEQ ID NO: 178615 - protein, 103 aa, Glycine max
  Coding DNA Sequence Number=SeqID_86930
  Gene Ontology: Mol. function=heat shock protein binding; Biological process=protein folding
  Homolog annotation: Hit_ID=O82368; Match level="QueryCoverage=86%, HitCoverage=28%, E-value=3e-20, Identity=55%"; Hit description =Uncharacterized protein At2g29880
MDAMNRGLRDANGSLSKQNVERIILPQLNAKTKFPKTYSHYLSRMKWFRNQYNMMSTLMRNNSGFGWDPIGKTFTAHEDVWKDYLKMSPEERSSWINFKLGNN

SEQ ID NO: 178616 - protein, 100 aa, Glycine max
  Coding DNA Sequence Number=SeqID_86931
MESIYEKDPRPTSSNVAYITLAHLGHQIASWRRNQLAWASSLLQGCFKGFQGSEVERIERIERIKKEEERRGNKAEALPNRDRDHSLHHSLFGVLRATIG

SEQ ID NO: 178617 - protein, 151 aa, Glycine max
  Coding DNA Sequence Number=SeqID_86932
  Homolog annotation: Hit_ID=Q6UUU1; Match level="QueryCoverage=39%, HitCoverage=40%, E-value=1e-18, Identity=78%"; Hit description =Putative uncharacterized protein
TTNRYSKSYTGARRGTVCEPLPLGNQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 178618 - protein, 150 aa, Glycine max
  Coding DNA Sequence Number=SeqID_86933
  Homolog annotation: Hit_ID=Q6WAY6; Match level="QueryCoverage=99%, HitCoverage=23%, E-value=2e-16, Identity=34%"; Hit description =Putative uncharacterized protein
MDGLVDLAAIDAFLAYHHNKESLVIVVLADAYYTFDQRCEKSSARIFCCMPVLYVWLVSHIFHHESRPVCPLQGHRMCAEKGKANWEQLLAGMVGSSVNWFPRWKEGGVGVMCSCEGFPNIPLMGTRDCINYNPMLAIRQIGYPMRGAPS

SEQ ID NO: 178619 - protein, 117 aa, Glycine max
  Coding DNA Sequence Number=SeqID_86934
  Subcellular localization annotation: CTP_CleavageSite=46; ConfidenceScore=5.47e-01
PPDISAGKCSGHAARNHHPARLMRRYRARPIRHSGCATVGKGRSVRASSLLRQLAKGGCAARRLSWVTPGFSQSRRCKTTASGLRIGASGVVYWAYYVGTDEGVSEVLHVQEKKAAP

SEQ ID NO: 178620 - protein, 57 aa, Glycine max
  Coding DNA Sequence Number=SeqID_86935
MSLDGNLRLQFLARNNFNMNNTEKGVPMNSKRIKVIPEWSTPPSVDEKAQSFKNLRI

SEQ ID NO: 178621 - protein, 95 aa, Glycine max
  Coding DNA Sequence Number=SeqID_86936
MGAKYLEVVKRGSHPNNGWSLDEIRGSQYHPQPHPSHSKAVKTPHAMAEMGKLDHLEERLRAIEGGAGYGFVNLEELFLVPNIITPPKFKVPDFD

SEQ ID NO: 178622 - protein, 193 aa, Glycine max
  Coding DNA Sequence Number=SeqID_86937
  Homolog annotation: Hit_ID=A5AM06; Match level="QueryCoverage=88%, HitCoverage=10%, E-value=4e-08, Identity=25%"; Hit description =Putative uncharacterized protein
MTHMIQRCLIFVETPPFSTVMPNMNDSHYVDDVHANRNDHDEGLWENILTFMATPPASPLQSNIQSPMKSRNTRKSTRLRRLTVRALDKPKPTVYVDAATSQGSGSFKEKFHSYLGVVAREKIPIVHNSWKDVPDTLKDLVWNDILAKFDIPEALNAKKKVMSTVASRWRQFKCNLTTRFVRQVASDILRRGG

SEQ ID NO: 178623 - protein, 149 aa, Glycine max
  Coding DNA Sequence Number=SeqID_86938
  Subcellular localization annotation: CTP_CleavageSite=56; ConfidenceScore=5.41e-01
MQLCAKRAIQISVSKKSKAVALWVLPLHPNLCTFLPLSTCVFSTSFVLFLCIFIASFQEHSNTAKHTLCTKPECYFVESELSVPCSGKLQLSSNLKIMASKKRKTPSTPTQARFDRSKFTSQEAWERYTDIVVPRKLLLERNVVVITQS

SEQ ID NO: 178624 - protein, 117 aa, Glycine max
  Coding DNA Sequence Number=SeqID_86939
MRMAQMHFMNTGAQEIVPFLDTTFGQHGARCMHLRRRHGPSVGIIPFNKHIAAVGTTSNNMLSKRKTLYEGSLLSSKSETQHDHKFTSTPYVPMDPGIRPLFNSLCMQKGVGVVCIK

SEQ ID NO: 178625 - protein, 134 aa, Glycine max
  Coding DNA Sequence Number=SeqID_86940
MSSIFGPDVLDIVSDIVDPAASILHLTFILPSSIFGQDVLDIVSDIVDPAASMLLAIPVFSSRMSWTLYPTFVNPAASILHLTFHLALCIVQPDLIVDITLDIMCSNSSFPSLSKCLCFNKILANLLKLSRAKH

SEQ ID NO: 178626 - protein, 78 aa, Glycine max
  Coding DNA Sequence Number=SeqID_86941
MAPKKLSTKRSRRDATGEGSSAAPEFDSHRFRNFQEEIARRRWTPLVTSVAKFNPEIVLEFYANAWPTEEGDREHALV

SEQ ID NO: 178627 - protein, 96 aa, Glycine max
  Coding DNA Sequence Number=SeqID_86942
MTARAFACEALLRLVDSKAPSSQAWVKTVGCGFGDPVNQDIRGGWWIALTSSIWHHRNNLIFQGSPFDPYKVMDHAIYLVWSWFKAKDKDFNTSFI

SEQ ID NO: 178628 - protein, 85 aa, Glycine max
  Coding DNA Sequence Number=SeqID_86943
MLLGYLSRESCCIGMCFGQSFLPLPCFLGLGLEGLWGPGAERNEDKGYLRSGTWRYVAGVRRPWGRQVGCYCPKPSLTNPDPTRA

SEQ ID NO: 178629 - protein, 54 aa, Glycine max
  Coding DNA Sequence Number=SeqID_86944
MASRKCKSIGSRPSTQYDTRRFYSFDALNRYMDNILGRNIVPERKLEIVGSSGL

SEQ ID NO: 178630 - protein, 28 aa, Glycine max
  Coding DNA Sequence Number=SeqID_86945
MARKLQEDWARDVGEGPRVLMGLRGSIV

SEQ ID NO: 178631 - protein, 144 aa, Glycine max
  Coding DNA Sequence Number=SeqID_86946
MKSFCSSLRTELIDLLAKLSKREKEENIKPDPDIDACMKCSTAHSLNCVSYWATCMSSPMCEKVLGAMLRCDDLGPLSAKNFNNYSESKDKDLYVTGDLYENDVVTPAMIVVPRRRGSRLTRSVKFHNVAEIEKRCFCAIREFP

SEQ ID NO: 178632 - protein, 76 aa, Glycine max
  Coding DNA Sequence Number=SeqID_86947
MAAEWRSKRERRRHFKEKMSLEEAHHHRRPWIRAWRKKEMNEGRGREEHEILCSKRALKSEPTNPRSIPRFSIKCA

SEQ ID NO: 178633 - protein, 62 aa, Glycine max
  Coding DNA Sequence Number=SeqID_86948
MEALEPFARETPKQGLWTLEGADPKFYSAVAVEEFPYFINKIPGFYQIIAYGTDNKNLQQNY

SEQ ID NO: 178634 - protein, 46 aa, Glycine max
  Coding DNA Sequence Number=SeqID_86949
MASKPTFCRQRIKLNVLMMPKVHMRLKALFKTKKLKIFKMDDQDSL

SEQ ID NO: 178635 - protein, 240 aa, Glycine max
  Coding DNA Sequence Number=SeqID_86950
MAGNQLTFAKGASISKPPLFCGMNYPFWKVQMKIFMESINRGILSVLEMNIIHSSLNPNEVFRVSVGTIAKEIWDLIQVIDEGTQEGLGHIFIEEEINVKRASAKYNTPRLSARKTLEEDELYRFAKRTASSHSAHRFSLSAKRERRAKPKITNLRGYEMGLTRMAEEEAIDKKNRGLASKTSIPSSDKSEYDNAKGLKAKNLNLLMGKFNKFLKKGKNYGNKTFLPKKNLKKGEPFFSN

SEQ ID NO: 178636 - protein, 178 aa, Glycine max
  Coding DNA Sequence Number=SeqID_86951
  Gene Ontology: Mol. function=protein kinase activity; Biological process=protein amino acid phosphorylation
  Homolog annotation: Hit_ID=A2Q378; Match level="QueryCoverage=82%, HitCoverage=11%, E-value=3e-33, Identity=46%"; Hit description =Putative uncharacterized protein
  Pfam annotation: Domain name=DUF889; Domain location=34-170; Score =14.4; E_value=1.8e-12; Accession=PF05970.5; Description=Eukaryotic protein of unknown function (DUF889)
MVDKCYFEALDKTLRDIMRIIDEVDIAFRGKVIVFGGDFRQILPVIPRGMCSNIVHATINASSLWDHYFAKWILEIGDGNHGQPNDGYATIEIPPALLILKYIDPIDAIVQSTYANLTNHFMDPQFLQSRAILASINELVEQQNDYDLSIILAEWRRNKDDWRCHFKKKMSQEEGHLD

SEQ ID NO: 178637 - protein, 115 aa, Glycine max
  Coding DNA Sequence Number=SeqID_86952
MKTLPPFESMHRLLKACNDWRQCRLRNAKETAIVLKTMKANDHDGLRMPSDLIVSGWQRRVNDHNLSPRANKLDCLWKARKADDHNLSSHANRLDCLWKAKRVWMTMIVSACQQT

SEQ ID NO: 178638 - protein, 137 aa, Glycine max
  Coding DNA Sequence Number=SeqID_86953
MSGLFFLTPTRSQVIAIIVVGVKPLEKASQRSHEEASGGSLLMKLLEKATWSYLNKNDAQRLLTVGSSQNLPLNEASEGSLLMKLLEKTTCSCLGRNASQPSLTVGSSRNLACAESTSKDKKESSSDATRNPWGSSL

SEQ ID NO: 178639 - protein, 209 aa, Glycine max
  Coding DNA Sequence Number=SeqID_86954
  Gene Ontology: Mol. function=aspartic-type endopeptidase activity; Biological process=RNA-dependent DNA replication
  Homolog annotation: Hit_ID=Q69F85; Match level="QueryCoverage=44%, HitCoverage=5%, E-value=3e-09, Identity=37%"; Hit description=Gag -pol polyprotein
MPWGGIQKADHDQLEARVSRPQGDEHFTHTMHERTQGKSYPKHTISTQDDPSLSHVHRHEERMICRHPFVDCIMEVDIPLGWKPLNLERYDGTIDSDEHLDSFLTQANLYTNNDAVLCCVFPMSLKGAIQNHNREVALHSILLLALRPSKFIDSLFKKPPSSMDELCEQAKCYIQMEEMSRLRNDVWQVGQKRNKREGGTKTDSHKSDK

SEQ ID NO: 178640 - protein, 234 aa, Glycine max
  Coding DNA Sequence Number=SeqID_86955
MASRKRKSIGARPTAQYDTRRFHSLDAWNRYTDNVLGRNILPERKVEIYHTEFNDFKTDSEGPSPKQARVRGHLVKIDVENLNTFLETPVVIEEGETLPTYSSYCKLPTDYREIEAALCIPGRVFILNAEGHPGRILKKDLTTLALVWSVLSYSNLAPTSHTSDLTVDRAKLIFIAQSNSFRLGFPGLITALCRAQGVVSDSLTFESLSPVIDLAYIRKNCWNLDDLTVAFWGG

SEQ ID NO: 178641 - protein, 292 aa, Glycine max
  Coding DNA Sequence Number=SeqID_86956
  Gene Ontology: Mol. function=P-P-bond-hydrolysis-driven protein transmembrane transporter activity; Cellular component=type II protein secretion system complex; Biological process=intracellular protein transport across a membrane
  Homolog annotation: Hit_ID=A8GAM7; Match level="QueryCoverage=83%, HitCoverage=39%, E-value=1e-120, Identity=90%"; Hit description =Protein-export membrane protein SecD precursor
  Pfam annotation: Domain name=SecD_SecF; Domain location=56-237; Score= -34.7; E_value=2.7e-06; Accession=PF02355.7; Description=Protein export membrane protein
TLFVEYKDSGKKDANGRAILVKQEEVINVANIQSRLGNSFRITGISNPNEARQLSLLLRAGALIAPIQIVEERTIGPTMGQQNITQGLEACLWGLIASIIFMVVFYKKFGLIATSALLCNLVLIVGIMSLLPGATLTMPGIAGIVLTLAVAVDANVLINERIKEELRNGRSVQQAIHEGYKGAFSSIVDANVTTLIKVIILYAVGTGSIKGFAITTAIGIATSMFTAIVGTRAIVNLEYSIEQLNHGRKVVDFMRWDTLAFIISGLLIVASIAIIGVRGFYLGARFHRRDGD

SEQ ID NO: 178642 - protein, 101 aa, Glycine max
  Coding DNA Sequence Number=SeqID_86957
  Subcellular localization annotation: CTP_CleavageSite=41; ConfidenceScore=5.07e-01
MVRAEINRPNSQKHVPSGVANCHNQPFGGRATQGSRVRLPREENARSCHQHLFEENIGKTGMSGLRTFIVKGSEVIFMHGEGINETLGLIRILVRRLEEGK

SEQ ID NO: 178643 - protein, 130 aa, Glycine max
  Coding DNA Sequence Number=SeqID_86958
MVGYTPSSFADLVFAGEKIEVGLRRGKFDYPALMNRKPGENGENEKEGGTHVVTVVPTWPNFPPAQQYQYSANISPSHYPPPYQPRTLNHPQRPPLNHPKPNTTLNTNQNTNQGRNFPTKKPIEFSSVIC

SEQ ID NO: 178644 - protein, 78 aa, Glycine max
  Coding DNA Sequence Number=SeqID_86959
  Subcellular localization annotation: CTP_CleavageSite=42; ConfidenceScore=5.39e-01
MQNRIYTGLATTRAYVQSSTLNHKGLSSFVFSVYTKKQIPLLAMNPKGPFVEASFMMMNQVDSRSFDNDKDDDKKPKE

SEQ ID NO: 178645 - protein, 115 aa, Glycine max
  Coding DNA Sequence Number=SeqID_86960
MCKREHETFKEYAQRLRDLVAEVGPPMMEKEMITMVVDMLLVFYYEKMGLLWRLNLCASMRSFNGDYPPWRRQPLGNKPWKKELHHQECALDKKLGEDASMKEKKERGGSTRLKE

SEQ ID NO: 178646 - protein, 74 aa, Glycine max
  Coding DNA Sequence Number=SeqID_86961
  Subcellular localization annotation: CTP_CleavageSite=53; ConfidenceScore=5.13e-01
MAYTHIPDSQAILLKFMPARINWTLHLMLQGPTMLNRMPRGSSMISTHCVRVVSSEKWRLRKPSRGYGYHCSIK

SEQ ID NO: 178647 - protein, 79 aa, Glycine max
  Coding DNA Sequence Number=SeqID_86962
  Gene Ontology: Mol. function=drug transporter activity; Cellular component=membrane; Biological process=multidrug transport
  Homolog annotation: Hit_ID=Q0WWD0; Match level="QueryCoverage=72%, HitCoverage=19%, E-value=1e-09, Identity=41%"; Hit description =Putative uncharacterized protein At4g25640
MGSATETLCGQDFEAGQEDIADPAGSFSILVIPQFLSLPFNFPTQKFLQAQSKMVQLWHLISRVGDHSGSTCLCCDLFF

SEQ ID NO: 178648 - protein, 50 aa, Glycine max
  Coding DNA Sequence Number=SeqID_86963
MGENEKEGKKAPDQGSKENRRSVQKGNNSQSQVVTYLWFGIRIKHLPVRD

SEQ ID NO: 178649 - protein, 143 aa, Glycine max
  Coding DNA Sequence Number=SeqID_86964
MALRKLSTKRSKKDAVAEGTSAVPEFDSHRFRSAEHQQPHRHWTSLVTPMAKFDPDIVLEFYVNAWPTEEGMRDLRSWVRGQWIPFDADALSQFLGYLLVLEEGQKCEYSQRRNRVDGFDEEAIAQLLCIPGQDFARTAAGRR

SEQ ID NO: 178650 - protein, 143 aa, Glycine max
  Coding DNA Sequence Number=SeqID_86965
MAAAGKAGATAARRAAVGVCRSARVAGAARGDRALSAAGAGREGDGGTGDRGDQLSAGVGAVYPGAVRSRRCGVRRRAGLPGGEEAGAVGGAAGAADRYRRAGAGRRAVDAGLGRRTGRLHHAVPSLPAGVFAEPRAAVGAAA

SEQ ID NO: 178651 - protein, 65 aa, Glycine max
  Coding DNA Sequence Number=SeqID_86966
TDPVAQEKAVAQEPTSPVQISPAPIPKDSQPSAPASEPAQPIVQDPPAAPVLDLNEHAEDHPQED

SEQ ID NO: 178652 - protein, 86 aa, Glycine max
  Coding DNA Sequence Number=SeqID_86967
  Subcellular localization annotation: CTP_CleavageSite=43; ConfidenceScore=5.62e-01
MSCKGSLSAPLHLTKRTTSVHPLSKKGALSQKSLTCAKRSIKLCMSRVSRERKVQVPESLERFCCVKICRDQSLKQEPVLELEMSL

SEQ ID NO: 178653 - protein, 69 aa, Glycine max
  Coding DNA Sequence Number=SeqID_86968
MAREKCDSEGEEETKIGTEISFDSPILKKEISKVPSLNRELIIETLDYPDTYFVKWFMHVYCPVQQDPV

SEQ ID NO: 178654 - protein, 166 aa, Glycine max
  Coding DNA Sequence Number=SeqID_86969
  Homolog annotation: Hit_ID=A0ST23; Match level="QueryCoverage=15%, HitCoverage=51%, E-value=4e-07, Identity=100%"; Hit description =Putative reverse transcriptase
GKPVVPAALMNRPTRGERRFAYWALAECILAYYVGTDEGYIPLPRSLTRYASVVRLRRAEMAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYL

SEQ ID NO: 178655 - protein, 116 aa, Glycine max
  Coding DNA Sequence Number=SeqID_86970
MFECNQLGHLRVDSPIFKKRMEKFEKKAFNDKKAKKAYITWDDNDMDSSEDSENEVVNLSLMAKNYKSDEEVTSSDNNISISFDELQDAFTDLHKELVNLAKLVSSSKKTISNLEK

SEQ ID NO: 178656 - protein, 199 aa, Glycine max
  Coding DNA Sequence Number=SeqID_86971
MRVFHAWGSVALIDEIPHAHHPSISATSSIIHSNFCQSKWWNCCWSSTWISQLIWRDWLDLRAKRKVLASCRVVLMASSSSCLSNISIISGPVEGDCGCKISIFHSIFRMGEEDIKLHIRRVVPTYQGQEEIPEEIIPLLRQSGYLNNHGGLEQVERFTHAWIFRFIGGVLFVDSATNYKTKSIGGGCDGKIKILVMMI

SEQ ID NO: 178657 - protein, 78 aa, Glycine max
  Coding DNA Sequence Number=SeqID_86972
MDWGMNPGCRGGGMCRQDFGRIEYGPTVLASVSPVPEWCPRKRYEGRFFEDPNDEGLTIDFDRDEEREMKPHQEETEL

SEQ ID NO: 178658 - protein, 445 aa, Glycine max
  Coding DNA Sequence Number=SeqID_86973
  Gene Ontology: Mol. function=transporter activity; Cellular component= integral to membrane; Biological process=transport
  Homolog annotation: Hit_ID=A4W7J4; Match level="QueryCoverage=99%, HitCoverage=53%, E-value=0.0, Identity=85%"; Hit description =Fimbrial biogenesis outer membrane usher protein precursor
  Pfam annotation: Domain name=Usher; Domain location=1-445; Score =232.0; E_value=1.4e-66; Accession=PF00577.11; Description=Fimbrial Usher protein
MYPDSLQGYAPTVRGIARTPAKVVVRQNGYVIYQSYVQPGAFAISDLNPTSSSGDLEVTVEEKDGTQQRYTVPYSTVPLLQREGRWKYDLVAGDYRSGNSDQDTPFFTQGTLITGLANGYTLYGGTQLASRYTAVAIGAGKNLGDWGAVSLDITHARSQLADDSKHEGQSLRFLYAKSLNGFGTNFQLLGYRYSTKGFYTLDDVAWRSMEGYQYADSQNDNDVPDVQSYHNLTWNKKGRFQLNVSQSLGDYGSVYISGSEQTYWGTDESNLWYQLGYAGGVKGINYSVSWSWNKSVGIDGTDRIASFNVSVPFSLFTRQGYRRDSAIDRAYATASASRNSDGDTSWQTGVSGTLLEDRNLNYSVTQGHTSTNGSSGSASANWQATYGTLGVGYNYSRDQHDLNWQLSGGVVGHADGVTFSQPLGDTNVLIKAPGASGVSVETRPA

SEQ ID NO: 178659 - protein, 240 aa, Glycine max
  Coding DNA Sequence Number=SeqID_86974
MRVSQRRNRADGFDEEAIAQLLCIPGQDVARTAAGRQVRIMRTSMTTLTQMWMTLLLINVLPSDHNSDLPLPKCQLVYAILTRMSVHVAELIADAIYLFAGMPPTRHPLDSDKSNRALGFPTLVTGLCQSFGVPVTPSKVIRPPITRAFIEKYCTPRQAQVDAPQATDALPPPHQADHAGSLGMEQYLQHLFRAEVAWPGDWPEAQAGEAPAGSPGDAEEARMDEEMMDLLGFLGGSGAM

SEQ ID NO: 178660 - protein, 218 aa, Glycine max
  Coding DNA Sequence Number=SeqID_86975
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=21%, E-value=1e-113, Identity=88%"; Hit description=DNA -directed RNA polymerase subunit beta
  Pfam annotation: Domain name=RNA_pol_Rpb2_6; Domain location=1-141; Score=-51.5; E_value=7.8e-11; Accession=PF00562.19; Description=RNA polymerase Rpb2, domain 6
  Pfam annotation: Domain name=RNA_pol_Rpb2_7; Domain location=143-206; Score=69.1; E_value=1.4e-17; Accession=PF04560.11; Description=RNA polymerase Rpb2, domain 7
  Pfam module annotation: Pfam domain module=RNA_pol_Rpb2_6::RNA_pol _Rpb2_7; Domain location=1-141::143-206
MPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEMERCFTYKSDHIKTRQEVLGTTIIGGTIPKPTDAPESFRLLVRELRSLAMELNHFLVSEKNFRIHRKEA

SEQ ID NO: 178661 - protein, 187 aa, Glycine max
  Coding DNA Sequence Number=SeqID_86976
  Homolog annotation: Hit_ID=A5BU47; Match level="QueryCoverage=75%, HitCoverage=8%, E-value=7e-12, Identity=31%"; Hit description =Putative uncharacterized protein
TCKRNLQDSGTLKRVAWGLDVGTRISEATCLTAYSSLGTRTRESRVTLLPKGRLRHISILIHHEALLLHQVQDKFHNYLGVEAREKIPIVHNNWIDVSESLKELVWDDILAKFDIPEAANAKKKVMSTVATRWRQFKSQLTTKFLYANNDGQHKSDPFEKYCIDPQIWEEFAATRKTPNWQGIRKRA

SEQ ID NO: 178662 - protein, 171 aa, Glycine max
  Coding DNA Sequence Number=SeqID_86977
MSEHSYTVVVDDLIALCPAKDVVVWFCSLHKKPDIHIKVAVNNAMKTLKSSLDGHIDKVASQWVEIKSHVQIGRCEFGYYVMHWMWNTWFVDGTSLDMESITTIRKKWAAYFLKVILYLRMSIVLMIDQLTSTNMRFDNYIHACSMREHGYEASSQSDHKPNKLPFHLTIE

SEQ ID NO: 178663 - protein, 141 aa, Glycine max
  Coding DNA Sequence Number=SeqID_86978
MGSMLLFEDIDDRWMHFSDYLAAVGQIYGVPGKCASDYMQWFFMISHPFMTPAQPVDPVRHPLVTQDDIYVKPHIPKVPVALATALAHAPSDVEQPRHAVETCQEITERLEHLLNLRIVIAGIEIHKVMEDCLRIARGVTT

SEQ ID NO: 178664 - protein, 129 aa, Glycine max
  Coding DNA Sequence Number=SeqID_86979
MVRSLSSICSILSFSSTVEGPSPLTKCKVVITNNIEIFREHSAQGCQKMPTLQWYILDKPQTQPECGLGELHVFPPWVERHVLDQIRGVLKKLNQEAFGGGVNLSIGGALRNLHQEATGRQPPPIFSYK

SEQ ID NO: 178665 - protein, 30 aa, Glycine max
  Coding DNA Sequence Number=SeqID_86980
MVDGKLIEMKGRVNLGLKDWGKLGLCKGGK

SEQ ID NO: 178666 - protein, 258 aa, Glycine max
  Coding DNA Sequence Number=SeqID_86981
  Subcellular localization annotation: CTP_CleavageSite=12; ConfidenceScore=5.27e-01
MAESSKKRKGSSSSTTTSGHHHHGASGDSPAPPNPYLSSPCSLTLFSTDDQCQRYYSSFSNRVILDPKFLDFEFFEGENFDCYQVFQKSELADFMTLKLPYYSKIVRVFYNNLEIRDGVIFSEVHKIPIVVDQSLFNSLTKLSSQALQIGRQIHWGHLVRHRIHKALRVNAPLPYPHLVTLILQHFNIPLANEPFVKDLPTNAPDERTPSPPPRDSSSTLLNDVLTELRDLRAFVGERFDSMDSCIIHLEDDMGFIRR

SEQ ID NO: 178667 - protein, 217 aa, Glycine max
  Coding DNA Sequence Number=SeqID_86982
MGDQEEIQEQMKADMSTLKEQMTSMMDPMLGMRQLMENNVATTVAVSSAAEADPTLPATAHHPLSNAVGRERSTLGHISNPHLGYNRVAYLYGLPPNYTPLVMRDDAGHVPSPFLEGEPPRQSDEVHEDHREYAQVDIDFYPPVPVEGPAPNILPQPNLPTQPIFLSTEGPPPTAEERRKLDLIKERLRAIEGFGDYPFADMVDLCLVPDVVIPQNS

SEQ ID NO: 178668 - protein, 110 aa, Glycine max
  Coding DNA Sequence Number=SeqID_86983
GSSRCGVSMENNDGLWLLMVDVGDGESSWDFRNGFGRKKEEEMTFFLSYTKAKAETKCREDPTVNEGWTAFFPRQLHAYREFGAKRNVEDSEPFLSLTCRECKEDGESAE

SEQ ID NO: 178669 - protein, 261 aa, Glycine max
  Coding DNA Sequence Number=SeqID_86984
MVIRTFCQPEASEPIDMQRLTLSSAPLSSRDGESDDMQRYLMVICTFCQLEASEPFDTQRLTSSSAPLSSRDGEFDDMQRLLMVIHTFCQLEANDAVDTQRLTLSSASLSSRDGESDDMQRYFMVIRTFCQLEASEPIDTQRLTSSSAPLSSRDGESDDMQRYLMVICTFCQPEASEPIDMQRLTSSSAPLSSRDGESDDMRRYLMVIRTFCQLEVSEPVDTQRLTSTSAPLSSRDGESDDMRRYLMVIHTFLSVRGKQAC

SEQ ID NO: 178670 - protein, 191 aa, Glycine max
  Coding DNA Sequence Number=SeqID_86985
  Subcellular localization annotation: CTP_CleavageSite=48; ConfidenceScore=5.59e-01
MDKARRGPDTSAPSSSALPAPAPPPTPPAPTPTTPIPSRTSAQSIEILVSMLQSLHHGLCLVMQSINHLAQHRPIMSMEAFMAQVVWPGVQHSPLGGGKAPTAQESQSEAEPEASPEAEGTLEDTPEVTPAATPLVEIEKDEDGTEDTDYTVDMAATKSTRDPWPTPAPETSQPAPDAPSSHHDEHTPAQD

SEQ ID NO: 178671 - protein, 112 aa, Glycine max
  Coding DNA Sequence Number=SeqID_86986
MVAGNTTIEKPREDWSEEERRLVQYNLKAKNIITSALGMDDYFRVSNCKSAKDMWDTLQEYEMELLRLNQHEENDKKKKGIALKASSSIQEESDNEDLIDLNEDDNLSLFVK

SEQ ID NO: 178672 - protein, 88 aa, Glycine max
  Coding DNA Sequence Number=SeqID_86987
MPTEPRTPVVNPPSSPELEVVSPSPPLIVISDASSDEVATPPNSPAGETADPPASQLEELPIFLIRHLEKLLLLLIPQFKPLLTFIDS

SEQ ID NO: 178673 - protein, 78 aa, Glycine max
  Coding DNA Sequence Number=SeqID_86988
  Homolog annotation: Hit_ID=A5BBD5; Match level="QueryCoverage=53%, HitCoverage=16%, E-value=1e-07, Identity=61%"; Hit description =Putative uncharacterized protein
MGSSRLIGLMPLKSLSVKVIGGRLHYRVASTKLMLMSWMAYLPGFTCSVYNGNHALVSPESHVYGPLPDWYCNTLQYY

SEQ ID NO: 178674 - protein, 67 aa, Glycine max
  Coding DNA Sequence Number=SeqID_86989
MENARSHHQRLFEENVGKTGKGCGLQTLSVKGSGVVFTHDEGHLRRWTIKRSFDSFERRENIKALDH

SEQ ID NO: 178675 - protein, 151 aa, Glycine max
  Coding DNA Sequence Number=SeqID_86990
MSNHKSTELALKNIEIQVGQLAKQLAEKSSDRFWANTEKNPKEECKAVVTRSWKLVAAEDEDVVALKEQVALKDTTVKKKNKEIGNNYALWRSFAADATLLKVFERYVDKEAQIHSLGEYRCGRQLQCCDTEDPSTKTQEPWKCDYSLFNK

SEQ ID NO: 178676 - protein, 161 aa, Glycine max
  Coding DNA Sequence Number=SeqID_86991
  Homolog annotation: Hit_ID=Q5QJQ3; Match level="QueryCoverage=65%, HitCoverage=82%, E-value=2e-57, Identity=100%"; Hit description =Putative uncharacterized protein
STLEDPPLKGGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPVTFGKRVGSS

SEQ ID NO: 178677 - protein, 251 aa, Glycine max
  Coding DNA Sequence Number=SeqID_86992
MAKFDPEIVLEFYAKAWPTEEGVRDMCSSVRGQWIPFDANALIQFLGDPLVLEEGQQCEFSQRKKRADGFDEETIAQLLCTPGQDFARTAAGRRVQLSYLALIQTWMTLLLSNVLPSDHKSDLPLPKCQLVYAILTRMSVHVAQVMADAIYLFVGMPPTRHPLDPDKSNRALGKVILPPITRAFIKKYCMPRQAQGDAHQAADAPPPPRQADPAGSLGMEHYLQHLVCQQAANHRGQVQIHECLYRFSLSQ

SEQ ID NO: 178678 - protein, 170 aa, Glycine max
  Coding DNA Sequence Number=SeqID_86993
  Gene Ontology: Cellular component=nucleus; Biological process=cell division
  Homolog annotation: Hit_ID=A7NUY9; Match level="QueryCoverage=55%, HitCoverage=16%, E-value=1e-12, Identity=37%"; Hit description =Chromosome chr18 scaffold_1, whole genome shotgun sequence
ADKAIAEIEAKCGQKIEECKEEQRQQLMRIEDEHTLLIKALRCELEDECQKLEEELHLQKSKEDRQRALLQLQLKVMSDKPKEDQEVNSKQTLSHSLCQGINTLNSNVKSDTAFQGGYYIITVFECRPDVTFKDGYYVITVFECRPDVTFKGGYYVITVFESRADVTFKA

SEQ ID NO: 178679 - protein, 128 aa, Glycine max
  Coding DNA Sequence Number=SeqID_86994
  Homolog annotation: Hit_ID=A7R6F1; Match level="QueryCoverage=93%, HitCoverage=39%, E-value=8e-08, Identity=27%"; Hit description =Chromosome undetermined scaffold_1262, whole genome shotgun sequence
MEKFENKNIGEKKAKKAYITWDDNDLESFDDSEKEVINLCLIGKNYESDEEVTSSNKSISFDELQDAFAELHSESIKLAKLVSSSKKTMSDLEKKISKLNKELDHLKSEVSISKSRDKVHASTMTIEK

SEQ ID NO: 178680 - protein, 60 aa, Glycine max
  Coding DNA Sequence Number=SeqID_86995
MGVSSDQKAILLSWGKLSGSHIINETSKRVGLRPQKETTPENLAFHRFKQKMQMKLKAET

SEQ ID NO: 178681 - protein, 15 aa, Glycine max
  Coding DNA Sequence Number=SeqID_86996
MEYLQNPHDRTKPYL

SEQ ID NO: 178682 - protein, 63 aa, Glycine max
  Coding DNA Sequence Number=SeqID_86997
MAGTVDSLWIGKKKGLTFTGAVFGSRVIEWSVGRDGGRVARGWNNEEYLVTKDAISGSMCVVG

SEQ ID NO: 178683 - protein, 240 aa, Glycine max
  Coding DNA Sequence Number=SeqID_86998
RKEADWWDPPVVAPPTDPDLLKLWWRPAAILTIAGARGRVLSGRCGCSVEPRHGIESSKWAIFGKQNWRCGMNRKLGYGAQLRANLDPTKGVGRLRQQDGGHGSRNPLRRREPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVE

SEQ ID NO: 178684 - protein, 175 aa, Glycine max
  Coding DNA Sequence Number=SeqID_86999
  Homolog annotation: Hit_ID=Q8LE22; Match level="QueryCoverage=85%, HitCoverage=65%, E-value=2e-17, Identity=28%"; Hit description =Putative uncharacterized protein
  Pfam annotation: Domain name=Hin1; Domain location=18-154; Score =15.1; E_value=8.5e-05; Accession=PF07320.4; Description=Harpin -induced protein 1 (Hin1)
MSLLFLIIVAIVIVALFFTIFRPKDPNIIVHPVGFENFNPSLLTNVTANVSLGMLITIENSNYENFEYPNATGYIKFHDTVVGQVPIVGELVPPRSQINVNTSANFMVAKLINDPNFLSDFLSGIVNFTSTASLPGKAHMLKIIKFKATVYSSCDISLNITSRNVDSKCISKIKL

SEQ ID NO: 178685 - protein, 236 aa, Glycine max
  Coding DNA Sequence Number=SeqID_87000
  Gene Ontology: Mol. function=SNAP receptor activity; Cellular component=integral to membrane; Biological process=intracellular protein transport
  Homolog annotation: Hit_ID=A7PXH5; Match level="QueryCoverage=99%, HitCoverage=72%, E-value=1e-73, Identity=62%"; Hit description =Chromosome chr12 scaffold_36, whole genome shotgun sequence
  Pfam annotation: Domain name=SNARE; Domain location=129-205; Score =54.0; E_value=5.3e-13; Accession=PF05739.10; Description=SNARE domain
MEKDIDEVGKIAHGVKTKIEAISRDNLSNRQKPGCEKGTGVDRARMNMTNALTKKFKDLMTEFQTLRQRIQDEYREVVERRVITVTGTRPDDETIDRLIETGNSEQIFQRAILEAGRGQIVNTVEEIQERHDAVKEIEKKLLDLHQIYLDMAVLVDAQGEILDNIESQSTFSLICVNERLVQVNNAVDHVQRGTSALQNAKKLQKNSRKWMCIAIIILLIIVAIIVVGVLKPWKSS

SEQ ID NO: 178686 - protein, 172 aa, Glycine max
  Coding DNA Sequence Number=SeqID_87001
  Gene Ontology: Mol. function=histone-lysine N-methyltransferase activity; Cellular component=nucleus; Biological process=chromatin modification
  Homolog annotation: Hit_ID=Q5PP37; Match level="QueryCoverage=88%, HitCoverage=47%, E-value=3e-47, Identity=49%"; Hit description =Histone-lysine N-methyltransferase ATXR2
MEVDWESSHSLLCTVESSDSARREALLKFIKHANKQMIYSSLLQRWWDCIALPDDVDSSDEASFRLQIKMLAFESLQLLKKAIFDKESSPVEDYFLYIDDLTYPNKEEAEKITQPILDALGEEYSIYCKGTAFFPLQSCLNHSCCRNARAFKRDRECGVPCASTRSPKPLMG

SEQ ID NO: 178687 - protein, 493 aa, Glycine max
  Coding DNA Sequence Number=SeqID_87002
  Gene Ontology: Mol. function=transferase activity, transferring glycosyl groups; Cellular component=membrane
  Homolog annotation: Hit_ID=A7PXJ9; Match level="QueryCoverage=88%, HitCoverage=91%, E-value=1e-143, Identity=57%"; Hit description =Chromosome chr12 scaffold_36, whole genome shotgun sequence
  Pfam annotation: Domain name=DUF604; Domain location=218-467; Score =430.6; E_value=2.2e-126; Accession=PF04646.3; Description=Protein of unknown function, DUF604
MDLEMIFTNSVTPHWNKRFSFFWACTDQPREIHIEEEGIHARIASFEQMVLLGTPSKLENLHSSSHNVYESKTTTTLDHLVFGIASSRSSWPKRKEYVKLWWNTIRNTTMRGCVFVDTLPQDKDNNNNASTLPPLCVSQDTSRFRYTYSGWGGGMRSAIRVARVVKETVARMNHSHIRWYVFGDDDTLFFPQNVVKTLCKYDHRLWYYVGANSESYKQTWFFGFGMGFGGAGFAISSSLATVLVKVFDSCIERYPELYGSDARVYACITELGVGLTHEPGFHQVDLRGNAFGLLAAHPLTPLLSLHHLDNIDPIFPNMTIIKALQHLYEAAKVDSQRLLQQTVCYDKRLSWTISVSWGYAAQVFHNHLSLPDVVRVQKTFKHWTRGTALADQFTFDTKELHTDPCRRPTIFYLENLSRGEDGIIISNYRKSIQNCSSNVAPEVIRVASSKLELGIKQLLAQRRHCCDVLPSSVSDQMEIAIRECKEDELISMQ

SEQ ID NO: 178688 - protein, 414 aa, Glycine max
  Coding DNA Sequence Number=SeqID_87003
  Gene Ontology: Mol. function=nucleoside transmembrane transporter activity; Cellular component=membrane; Biological process=transport
  Homolog annotation: Hit_ID=A5AZ51; Match level="QueryCoverage=97%, HitCoverage=99%, E-value=1e-179, Identity=77%"; Hit description =Putative uncharacterized protein
  Pfam annotation: Domain name=Nucleoside_tran; Domain location=113 -410; Score=72.6; E_value=1.3e-18; Accession=PF01733.9; Description =Nucleoside transporter
MVNSEVSTRLEGKYAAIVVCWLLGNGCLFSWNSMLTIEDYYGYLFPKYHPSRVLTLVYQPFAVGTLAILAYNEAKLNTRLRNLFGYILFFISTLLVLILNSATSGKGGLGTFIGICALSGAFGVADAHVQGGMVGDLSYMKPEFIQSFLAGLAASGVLTSALRLVTKAAFENSKDGLRKGAILFFAISTFFELLCVVLYAFIFPKIPIVKYYRSKAASEGSKTVSADLAAGGIRTLPGTEKEYTKDPERKGNKQLLLENIDYALDTFLIYMLTLSIFPGFLLEDTGSHSLGTWYALVLIAMYNVWDLIGRYIPLLKCLKLESRKLITITILSRFLLVPAFYFTAKYGDQGWMIVLTSFLGLSNGYLTVCVLTSAPKGYKGPEQNALGNLLVLFLLGGIFAGVTLDWLWLIGKGW

SEQ ID NO: 178689 - protein, 468 aa, Glycine max
  Coding DNA Sequence Number=SeqID_87004
  Gene Ontology: Mol. function=acyltransferase activity; Cellular component=cytoplasm; Biological process=paclitaxel biosynthetic process
  Homolog annotation: Hit_ID=Q69FA1; Match level="QueryCoverage=98%, HitCoverage=99%, E-value=1e-139, Identity=52%"; Hit description =Anthocyanin acyltransferase
  Pfam annotation: Domain name=Transferase; Domain location=10-460; Score=36.3; E_value=1.1e-12; Accession=PF02458.6; Description =Transferase family
MAQEMNEPAMNIIEQSQVAPPQGSLPSTIIPLTFLDIPWLLSRHARRIFFYDFPFPTTHFLQTALPILKHSLSHTLQHFFPFASNLILPPHPHVPYIRYLEGDSLSFTVAESSPADFTLLTSDSPRDSYDWQPLAPVLPSQRTSHDGTCEFPLMAIQVTMIPNSGFSICVIFDHVAGDGRTLHHFMKFWASVCKAKGDLDFPCSMPLPLYDRNIVKDPKGLMHVYMQDLRNSALLTKQFRGVLRGVYTDKVRATFIFSSEQAQKLKKWVSLKCNGSRTLHISTFVVTCSLIWVCMLRSEQKEKEGNNEPCNIGFSADCHNHPQFSLPSNYFGNCLIPLITRLKRGELVEQNGIVAAANAIEKKIRDFKSDALRWAETTMSDIRGLRKSGQSLVVIVGSPKLTAYNTDFGWGKPVKSEVVNLDSVGTVSLSDCRDQEGGIQVGMVLERIRMNNFTSILEEHLSHVAVLD

SEQ ID NO: 178690 - protein, 114 aa, Glycine max
  Coding DNA Sequence Number=SeqID_87005
MGLDLLNVPATMILRRYTYQPSWWHVPCDDDELCYLVFLADCRDSTPELSFPSRIRDFKSDALTKTETLMSEYRVMETRDKEGGIDVGLALDKSRMNSFTKILEEQLNIMACEE

SEQ ID NO: 178691 - protein, 141 aa, Glycine max
  Coding DNA Sequence Number=SeqID_87006
  Homolog annotation: Hit_ID=Q9SBR5; Match level="QueryCoverage=60%, HitCoverage=94%, E-value=1e-19, Identity=57%"; Hit description =Putative wound-induced protein
MSSATSKAWIVAASVGAVEALKDQLAKNVSSSSALVASKLKGDEKAKKAEESLRTVMRAWTVAISVGVVETLKDQGLCRWNSAFKSAQQSVKSHLRSLSQAKKLSSSSSAMLSSTLQHGEKAKHSEESLRTVMYLSCWGPN

SEQ ID NO: 178692 - protein, 83 aa, Glycine max
  Coding DNA Sequence Number=SeqID_87007
  Homolog annotation: Hit_ID=Q00M75; Match level="QueryCoverage=43%, HitCoverage=5%, E-value=3e-08, Identity=77%"; Hit description=PPR -repeat containing protein
MGSNPETASLHMQGTNPGTAVKLCLGDLLVMGSNPETASLHMQGTTELWSQPMKHGHFSPMPCPVSTCPCRVVSGVRVGVGAS

SEQ ID NO: 178693 - protein, 391 aa, Glycine max
  Coding DNA Sequence Number=SeqID_87008
  Gene Ontology: Mol. function=iron-sulfur cluster binding; Cellular component=mitochondrion; Biological process=lipoate biosynthetic process
  Homolog annotation: Hit_ID=Q3LSN4; Match level="QueryCoverage=96%, HitCoverage=95%, E-value=1e-166, Identity=79%"; Hit description =Putative lipoic acid synthase
  Pfam annotation: Domain name=Radical_SAM; Domain location=134-317; Score=51.3; E_value=3.3e-12; Accession=PF04055.12; Description =Radical SAM superfamily
  Subcellular localization annotation: CTP_CleavageSite=44; ConfidenceScore=5.19e-01
MMMHSRIRSVAGNIKCAARLFCSSSTITPAAAPSQLPQTLAGLRARLAEESPSLSDFVALKSDSAYSVEVGTKKKPLPKPKWMKEAVPGGEKYVQIKKKLRELKLHTVCEEAKCPNLGECWSGGETGTATATIMILGDTCTRGCRLNILSVKFVGRDILSMKFCNVKTSRTPPPPDPDEPTNVAEAIASWGLDYVVITSVDRDDLPDQGSGHFSETVQKLKALKPNMLIEALVPDFRGDADCVEKVAKSGLDVFAHNIETVEELQNFVRDHRANFKQSLDVLMMAKEYAPAGTLTKTSIMLGCGETPDQVVKTMEKVRAAGVDVMTFGQYMRPSKRHMPVSEYVTPEAFDKYQKLGMEMGFRYVASGPMVRSSYKAGWLVSVSQHPVGTNG

SEQ ID NO: 178694 - protein, 35 aa, Glycine max
  Coding DNA Sequence Number=SeqID_87009
MENIIEYSDENEEKLMDCNFNLDQVPMAGLILSRD

SEQ ID NO: 178695 - protein, 369 aa, Glycine max
  Coding DNA Sequence Number=SeqID_87010
  Gene Ontology: Cellular component=integral to membrane
  Homolog annotation: Hit_ID=A7PXD7; Match level="QueryCoverage=62%, HitCoverage=65%, E-value=4e-84, Identity=63%"; Hit description =Chromosome chr12 scaffold_36, whole genome shotgun sequence
  Subcellular localization annotation: CTP_CleavageSite=58; ConfidenceScore=5.46e-01
MATVSSPCTVFPILTSTLSKPHLAPLSCRTQKRSRVSIITSVAEDREIVPVSEDRGIRLNEVDGFQPSEPHTESDVVVPRLTSSSTVNAIIVLGFGTFAVTKLLTIDHDYWHGWTLFEIVRYIPEHNWIAYEQALKANPVLAKMAISGIVYSIGDWIAQCYEGKPLFEFDRTRVLRSGLVGFTLHGSLSHYYYQLCEALFPFQEWWVVPAKVAFDQTVWSAIWNSIYFVVLGLLRFESLTNIYGELKSTFLPLLTVYSREVIRVSLGFKFSCRVETLAFCASDYLWCDSCGTKASLGGLCGAHLGHNTFNVAIQMRNQKHEYLRQHQKQGHPLQAKIPRNKRNEERRKNYLGSWQLQNQPQQRFEESIS

SEQ ID NO: 178696 - protein, 51 aa, Glycine max
  Coding DNA Sequence Number=SeqID_87011
MYDKILKRSTKWMRKNVLEVPVLEDIHALKDEAVMYQKKEREIYGVMCSVS

SEQ ID NO: 178697 - protein, 325 aa, Glycine max
  Coding DNA Sequence Number=SeqID_87012
  Gene Ontology: Mol. function=hydrolase activity; Cellular component =extracellular space; Biological process=metabolic process
  Homolog annotation: Hit_ID=A7PWY7; Match level="QueryCoverage=99%, HitCoverage=99%, E-value=1e-111, Identity=61%"; Hit description =Chromosome chr12 scaffold_36, whole genome shotgun sequence
  Pfam annotation: Domain name=Abhydrolase_1; Domain location=53-318; Score=51.9; E_value=2.1e-12; Accession=PF00561.11; Description =alphabeta hydrolase fold
MENIQHSHVEVKGLKLHVAEIGSGQKALVFLHGFPEIWYTWRHQMIAAANAGYRAIAFDFRGYGLSEHPAEPEKANLLDLVDDVVGLLDSLSITKAVLVGKDFGAFPAYIVAALHPDKVDSVIMLGVPFMLPGPSAIQNLPKGSYVIKWQEPGRAEADFGRFDVKSVIRNIYTLFSGSEIPIAGDNQEIMDLYDPTTPLPPWFSEEDLATYASLYEKSGFRFALQFSSLGYFSNIISVNDPHRTLGVDSGISDPKITVPALLIMGEKDYVFKCFGMEDYIRSGAVKHFVPDLEIIYIPEGSHFVHEQFPEKVNQLIIEFLNKQSI

SEQ ID NO: 178698 - protein, 112 aa, Glycine max
  Coding DNA Sequence Number=SeqID_87013
  Homolog annotation: Hit_ID=Q304D2; Match level="QueryCoverage=95%, HitCoverage=28%, E-value=3e-38, Identity=75%"; Hit description =Uncharacterized protein At1g03687.1
  Pfam annotation: Domain name=DTW; Domain location=2-100; Score=-48.9; E_value=0.012; Accession=PF03942.6; Description=DTW domain
MRWNNHPRRIGFHDKAKSVWGDEDLSCISLNPGASAMHKLRPQPSWDRTCTAAAAAGLLSELQLLPQFSSVELEKQAEAVEHALTVLLDALTNRRLRMGRSITRKMRHTNIQ

SEQ ID NO: 178699 - protein, 212 aa, Glycine max
  Coding DNA Sequence Number=SeqID_87014
IPVEVDGHVMEDVSDAFGEEAKVGGLAPNEEVEGDVEKFAAAVVIGGVGFVIGEPDRGFGGEVVAPGGVVAEEFCAEGAEDGGVEGFGGRGEAHLGVGEVEDEVLALVANVVGLEPEEEGKPVQEVHTWLPFRGAEEVPDGVEGGGGGADLREAEGWMVGERGVEGDDVVGLNVVVVAISDRHVMGNVDPEEQGTLRWFREVFVYYYKVDFK

SEQ ID NO: 178700 - protein, 85 aa, Glycine max
  Coding DNA Sequence Number=SeqID_87015
MEQSLLRGESSDQSNRSRGIFRRSDAITYGSNYEKAAAFIDLVVSLLILLVRNSRATNLRRIFVLREMNRSRRCQNEEEDEKYQK

SEQ ID NO: 178701 - protein, 48 aa, Glycine max
  Coding DNA Sequence Number=SeqID_87016
MEEMEMSLNWDQNLMEEHISLTILGMFPNSFIGSTLSSIGQQTPIQYL

SEQ ID NO: 178702 - protein, 335 aa, Glycine max
  Coding DNA Sequence Number=SeqID_87017
  Homolog annotation: Hit_ID=A7P1N8; Match level="QueryCoverage=74%, HitCoverage=65%, E-value=1e-22, Identity=30%"; Hit description =Chromosome chr19 scaffold_4, whole genome shotgun sequence
SERNHICFRLEHLRHWQREWRNCMDRKGKILNQLHVALDDLCFMLNSLMLHGNKNFAEEKQILRNVNIQERDGASFKSLEMLKETVRCNDYLNNWQKLLREIEQFEIQCQRASGSGNAYVKGKISNSESLRKTIKDEIKVRCNDYLNNWQKLLREIEQFEIQCQRASGSGNAYVKGKISNSESLRKTIKDEIKHLCDDSSENKRKMIAPGIEVMHSEKELEAIDRLINSLETKLTERRQKKGQAYQSISKLKEFHDGEVIHYYQYSSLINKVHQLAKEKDVAALDEFSRSEVRKFMLEWNSNKAFREDYEKKVVQSLERRQLSRDGRRRQDKNST

SEQ ID NO: 178703 - protein, 66 aa, Glycine max
  Coding DNA Sequence Number=SeqID_87018
MIHVTLRNESKQITTKVKQFFRHAAQPPDKLRHVNVIKKCLEYRSGENKINEGDLALFNNNVSSRL

SEQ ID NO: 178704 - protein, 499 aa, Glycine max
  Coding DNA Sequence Number=SeqID_87019
  Gene Ontology: Mol. function=protein binding; Cellular component =nucleus; Biological process=regulation of transcription
  Homolog annotation: Hit_ID=A7PXM0; Match level="QueryCoverage=96%, HitCoverage=96%, E-value=0.0, Identity=68%"; Hit description =Chromosome chr12 scaffold_36, whole genome shotgun sequence
  Pfam annotation: Domain name=GRAS; Domain location=55-393; Score =267.2; E_value=3.4e-77; Accession=PF03514.5; Description=GRAS family transcription factor
MEKERYIKVTEIIILCPYSKSSGAGFHPAYAKNKVTSSQSHMKAELKGTTSISFQNPNTALFNTPHNNPLSGALKGCLGSLDGACIEKLLLHCASALESNDITLAQQVMWVLNNVASPVGDTNQRLTSWFLRALISRASRICPTAMSFKGSNTIQRRLMSVTELAGYVDLIPWHRFGYCASNNEIYKAITGFQRVHIVDFSITHCMQWPTFIDGLAKRPEGPPSLRITVPSCRPHVPPLVNISIHEVGLRLGNFAKFRDVPFEFNVIGNTEGPLTPAELSDESTSFHFEAMLSLLNPTMLNLREDEALVINCQNWLRYLSDDRKGISCQSFSLRDAFLNLIKGLNPRIVLLVDEDCDLSASSLTSRITTCFNHLWIPFDALETFLPKDSCQRSEFESDIGQKIENIIGYEGHQRIERLESGVQMSQRMKNVGYLSVPFCDETVREVKGLLDEHASGWGMKREEGMLVLTWKGNSCVFATAWVPCEILRDHHIGMDASLS

SEQ ID NO: 178705 - protein, 305 aa, Glycine max
  Coding DNA Sequence Number=SeqID_87020
  Pfam annotation: Domain name=RALF; Domain location=11-74; Score=6.9; E_value=0.004; Accession=PF05498.2; Description=Rapid ALkalinization Factor (RALF)
MAIMSKVVMGLVLCVLLVSAVLVQDAEASMVGHGAMQRDTFPGCSKRHPSNVACHLPIANDYRRDCEPGQRCRHQEAPKITCNTTTNITMLQFTCKSKLAGLAVIEDELGSFANLLHCQTMHLPFVYLGIPIAASPQSRNLASGHPKVQAKTLFVEAQELIHWMKDLSCQYESGACLEIFAKKFFVGEKEESRKIAWVLRSKYGEYNGKVREGHFMKGSKGWSGGTWGGVTKVRGQSHWFASKIKWLVGEGEELALPSDPASHEATLGSDSREQKKERKSIWSLWLYRNDIAFNNFNEGTDHGIG

SEQ ID NO: 178706 - protein, 586 aa, Glycine max
  Coding DNA Sequence Number=SeqID_87021
  Gene Ontology: Mol. function=transferase activity, transferring nitrogenous groups; Cellular component=cellular_component; Biological process=amino acid and derivative metabolic process
  Homolog annotation: Hit_ID=A7PJ83; Match level="QueryCoverage=99%, HitCoverage=99%, E-value=2e-97, Identity=59%"; Hit description =Chromosome chr12 scaffold_18, whole genome shotgun sequence
  Pfam annotation: Domain name=Aminotran_1_2; Domain location=40-575; Score=128.1; E_value=2.6e-35; Accession=PF00155.12; Description =Aminotransferase class I and II
  Pfam annotation: Domain name=Beta_elim_lyase; Domain location=83-291; Score=-111.8; E_value=0.0042; Accession=PF01212.12; Description=Beta -eliminating lyase
  Pfam module annotation: Pfam domain module=Aminotran_1_2::Beta_elim _lyase; Domain location=40-575::83-291
MENSSEKCNFEGNKELNASTITVGGIYDMLLDSINHEDTRSVVRLGRVDPTDNPLFRTTTVAVDAITRAVHSFNFNCYPPTVGLPEAKRAVADHLTSNLPHKIISPENVFLTIGGTQAIDIILPSLARPGANILLPKPGYPHYELRATRCLLEIRHFDLLPERGWEVDLDSLEALADENTVAIVFISPSSPCGNVFTYEHLKRVAEIASKLGIFVISDEVYAHVTFGSKPFVPMREFSSIVPVITIGSFSKRWFIPGWRIGWIALCDPQGIFQKTGIVTKIIDNLEITSDPTTIVQGVCYFTTKRLPEKRVPPERDTWLDWTGRCDRGGRACLSGATSRAYLPGATSSGRAPGATTSGSLTGTSTSAELKRVKALYTGKYIALQICDDEDVETMIQSFEQQQEMPVIELCVEVDVAGNKDVSGAPPLVEVPARLPLVVAPGALPLLVAPGSQATCRVLVERAPQASIPGILEKTTDDFHSNNLNILREAANIFYDGCKEIPCLTCPHKPEGAMVVMVEINFSQLEGIVDDVQFCTKLAKEESVILFPGVAVGLKNWVRVSLAVDLSDLKDGLSRIREFSLRHAKMS

SEQ ID NO: 178707 - protein, 133 aa, Glycine max
  Coding DNA Sequence Number=SeqID_87022
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A7PJD9; Match level="QueryCoverage=71%, HitCoverage=54%, E-value=1e-25, Identity=52%"; Hit description =Chromosome chr12 scaffold_18, whole genome shotgun sequence
  Pfam annotation: Domain name=X8; Domain location=2-87; Score=126.2; E_ value=9.4e-35; Accession=PF07983.4; Description=X8 domain
EVWCVAKNNAEDAALQSAVEWACGAGGADCGAIHGGGPCFDPSNMQNTASYAFNDYFRKHAISEENCNFGNNAAITSFNPSFGNCKFPSSLLVNNGSFSGSASSMGTMSGEDTSGYSGVVWNWSGYAQLLPNL

SEQ ID NO: 178708 - protein, 138 aa, Glycine max
  Coding DNA Sequence Number=SeqID_87023
MVGTFTLRHGESNKENIPPGCTKLETKKNPIPLMAQQSFKRKMKRLPLADITNLVNNSAQELNQLHGFGVSALSSASVLLHSISRRRTTPVLHRLQAKKRQENSKNMKKPQRKMRSARMQTFSLSGKKRAKRKNTHWR

SEQ ID NO: 178709 - protein, 312 aa, Glycine max
  Coding DNA Sequence Number=SeqID_87024
  Gene Ontology: Mol. function=protein domain specific binding; Cellular component=melanosome; Biological process=intracellular signaling cascade
  Homolog annotation: Hit_ID=A7P1Z4; Match level="QueryCoverage=78%, HitCoverage=95%, E-value=1e-102, Identity=76%"; Hit description =Chromosome chr19 scaffold_4, whole genome shotgun sequence
  Pfam annotation: Domain name=14-3-3; Domain location=7-233; Score =414.3; E_value=1.8e-121; Accession=PF00244.11; Description=14-3-3 protein
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYELLLKRSFLFRILYPFIPYLTQILNSPERACHLAKQAFDEAISELDTLNEESYKDSTLIMQLLRDNLTLWTSDIPEDGEDAQKVNGTAKLGGGEDAEVSNPFYTCTLSPMDDGIFHRIRCMRLGMKHEGRLLICVLARDRDSIVSSLFPVGLPNTSR

SEQ ID NO: 178710 - protein, 68 aa, Glycine max
  Coding DNA Sequence Number=SeqID_87025
MDLENSLRICRFEYEFRCHSLEYQESNLFVVAASVTSKFKTSGLDLIMIPLVAVHESHSPLCLPFLFD

SEQ ID NO: 178711 - protein, 822 aa, Glycine max
  Coding DNA Sequence Number=SeqID_87026
  Gene Ontology: Mol. function=protein serine/threonine kinase activity; Cellular component=myosin complex; Biological process =regulation of transcription
  Homolog annotation: Hit_ID=A5B803; Match level="QueryCoverage=34%, HitCoverage=99%, E-value=1e-107, Identity=57%"; Hit description =Putative uncharacterized protein
  Pfam annotation: Domain name=Pkinase; Domain location=124-276; Score=- 43.1; E_value=4.9e-06; Accession=PF00069.16; Description=Protein kinase domain
  Pfam annotation: Domain name=Pkinase_Tyr; Domain location=124-276; Score=-16.5; E_value=2.2e-11; Accession=PF07714.8; Description =Protein tyrosine kinase
  Pfam module annotation: Pfam domain module=Pkinase::Pkinase_Tyr; Domain location=124-276::124-276
MNETLKQNRLLRERGDDNSFPNSPNNSSSDANLQKNVSNFHLDGHDERSALYSFQRDQGTSQKAMSLPSSPHDYRGQASERSGPSRYGVNDEMESTWNKVLESPMFNNKPLLPYEKWNIDFSELTVGTRVGIGFFGEVFRGIWNGTDVAIKVFLEQDLTAENMEDFCNEISILRIMTESPMRDSSSAGTPEWMAPELIRNEPFTEKCDIFSLGVIMWELCTLNRPWEGVPPERVVYSVAHEGSRLEIPEGPLGRLISECWAECHQRPSCEEILSRLVDIEYSFILSSLPRKSFSPLFSLPRKQASLAVFFSARLLRLHLLREASLFHLHSRIEDAGKNGGSLVTMSLPEDPLGVLPELPEEDLPEDFRKKGSSGTLGTPLPEDVLLPETFRKRVLPDDLSMVPEALFGRPSFRNVFGRSTSSRINGYLPEEVSSGNIPNDVLPEKKVFRNDSGRTFFQKKNSRKTISPLFAGCPNNKPGPTELTVSPNHHHHRQSKTKPPTPASTMDSIAGAPPHADVTPPPPRQSPFPGREDCWSEEATFTLIEAWGQRHLELNRGNLRQRHWQEVADAVNARHGHVSTKARRTDVQCKNRIDTLKKKYKIEKARVSDSGDSATTWPFFRRLDFLIGDNFPAKKPSPPATAGITRRSTPPAKSPPWAVIPVGPRSGTKKRPAAAKPASASPDSVANSYFRRNFSVFAAAAAAAAAAAADSENSNGSKWSSGSEKGTMKKKRTRGDWEFGYREMAEALEKFGEIYERVEGAKQRQMVELEKQRMQFAKDLETQRMKLFMETQVHLQKINRSKRSSASGLLLASLFLSCQFLK

SEQ ID NO: 178712 - protein, 207 aa, Glycine max
  Coding DNA Sequence Number=SeqID_87027
  Gene Ontology: Mol. function=DNA binding; Cellular component=nucleus; Biological process=regulation of transcription
  Homolog annotation: Hit_ID=A7PJI1; Match level="QueryCoverage=37%, HitCoverage=47%, E-value=1e-33, Identity=92%"; Hit description =Chromosome chr12 scaffold_18, whole genome shotgun sequence
  Pfam annotation: Domain name=Myb_DNA-binding; Domain location=94-145; Score=45.2; E_value=2.2e-10; Accession=PF00249.22; Description=Myb -like DNA-binding domain
MDETICVSEEDHHKSGSSSKPSSPTLRRKRSFFDLNEEAVDGGGDDSTSDDDGLMTSNGISSQEGNLSSNNSSSEEGKERASTVRQYVRSKMPRLRWTPDLHLAFVHAVERLGGQERATPKLVLQLMNVKGLSIAHVKSHLQMYRSKKLDESGQVLPHNRAMQGRHSIFDMYGRLNAPRHFGNDNRNYLPSSLLLEQRPYESGHGSS

SEQ ID NO: 178713 - protein, 100 aa, Glycine max
  Coding DNA Sequence Number=SeqID_87028
MTPKLLAFNKDLELECPGGVVLSIKTNKEDIISFSRHDAEKKSQEEKKQETGKIKNRTRINMNSATREQYHDVNNPHANNTAQETRTGNSETRSAAKEKN

SEQ ID NO: 178714 - protein, 461 aa, Glycine max
  Coding DNA Sequence Number=SeqID_87029
  Gene Ontology: Mol. function=transferase activity, transferring glycosyl groups; Cellular component=integral to membrane; Biological process=metabolic process
  Homolog annotation: Hit_ID=Q53UH2; Match level="QueryCoverage=95%, HitCoverage=94%, E-value=1e-122, Identity=50%"; Hit description =Glucosyltransferase
  Pfam annotation: Domain name=UDPGT; Domain location=1-461; Score= -171.8; E_value=0.06; Accession=PF00201.9; Description=UDP -glucoronosyl and UDP-glucosyl transferase
MENAPPNPMHIAMYPWFAMGHFIPFLHLSNKLAKRGHKISFIVPKRTQTKIQHLNQHPHLITLVPITVPHVDGLPHDAETTSDVLFSFFPLLATAMDRIEKDIELLLRELKPQIVFFDFSFWLPNLARSLGIKSVQYFIVNAVSVAYFGSPERYHNGRDLSETDFTKPSPGFPDSSITLHEHEAQFVVRMGKVEFGSGVLMYDRFDIGTRLSDAIGFKGCREIEGPYVDYLETQHGKPVLLSGPLLPEPPNTTLEGKWVKWLEEFNPGSVIFCAYGSETTLQQNQFLELLLGLELTGFPFLAALKPPNGFESIEEALPEGFRERVQGRGVVYEGWVQQQLILGHPSVGCFITHCGAGSITEALVSECQLVFLPRLGSDYVITARMMSRELKVGVEVEKSEEDDGSFTKESVCKAVKIVMDDENELGRQVRENHRKVRNILLSNNLESFHVDILCDKLRALL

SEQ ID NO: 178715 - protein, 569 aa, Glycine max
  Coding DNA Sequence Number=SeqID_87030
  Gene Ontology: Mol. function=sequence-specific DNA binding; Cellular component=nucleus; Biological process=regulation of transcription, DNA-dependent
  Homolog annotation: Hit_ID=A7QUM2; Match level="QueryCoverage=95%, HitCoverage=68%, E-value=9e-99, Identity=40%"; Hit description =Chromosome chr10 scaffold_179, whole genome shotgun sequence
  Pfam annotation: Domain name=START; Domain location=29-267; Score =86.9; E_value=6.5e-23; Accession=PF01852.10; Description=START domain
MDSTSNERARDLFMGFSIFTEPMKTEIIEHARSAMEELLKIGTAGHLLWKPQPKDRYDILNQIEYMRQFGQVDSTLNSPTFATYQTEQPASMETPTVALQTEASRDMAFINMSPISIVELLMDVNEWSSAFYNIVSKATIVGTLLGAQGSYNDKLHVMSAELHLPSTTVPIREYYFGRYSKKFSHNIWGIVDISLEKFIPSPTSNLLKRPSGCLISGMANGHSKVAWVEHVEADHSHLDNYFKPLVASTLAFGASRWLNSLNRYGEWLQTLRATTFVADEGVLIPQTGRTSFLKLGDRMMKTFCANVSATADNPWMKITSFHGDSDVKVMIKNNVEDTAMPPGTSAVFTTSVWLEVSPNRLFNFLRHENSRTKTNLIMMASIKLNVMPFIVPHVLTCLFVDFVEKLQWDMLSHRLVIRKVASIPKGENPGNCVSLLRANTSQGKLQIFYLQESYTDSTGSYVVYAPLDESAITAIVKGTNPDRVMILPSGFSILPGRLQGDEDRGTTGSLLTVAFHVFESVTNKSHILPEYIHTMRKVITDTVTSIKDIVQYHNRPNNWMEDSDFLVRF

SEQ ID NO: 178716 - protein, 208 aa, Glycine max
  Coding DNA Sequence Number=SeqID_87031
MVYCFVFWFALVLLVFVFCVLFFLPAMLLYSMVISVKNSYGLAIQCHALIRRHHVGPTSMRNWSSFLRLCLIFGEVSKVHTIRWKDVLETVWHLVDKDGNYHSVVYNKDLDQPVIVVGWTALRDFYQLTGDHLVFLTHYDSVTFKVYLTQQKVIAVWTFQAACIILLKTKTELICTWRTLQNVGLCSIIGGRHLKLESDGNIYVRPYP

SEQ ID NO: 178717 - protein, 35 aa, Glycine max
  Coding DNA Sequence Number=SeqID_87032
MGMEEEGRWIRREEMALERALVSLKFMRHRAKRDI

SEQ ID NO: 178718 - protein, 94 aa, Glycine max
  Coding DNA Sequence Number=SeqID_87033
MGGVILRCWLVVGERNAPPDRRLHCARDTAGSAPDAGAFGSAQGSGTTGGVPAAGATTSAGQPGAYPPASSSHTPSLFPHPPKILYFLYCLSKI

SEQ ID NO: 178719 - protein, 259 aa, Glycine max
  Coding DNA Sequence Number=SeqID_87034
  Gene Ontology: Mol. function=zinc ion binding; Cellular component =intracellular; Biological process=regulation of transcription
  Homolog annotation: Hit_ID=A7Q3B8; Match level="QueryCoverage=27%, HitCoverage=98%, E-value=5e-30, Identity=80%"; Hit description =Chromosome chr12 scaffold_47, whole genome shotgun sequence
  Pfam annotation: Domain name=zf-B_box; Domain location=1-45; Score =38.3; E_value=2.8e-08; Accession=PF00643.15; Description=B-box zinc finger
MKNCELCKLPARTFCESDQASLCWDCDAKVHGANFLVERHTRTLLCHACQSPTPWKASGAALGNTVSLCERCAGGTTEQGQESQGGNDDDIDTDIDTDDEDDYDESEDEVAADEEDGDNQVVPWSSEPPPPAPSSSSSEESVSRCNNVDEVSTTLKRRRQEDNDFQGWNSNNWGCERSEVERGGWLVRLRRRTADDVAVEQRSARAASPDGCCGDRASEDSATKKEKSVCENAMSRVRHAAKPVALESKNSACEEVASM

SEQ ID NO: 178720 - protein, 38 aa, Glycine max
  Coding DNA Sequence Number=SeqID_87035
MAHTFGKGFRYPFQPMIPLGAILAIVDPVVIGIVEKPE

SEQ ID NO: 178721 - protein, 98 aa, Glycine max
  Coding DNA Sequence Number=SeqID_87036
MGKHNNSGWERYFNWKRPLFDSEIGMAITFLSEVEAKPIHNYGSDSWDWAADPWGIYSTNSAYSMFWEEAAVDSLEECFEELWKIKIPSKIAVFTLID

SEQ ID NO: 178722 - protein, 70 aa, Glycine max
  Coding DNA Sequence Number=SeqID_87037
MEEGKGVVEKEANGSAGTEAEEGEGNDGREHSTNISKEVWGTEIEDMMTMGTGTTTMVTMETMTTMRGEI

SEQ ID NO: 178723 - protein, 39 aa, Glycine max
  Coding DNA Sequence Number=SeqID_87038
MVANDRLRMLNILHRSFRHDHHRIVIILRSSCLNDRLRM

SEQ ID NO: 178724 - protein, 67 aa, Glycine max
  Coding DNA Sequence Number=SeqID_87039
MSLPPSSPVASSRRHRLLEEHPGRPKMLRNLTDWVTMLPFDFWHVMELYVLCNNGCQVPRSGRAKVA

SEQ ID NO: 178725 - protein, 116 aa, Glycine max
  Coding DNA Sequence Number=SeqID_87040
MPATRHPLDPDKSNRALGFPALITGLFQSFGIPVTPSKVIRPPITRAFIEKYCTPRQAQDDAHQAADAPPPPRQADPAGSLGMEREEPAGSPGEAEEARMDEEMTDLLGFLGGSGA

SEQ ID NO: 178726 - protein, 200 aa, Glycine max
  Coding DNA Sequence Number=SeqID_87041
  Homolog annotation: Hit_ID=Q1S5K3; Match level="QueryCoverage=34%, HitCoverage=17%, E-value=2e-07, Identity=41%"; Hit description =Ribonuclease H
MADALATLASMFQLIPHGDLPYIEFRCCNKSIHCCLIKEEQVGKPWYFDIKRYIKDKEYPREASDNDKRINKANNNALGQTPTSLRESAESISVERFPSVWDFNGENGGLWWLMVVVGDGESAWDVRNGFGRKKEEMVFFLSYTKAKAENAYVRNGLGHGNVTLGSIFTEAAHVASSRSFIKRLPRGFFEKLSEEASLRS

SEQ ID NO: 178727 - protein, 143 aa, Glycine max
  Coding DNA Sequence Number=SeqID_87042
MPLKRNGSEETPNQEVEKRCRWIWMTLLLSNIFPNDHSSDLPLLKCYLVYAILTQGPGVPGVDHVPLPILWSIGYSHQAHLASHQQSLRREILHAQAGAGSGTATAQGGSAATSYRCTAAISIGGTISGVHLRSPVEVRAPDA

SEQ ID NO: 178728 - protein, 107 aa, Glycine max
  Coding DNA Sequence Number=SeqID_87043
MSEFTSDYPSQILANLYCLDLPFGGRATRGLTGEKREVVTTQLAQASSACPSELGCFHQKAPPFAGTPGWPKWAWLLFAHPFLLNTPPFAFFLLISFPKRYGTSRIT

SEQ ID NO: 178729 - protein, 147 aa, Glycine max
  Coding DNA Sequence Number=SeqID_87044
LHPGNHFNKDQGGPSNRPPQQGPDIFQRTTKLEETLTQFMQVTMSNDKSTELALKNLEIQVGQLAKQLAEKSSNSFGANTEKNPKEECNVVMTRNKKCLADEDEDSVALEKQIFVKDGTKKKEEEVTDVTNQESEKPIMVEEKEIND

SEQ ID NO: 178730 - protein, 298 aa, Glycine max
  Coding DNA Sequence Number=SeqID_87045
  Gene Ontology: Mol. function=4 iron, 4 sulfur cluster binding; Cellular component=integral to membrane; Biological process=protein -chromophore linkage
  Homolog annotation: Hit_ID=O78507; Match level="QueryCoverage=100%, HitCoverage=50%, E-value=5e-99, Identity=51%"; Hit description =Photosystem I P700 chlorophyll a apoprotein A2
  Pfam annotation: Domain name=PsaA_PsaB; Domain location=1-298; Score =87.6; E_value=4e-23; Accession=PF00223.10; Description=Photosystem I psaApsaB protein
HLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHKEIIIQNRMKINVLARMLAHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLVHHAIALGLHTTTLILVKGALDARGSKLMPDKKDFGYSFPCDGPGRG

SEQ ID NO: 178731 - protein, 241 aa, Glycine max
  Coding DNA Sequence Number=SeqID_87046
  Gene Ontology: Mol. function=succinate-CoA ligase (ADP-forming) activity; Cellular component=hydrogenosome; Biological process =metabolic process
  Homolog annotation: Hit_ID=P0A838; Match level="QueryCoverage=100%, HitCoverage=62%, E-value=1e-111, Identity=83%"; Hit description =Succinyl-CoA synthetase beta chain
  Pfam annotation: Domain name=ATP-grasp; Domain location=4-127; Score=- 86.3; E_value=0.095; Accession=PF02222.13; Description=ATP-grasp domain
  Pfam annotation: Domain name=ATP-grasp_2; Domain location=2-203; Score=449.4; E_value=4.8e-132; Accession=PF08442.1; Description=ATP -grasp domain
  Pfam annotation: Domain name=GARS_A; Domain location=8-122; Score= -121.0; E_value=0.097; Accession=PF01071.10; Description =Phosphoribosylglycinamide synthetase,
  Pfam module annotation: Pfam domain module=ATP-grasp::ATP-grasp _2::GARS_A; Domain location=4-127::2-203::8-122
MNLHEYQAKQLFARYGMPAPTGYACTTPREAEEAASKIGAGPWVVKCQVHAGGRGKAGGVKVVNSKEDIRAFAENWLGKRLVTYQTDANGQPVNQILVEAATDIDQELYLGAVVDRATRRVIFMASTEGGVEIEKVAEETPHLIHKMALDPLTGPQPYQGRELAFKLGLTGKQVSQFTKIFMGLATMFLERDLAMVEINPLVITKQGDLDLSGWQLGADGNALFRQPELREMRDPAREDPR

SEQ ID NO: 178732 - protein, 85 aa, Glycine max
  Coding DNA Sequence Number=SeqID_87047
  Homolog annotation: Hit_ID=Q84VH5; Match level="QueryCoverage=51%, HitCoverage=6%, E-value=1e-14, Identity=95%"; Hit description =Envelope-like protein
ESCCFSAVSKDALIAELKDTCKVLEATIKANTEKKMELERLIKRLSESGIDDEEAAEEEGEAAEEEEEAAEEEEDADPFRRDRIR

SEQ ID NO: 178733 - protein, 126 aa, Glycine max
  Coding DNA Sequence Number=SeqID_87048
MDISKDTDIPIILGRSFMLTASCIVDMGKRKLELSFEDQKIDFDFFVEDKPAPEHNVCLQRLLLAKCIIVYAVSHEFQALSAQPWHLRLTNSVKLTELSDRLIAERWLPFAKRDLVSPSAIHYSQN

SEQ ID NO: 178734 - protein, 89 aa, Glycine max
  Coding DNA Sequence Number=SeqID_87049
  Homolog annotation: Hit_ID=A0PAV3; Match level="QueryCoverage=42%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGASHSPFSCATVGKGDRCGPLRYYASWRKGDVLQGD

SEQ ID NO: 178735 - protein, 131 aa, Glycine max
  Coding DNA Sequence Number=SeqID_87050
MFHCIIIQVNIISVEAKLHDESRLIQRCFDDNKDDDKGDDKKLKGQSKNEFKVFKIESRTLQDSREKLNSRIKNQDSRIKLQESRSRFKTQESREELIKISMKRFFQKLSSTWIFLKTCLPKSFYSLVIDY

SEQ ID NO: 178736 - protein, 18 aa, Glycine max
  Coding DNA Sequence Number=SeqID_87051
MPISPCEVSVGLCRPDIG

SEQ ID NO: 178737 - protein, 103 aa, Glycine max
  Coding DNA Sequence Number=SeqID_87052
MTLLLSNILPSDRNANLPLQMYRDRAHKTPSGPEEVQQGPGVSSSGIAPARHPVDLKKSNRVLELSSSNYGKGIRPPTDRAFIKKYCVPRQAQGETPQQHWDG

SEQ ID NO: 178738 - protein, 494 aa, Glycine max
  Coding DNA Sequence Number=SeqID_87053
VARAKRRPHGLNAIRCGMHKAKLALLTKPLWHPGKGRALLLSHRLSMIPGDSNPWNIDNIMDRRILPERNVKIYHTEFDEFKEELERRNLHKCLTNLQEGSIDVAMVKEFYDKLYNSEDQVPKCARVRGRMIKIDADSLNEFLQTPVLLEDGESLPTYSDFGQPWKLLKQDLTTLAQTWSLFSYSNLAPTSPTSDLNMDRARLVYGLVIGMDMNICGLISGHITIMAQSNSSRLGFPALITALCRSMGVGSDALTSYKSLRPVINSAYIKRKCWNVNDQTVNLPEARKTKSKADDVPFSPASTAPSAQISQTSDAKLQSLFEGQIFIMQSLQELAHQRPIMSVEQFIEQVAWPRARPSFVSDNGSSTAQTPQQQKLEPEPENDQSSEATVPRAFDVSEGRSQIRSDEAAYPDPVPVPADPPSLVVDPSSLTPEAALPSIPIIISDDPTVQAPGLAPTPPATPELQFSYEEGRRVTTPPGTSVLHFDDEEQDRDE

SEQ ID NO: 178739 - protein, 103 aa, Glycine max
  Coding DNA Sequence Number=SeqID_87054
MWLVVQTSLVASGQSTICCKLFSSSVLSIGCRETPPIEDLHLLDSIVGAHHSCVGYSISSRTVGGAWGVLDLVYMRAGHVKEVLIHHIVVARSRTAAISLCYG

SEQ ID NO: 178740 - protein, 329 aa, Glycine max
  Coding DNA Sequence Number=SeqID_87055
  Homolog annotation: Hit_ID=Q84VH5; Match level="QueryCoverage=91%, HitCoverage=55%, E-value=1e-104, Identity=83%"; Hit description =Envelope-like protein
SGRIKTIAQKKSTPITPTTSRWSKVAIPSKKRKEISSSDSDDDVELDVPDIKRAKKSGKKVPGNVPDAPLDNISFHSIDNVERWKFVYQRRLAVERELGRDALNCKEIMDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKAFCREANQHPNILNNIDSVKKRESPLSLHYKLFEGTHVPDIVSTSGKAAASGAVSKDDLIAELKDTCKVLEATIKANTEKKMELERLIKRLSDNGIDDGEAAEEEEDAAEDTESDDDDSDATP

SEQ ID NO: 178741 - protein, 140 aa, Glycine max
  Coding DNA Sequence Number=SeqID_87056
MSNHKSTESALKNLEVQVGQLAKQITDKSSNIVMTRSKRFVEAEDEDSVVHKKKTADKKGTDGKKNEVRGESNQEKEEQIMVKNKELKDQEKEKEVEKEIENEKMKKKKKIIRMQRRVEVKKLWMKVWKYHILWYLPRKK

SEQ ID NO: 178742 - protein, 110 aa, Glycine max
  Coding DNA Sequence Number=SeqID_87057
MFCIVICLTSSSKKGCGGASTVGCFWGCCCCWIGGGIISFGLLNCSRLLHGRAKVCMVVSRGAQTTNPCKRYKFLVQGQLGYQVSQCIQFAFNFLVSDDADGFVATSCTL

SEQ ID NO: 178743 - protein, 114 aa, Glycine max
  Coding DNA Sequence Number=SeqID_87058
MASRRTAQYDTRRFQSLEAWNRFTDNILGRNIILERNVKIYYTEFDEFKVELERRNLHKHLTNLQDGSIDVALVVEFYANLYSPEEPTPKQARVREHLIKIDADSLNEFLQTPV

SEQ ID NO: 178744 - protein, 90 aa, Glycine max
  Coding DNA Sequence Number=SeqID_87059
  Subcellular localization annotation: CTP_CleavageSite=65; ConfidenceScore=5.33e-01
MASYGGELLLDSSSPRSGISNHLSSFSIPLPFMFKKQRTPFDAILPRKGPVTRAMSKRLQEDWARAAEEGPRVLLNLRVGYPRNIGFFSP

SEQ ID NO: 178745 - protein, 98 aa, Glycine max
  Coding DNA Sequence Number=SeqID_87060
MALRKLSAKRSRKDAVTEGTSAAPEFDSHRFRSAEHQQRFEAIKGWSFHRERRVQLRDDEYTDFQEEITRRRWTSLLQWGPLMVIFHHGDAAEDKGKE

SEQ ID NO: 178746 - protein, 99 aa, Glycine max
  Coding DNA Sequence Number=SeqID_87061
MAAQLIRDRVEMECLEGAWETLEGNTRYEPARTLQRTVEWILPTPTPYRLVEPVQVIERVMRIHFLRWILPEEVMSASEADSTEDSGPREMAISGGSSS

SEQ ID NO: 178747 - protein, 37 aa, Glycine max
  Coding DNA Sequence Number=SeqID_87062
MEDKMQRRIKDKRWEEAPSTKEYAMEGGASPPKECLG

SEQ ID NO: 178748 - protein, 80 aa, Glycine max
  Coding DNA Sequence Number=SeqID_87063
MSNLLSVFSNDSLEDQASQGSFAAHGCQNVLIAAIGQPEHPGYMRAAGAGVTIKKYFGPAPRTSSTSSSMAPEDLGQLPQ

SEQ ID NO: 178749 - protein, 104 aa, Glycine max
  Coding DNA Sequence Number=SeqID_87064
METCLVVEDLLQQMIDRGRLEVGDEGSEEQHICMQSADERSFGRPKPMVLCSSVEVCTSKRKEGRGHRYQLVASQGNQYHGVERRDPQRSRVCTPLPADTTHKR

SEQ ID NO: 178750 - protein, 274 aa, Glycine max
  Coding DNA Sequence Number=SeqID_87065
MGRPLEGRKPYLFSRFYPSMARVAKVVKISAQELDRVKTNRNGVVGLPRKSLEEKAKALADQGEWTSFIDILALLVFETILFPNVDRLMGLVAINAFLAYHHSKESPIVAILADAYDTFDLRCEKSSTRIICCTPALYVDLSVLYKVIACAPKREKQIGRNSWQGFVTFRKGMCKILKRRAKRGPERRRKKRKKEERRENKAKMLLNCICDRFLHRSVEAKLSKFILMMPKTQVKNQESDKFQESKSRSIKNQDSSEDLREDSRLARTSRKTSR

SEQ ID NO: 178751 - protein, 141 aa, Glycine max
  Coding DNA Sequence Number=SeqID_87066
VLQVLQVDPCPCSWSCPHHEGTSQVTTPRALKNIDSMSLEELVGTLKVHEQELQQDKGTKREKSLALSSQKNKKALSSREQVSRSLSKDLKADDSSDEFEEDEFTFISRKAAKYGETKVAPSEKTAQEECLKKKKIKKRAP

SEQ ID NO: 178752 - protein, 107 aa, Glycine max
  Coding DNA Sequence Number=SeqID_87067
  Subcellular localization annotation: CTP_CleavageSite=81; ConfidenceScore=5.00e-01
MWLRVLNNLRFWDSWFMIPNAFLHIQAQSSQRFPTTVSVIVGNTGAKKGKVHGAYLDGGRTNLLNDRCSSQKLPCSTTATMAATSSTKKKKRHKEDAQGIKKKTPKE

SEQ ID NO: 178753 - protein, 711 aa, Glycine max
  Coding DNA Sequence Number=SeqID_87068
  Gene Ontology: Mol. function=phosphoenolpyruvate carboxykinase (ATP) activity; Cellular component=cytoplasm; Biological process =gluconeogenesis
  Homolog annotation: Hit_ID=Q94LX8; Match level="QueryCoverage=98%, HitCoverage=97%, E-value=0.0, Identity=77%"; Hit description =Phosphoenolpyruvate carboxykinase
  Pfam annotation: Domain name=PEPCK_ATP; Domain location=207-658; Score=1109.6; E_value=0; Accession=PF01293.11; Description =Phosphoenolpyruvate carboxykinase
MPTSDNAGNGNGLAKIQQLGDNEEGRPTVKAQTIDELHSLQKKKSAPSTPKGSLPTSASVFTEEERNKQQLESIRFPKSRSRTCDSYFTPDDPLLQEISFKFAKRRSRCRHRGTCRTVPTNQGSNSRCPSRGRGARWHEGSESCLASLTKCCGVGVVIASLASLTRESGPKVVKGDPAARKYEASRVEHVPHQILTPTIAVSDSALKFTHVLYNLSPAELYEQAIKYEKGSFITSTGALATLSGAKTGRCPRDKRVVKDEVTENELWWGKGSPNIEMDEHSFMVNRERAVDYLNSLDKVFVNDQFLNWDPENKIKVRIVSARAYHSLFMHNMCIRPTTEELENFGTPDFTIYNAGQFPCNRYTHYMTSSTSIDLSLARKEMVILGTQYAGEMKKGLFSVMHYLMPKRKILSLHSGCNMGKGGDVALFFGLSGTGKTTLSTDHNRYLIGDDEHCWSESGVSNIEGGCYAKCIDLSRENEPDIWNAIKFGTVLENVVFDEHFREVDYTDKSVTENTRAAYPIDYIPNVKLPCVGPHPKNVILLACDAFGVLPPVAGTEEGIKEPQATFSACFGAAFIMLHPTKYAAMLAEKMQNHGATGWLVNTGWSGGSYGCGSRIKLSYTRKIIDAIHSGSLLDVEYKKTEIFGLEIPTEVEGVPSEILEPENTWSDKQAYKETLLKLAGLFKNNFETFTYGENNQVTKEILAAGPIIHDA

SEQ ID NO: 178754 - protein, 226 aa, Glycine max
  Coding DNA Sequence Number=SeqID_87069
  Homolog annotation: Hit_ID=A5BQD7; Match level="QueryCoverage=72%, HitCoverage=18%, E-value=6e-09, Identity=26%"; Hit description =Putative uncharacterized protein
  Pfam annotation: Domain name=zf-CCHC; Domain location=31-48; Score =16.7; E_value=0.0045; Accession=PF00098.14; Description=Zinc knuckle
MVRKFGKFHKSKDRKFSKCSKKIENNNKNNFTCFEYGKQGHIKYECPIYLRKHVGEKKGKKDKKQKKAYIAWEDNVSTTSDSSSHEEVENVCLMAKSMDNSSTFEETEVNPKLEEVLEAFNEMHQEAQRLDVLNKKLKSDLKLHITKLASTQSELDKLKQENEKLVSNYKATDCDCTSTSFNMNDYKSLQTEFENFKKDHCAEHMKLQTELSYLKDLFGKLKQRKE

SEQ ID NO: 178755 - protein, 363 aa, Glycine max
  Coding DNA Sequence Number=SeqID_87070
  Gene Ontology: Mol. function=phosphoribosylaminoimidazolesuccinocarbox amide synthase activity; Cellular component=cytosol; Biological process=purine nucleotide biosynthetic process
  Homolog annotation: Hit_ID=Q8PQ58; Match level="QueryCoverage=45%, HitCoverage=53%, E-value=5e-80, Identity=87%"; Hit description =Phosphoribosylaminoimidazole-succinocarboxamide synthase
  Pfam annotation: Domain name=SAICAR_synt; Domain location=186-363; Score=40.0; E_value=1.7e-13; Accession=PF01259.9; Description=SAICAR synthetase
RTGGDDVVDFLAEAGEVGGENGRGDEAVGHGRGLRNGERILPPAGGTVGSALAQGLDAVVGGVDPPRLLLGLLLQLGGGTAQLVGVVLRDQLAIGALYLGIGGLGGQPQLPVRVLLVQAEPVRVEGMADQQADHRAKQRIGPEQQGAGDESEQFSVPAHGAPGSTDEMDAHFTSARANHAVAIRSPRPALAPSRQGTPPGDYLLMVATDRLSAFDVVLPDPIPGKGEMLCQVSNFWLTKSAHLMPNHLTGIDVASVLPEGVDPALYAKRAVVTRKLKPVPVEAIARGYLIGSGWKDYQRTGKVSGIDLPDGLRQTEQLPEPIFTPSTKAAVGIHDENIDFDAMVKQVGADLTENMRDATLRIY

SEQ ID NO: 178756 - protein, 97 aa, Glycine max
  Coding DNA Sequence Number=SeqID_87071
MVWVKPLATSLALYLSIDPSALYLIVNTHLHPTVVFPLGDDKKLKDQSKNNSSESRTIQEFKNQEESLESRIKIQGSRIKIKIQDSRFKNAEKTQSR

SEQ ID NO: 178757 - protein, 259 aa, Glycine max
  Coding DNA Sequence Number=SeqID_87072
  Homolog annotation: Hit_ID=A5ATL8; Match level="QueryCoverage=33%, HitCoverage=68%, E-value=6e-20, Identity=65%"; Hit description =Putative uncharacterized protein
RTPVEYEAPGYKLCLGMEENSESALSTNKEAISNATRNLMESSILAQDERWRHALHMQVGREVVFPVADGHTGTETRPRLLREAAVGIFRNGRKPDGAMPREGRRPTVRRQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSREGELTPKTRPQFGL

SEQ ID NO: 178758 - protein, 415 aa, Glycine max
  Coding DNA Sequence Number=SeqID_87073
  Gene Ontology: Mol. function=transferase activity; Cellular component= integral to membrane; Biological process=lipopolysaccharide biosynthetic process
  Homolog annotation: Hit_ID=Q2NUB4; Match level="QueryCoverage=97%, HitCoverage=87%, E-value=1e-134, Identity=56%"; Hit description =Putative extracellular polysaccharide biosynthesis protein
  Pfam annotation: Domain name=Bac_transf; Domain location=274-415; Score=37.3; E_value=5.1e-12; Accession=PF02397.7; Description =Bacterial sugar transferase
MNGFRRGVLHTNASLTSMLQRFSDIFVIFSGLYLSCLISGAAFSVQHWIMVLISIVIFQMIGGITDFYRSWRGVRAGLEIQLILQNWSLSLLLTSGTVALINVFNNEYSVYIQWYLLVCCGLVITRSVIRLLLGYMRNIGFNTRNVAIMGAMPVGIRLAESLRDAHWMGFKVLGIYDNDNSPLNSKIERCGDLSQLVSDAKSGRIDRVYIAMSMEQEKLIKDTIADLSDTTCSVMLIPDIFTFNILQSRSEEINGVPVVSLFDTPMSGINQVIKRIEDIILSIFILLFISPVLLLIACMVKFTSSGPIIFKQRRYGMDGKAIEVWKFRSMTVMEDGDKVVQAKKGDARLTPVGSFLRRTSLDELPQFVNVLKGDMSIVGPRPHAVAHNEQYRKLINGYMLRHKMKPGITGWAQIN

SEQ ID NO: 178759 - protein, 163 aa, Glycine max
  Coding DNA Sequence Number=SeqID_87074
VTSCTICGEAHETRQCIPIKENTQEVHYMGNQQRQGYTRGGFSGFQQGPYNQQGQWRSHPGNQFNKDQGGPSNRPIQQGPNIFHRTTKLEETLTQFMQVGELAKQIADKSSNSFMANTKNNPKEECKVVMTRSMRFVEAEDEDSVVSKKNVVEKKGTDEKKDD

SEQ ID NO: 178760 - protein, 85 aa, Glycine max
  Coding DNA Sequence Number=SeqID_87075
  Subcellular localization annotation: CTP_CleavageSite=44; ConfidenceScore=5.17e-01
MGPDRKFQQLPFLPPRCFFFLFFSTIVVSLEAPNSLSFPHQIARKSHFRSLGAYLYFVGPSIPDRKMVERMGRVSLELNLRMVVL

SEQ ID NO: 178761 - protein, 25 aa, Glycine max
  Coding DNA Sequence Number=SeqID_87076
MNYLAKLVGVGARRIVGLMHCPHSI

SEQ ID NO: 178762 - protein, 287 aa, Glycine max
  Coding DNA Sequence Number=SeqID_87077
  Gene Ontology: Mol. function=transcription factor activity; Biological process=regulation of transcription, DNA-dependent
  Homolog annotation: Hit_ID=A9HX36; Match level="QueryCoverage=93%, HitCoverage=84%, E-value=7e-66, Identity=51%"; Hit description =Transcriptional regulator, LysR-family
  Pfam annotation: Domain name=HTH_1; Domain location=7-66; Score=63.1; E_value=9.4e-16; Accession=PF00126.18; Description=Bacterial regulatory helix-turn-helix protein, lysR family
  Pfam annotation: Domain name=LysR_substrate; Domain location=90-287; Score=130.6; E_value=4.5e-36; Accession=PF03466.11; Description=LysR substrate binding domain
  Pfam module annotation: Pfam domain module=HTH_1::LysR_substrate; Domain location=7-66::90-287
MEASVPITAVVAFVHEAEHASFTRTAEALGVSTSALSQSVRALEARMGVRLLQRTTRRVSLTEHGARFLQRVRGGLDQIDQAFAELDSARSVPAGRLRVTLPRIVADRMVLPRLPDFLARYPQVQVELCVDPALTDLVAEGFDAGIRLGESLAQGMIAVPVGPPERQVVVATPAYFERHGVPQTPHDLQGHACIVHRLANGRLMPWEFSREGHDLDVEVSGRLVFNDAGVAHHAVLAGLGMAQGFASLMADDIAAGRLQSVLQDWQPPFPGFHLYYPAREQMAPKLR

SEQ ID NO: 178763 - protein, 87 aa, Glycine max
  Coding DNA Sequence Number=SeqID_87078
MVKREMITMMVDTLPVFYYEKLLGYMPSSFADLVFAGEKIEVGLKRGKFDYVSSTSTNARRIGATGAKRKEGDTHAVTSAPAWVKPP

SEQ ID NO: 178764 - protein, 156 aa, Glycine max
  Coding DNA Sequence Number=SeqID_87079
QTQEHRSLEQMDQWLALNSGFTCDSPQILASPHQLDLAPYASGPYNAQWNAPGLFHDKHTLRSSRILGEMEVDETWLRLSRCKIHFLVGVLVYTKGMAFVDNWAVGKEKVCYWLSNDIVGLVGNLAVLEWQSQHGLLLHPHPLHLPQFSHSSKQDD

SEQ ID NO: 178765 - protein, 161 aa, Glycine max
  Coding DNA Sequence Number=SeqID_87080
  Homolog annotation: Hit_ID=A6H595; Match level="QueryCoverage=45%, HitCoverage=85%, E-value=2e-27, Identity=81%"; Hit description =Putative 23S ribosomal RNA
MLRGVENKRRSGIPDIGQPFELLLNPRAGKRQPELYKCRAARRSSRECCTLDGESPVAESITSLRSDPSSMGHVESRVNQQGPPCKAKYSWVTDSEVVPETTGAVAKASLHRAIVTAYGPEPGGEMPLEPRASWFSPKCVEAQQLTRHLGVKHCFGAGARA

SEQ ID NO: 178766 - protein, 92 aa, Glycine max
  Coding DNA Sequence Number=SeqID_87081
  Subcellular localization annotation: CTP_CleavageSite=27; ConfidenceScore=5.27e-01
MTKNDGKSLRNRSWKHLGRKRRRSLPPSSPRRARFLPLEGTAFWWNFLEGRSGPGCYLHPLFTKYTPYLFPDSFSVTLRNFTSFAMILVFFP

SEQ ID NO: 178767 - protein, 97 aa, Glycine max
  Coding DNA Sequence Number=SeqID_87082
  Subcellular localization annotation: CTP_CleavageSite=2; ConfidenceScore=5.21e-01
MKSGGKSSRNRSRKRLGSVTEAPRLGFSSRKQFFSLISRGKREVVAAQLAQESWVASTRRHHLLLEHPRRSKWAWLLFAHPFLLNIPPLPVLLILFP

SEQ ID NO: 178768 - protein, 102 aa, Glycine max
  Coding DNA Sequence Number=SeqID_87083
  Homolog annotation: Hit_ID=A5AV98; Match level="QueryCoverage=98%, HitCoverage=13%, E-value=3e-24, Identity=56%"; Hit description =Putative uncharacterized protein
MSIFNGLNFPNWNEQVQFNLGVLDLDLAILEEKLATITNASSNESKAHYKAWERSNRLILIFMRMNVEDNIKTTLPKIDSAKDFMGLVRERSQIADKSFVGT

SEQ ID NO: 178769 - protein, 67 aa, Glycine max
  Coding DNA Sequence Number=SeqID_87084
MEHSSKLENGGHMNDNAIHSCGSGKRMRMEDCLEGPLLGNDGTQLQTRNGGHMNNPKQYHSCGSGKR

SEQ ID NO: 178770 - protein, 72 aa, Glycine max
  Coding DNA Sequence Number=SeqID_87085
  Gene Ontology: Mol. function=protein dimerization activity
  Homolog annotation: Hit_ID=A5C6E9; Match level="QueryCoverage=58%, HitCoverage=3%, E-value=2e-09, Identity=66%"; Hit description =Putative uncharacterized protein
  Subcellular localization annotation: CTP_CleavageSite=52; ConfidenceScore=5.19e-01
MWWKFNGVKYPTIQAIAKDILAISVSTIASKSTFSTGGSMSYKVVAECANVMNEMVSDEGEMMGAGVTNLEE

SEQ ID NO: 178771 - protein, 272 aa, Glycine max
  Coding DNA Sequence Number=SeqID_87086
  Gene Ontology: Mol. function=catalytic activity; Biological process =metabolic process
  Homolog annotation: Hit_ID=Q5NWD5; Match level="QueryCoverage=54%, HitCoverage=9%, E-value=7e-27, Identity=42%"; Hit description =Putative uncharacterized protein
  Pfam annotation: Domain name=PGAM; Domain location=171-263; Score =23.5; E_value=1.8e-05; Accession=PF00300.13; Description =Phosphoglycerate mutase family
VVMLSERNSPKHRESLGFWLRDNLADSIVLCDAYFSSADCEFMQLVLAECPDAKLTVLTSMKGVSHEEFSQDLFLSRWKLLSDDDPPDTEIIAIAGYDNKGQILIHDRWLISGDAALRLGTSFNSLGMGKLSELSPVVAEGCPAVLEEIAKYKAKNRLVNGVRAQTRRGKMLVMVRHAQSMANAGFVTADPESIALTALGEEQARALAMTWSAAPDRIFTSPFFRARQTSQPLAERFKLVVAPLGVQEFTYLSPERCVGTSAADRKQWVEDY

SEQ ID NO: 178772 - protein, 145 aa, Glycine max
  Coding DNA Sequence Number=SeqID_87087
MTNPLYESISCFLIRVDPWVLVPSPSEGCMTSPSEDYTSSPLEDYTSSPSEGSMPSPSEDCRSLSSEGYTPSPSDAFRGLHVLPFKRLHVLAFRGLHVLAFRRLHVLAFRGLHDLAFRGLHILTFRGLHVLAFRGQHALAFRGLH

SEQ ID NO: 178773 - protein, 109 aa, Glycine max
  Coding DNA Sequence Number=SeqID_87088
  Subcellular localization annotation: CTP_CleavageSite=7; ConfidenceScore=5.28e-01
MTFRGPRKARGKRSEVPTTSAPPETPSTSSSTALLGAQPSPSGGGGDFASQEPTSEEPAAAATEGEDELTPLEPFYFDADAHMAQKEGTSIDQIPEPSPAPVPEETRTI

SEQ ID NO: 178774 - protein, 303 aa, Glycine max
  Coding DNA Sequence Number=SeqID_87089
MAKFDFEVVLEFYANAWPTKEGVRDMHSWVRGQWIPFDTNALSQFLGDPLVLEEGQECEFSQRRNRADGFDEKAIAQLLCTLGQDFARTAAGRRVRIMRTTMTTLTHMWMTLLLSNVLPSDHNSDLPLPKCQLVYAILTWMSIHMAQLIADAIYLFAGMPPTKHPLDPDKSNKALGSLALITGLCQSFGVPVTPNKVIRLSITWAFIEKYCTPRQAQSDAPQAADAPPPPHQADPAGSLGIERYLQHLVRQQAANHRGQVAWPRDWPEAQAGEAPAGSPGDAEEARMDEEMTDLLSFLGGSGA

SEQ ID NO: 178775 - protein, 101 aa, Glycine max
  Coding DNA Sequence Number=SeqID_87090
MVRTRGLGRALGAGRGRGISEDAHEANVPRRHRPIASARRQRVHLHEDVTERHEDVPQLHEDVPHVFDATPEMTGAADAVQTKGVATDGSLGSLATDEGFP

SEQ ID NO: 178776 - protein, 117 aa, Glycine max
  Coding DNA Sequence Number=SeqID_87091
MEACLWGFYGGWIFELQCNGRQRRRGERRHHLLGNKPWKKEFHHQDEPWIRSLEGCFNGGKERGRERERGEHEIEGIKEGEKWNFEVCLTRLSFIKVTTSFTHASIYRLGSFLEKLS

SEQ ID NO: 178777 - protein, 58 aa, Glycine max
  Coding DNA Sequence Number=SeqID_87092
  Homolog annotation: Hit_ID=A7PPP1; Match level="QueryCoverage=84%, HitCoverage=4%, E-value=9e-12, Identity=73%"; Hit description =Chromosome chr8 scaffold_23, whole genome shotgun sequence
MDAPRKQQVSLRGASAKEITRDALLQKVSWEREFRNYAKKAASPALFIQVLCLCFRFL

SEQ ID NO: 178778 - protein, 199 aa, Glycine max
  Coding DNA Sequence Number=SeqID_87093
MVTFSVYTVVKYCSGSVWWSKFATENIKEKYLDPAMYWDSQLMARYATLVQVSREVCEATYYDEDEYGKMLHFLSNEVRRLKSKTNSQPCFDDNDDQQGDNYDGILDPVVVRTKGCGQVGIDESGKRRRIQKCGQCAGSRHNKRSCTNRPRNTNVSIGGSFISSTEQTNTMCQPTDEYNYQLFMQQPHTFVVGSSRAGP

SEQ ID NO: 178779 - protein, 125 aa, Glycine max
  Coding DNA Sequence Number=SeqID_87094
MLTSPERVQMTTLVSVCQSDLGSPNDEVRITVRCLCMLPDSWVMIAKGGVVDKSEAFTPTYPQFVMRNSDLRSSFKKETLVLQPTLQREGGARLTSASFKKGKRAESPPTFIRGKHRKNRKRRGL

SEQ ID NO: 178780 - protein, 146 aa, Glycine max
  Coding DNA Sequence Number=SeqID_87095
MGSSQAPSLKKRVYQVMVKRLGITNLKELGQLMGQLQRRAFHKAYGKIWDLAMAEVSIEAIASLAQNPRMPSRGKETIPLLRILSLFRKCLEAKARILAGRGEWAPFIDILALLIFGGVLFPNVDRLVDLAAIDTFLAFHDRKESP

SEQ ID NO: 178781 - protein, 219 aa, Glycine max
  Coding DNA Sequence Number=SeqID_87096
WAKTTNQAIVRYSTGGKIKLKTSEEATELIENMSASDHAILRDRTHQPTKKSLIELSSHDALLGQNKLLSKQLEILKETLSKLPTKLSMGQPTHSSVVQVTGSTICGEAHEIGQCIPTEENTQEIHYMGNQQRQGYTQGGFSGFQTATIPLGLGFMLSMTIHAKRNSSCTKRGNSHSAQFPLGNLQSKFEDDPTVNEFRITVLPEQGVIVGHGRGGLGC

SEQ ID NO: 178782 - protein, 169 aa, Glycine max
  Coding DNA Sequence Number=SeqID_87097
RYTDLEGNLFSTVNGVDMVIDVALWKEVASLDMGGVRKFDEMPDGYRKIQTYKEMLLDPVRNLRNHLEVGIKMNWVLLIEDIMLKCHRLVDYEFPYVVFASRYTDYFVVDVSNKIVDFTKASSEITENHLKKLGMRFVDHEWIIVGRHATGNVGEMEEDVDAEAQHKLV

SEQ ID NO: 178783 - protein, 146 aa, Glycine max
  Coding DNA Sequence Number=SeqID_87098
MTSKKRKAFSTPTQARYDRSRKLLPERNVVVYYTKFDEFKEELERRHWDEKLTDFADSSIDIAIVKKFYANLYDPEDKSPKQVRERGHLVKFDEDTLNTFLKTPVILEEGENLCTYSKFALLRPNPQELATKFCIPGRGFELNADG

SEQ ID NO: 178784 - protein, 65 aa, Glycine max
  Coding DNA Sequence Number=SeqID_87099
MTRAYFKRCMENRKMQGSRMSEHENKRDAYAMHDMNAFTDTRAQKIISSYLRIQGRSAPCVQLRR

SEQ ID NO: 178785 - protein, 225 aa, Glycine max
  Coding DNA Sequence Number=SeqID_87100
  Gene Ontology: Mol. function=catalytic activity; Cellular component =cytoplasm; Biological process=Mo-molybdopterin cofactor biosynthetic process
  Homolog annotation: Hit_ID=A4W8H1; Match level="QueryCoverage=100%, HitCoverage=100%, E-value=2e-85, Identity=67%"; Hit description =[molybdopterin synthase] sulfurylase
  Pfam annotation: Domain name=MoeZ_MoeB; Domain location=144-225; Score=108.2; E_value=2.5e-29; Accession=PF05237.4; Description =MoeZMoeB domain
  Pfam annotation: Domain name=ThiF; Domain location=31-176; Score =157.9; E_value=2.7e-44; Accession=PF00899.12; Description=ThiF family
  Pfam annotation: Domain name=adh_short; Domain location=33-184; Score= -54.6; E_value=0.049; Accession=PF00106.16; Description=short chain dehydrogenase
  Pfam module annotation: Pfam domain module=MoeZ_MoeB::ThiF::adh _short; Domain location=144-225::31-176::33-184
MTVELSDQEMMRYNRQIVLRGFDFEGQEALKAASVLVVGLGGLGCAAAQYLAAAGVGRMTLLDFDTVSVSNLQRQTLHSDATVGQPKVDSARAALARINPNVQFTLLDAMLDDDALSAQIARHDLVLDCTDNVAGQISVFTYADGEPCYRCLSRLFGENALTCVEAGVMAPLVGVIGSLQAMEAIKVLAHYGTPAAGKIVMYDAMTCQFREMKLMRNPGCEVCGG

SEQ ID NO: 178786 - protein, 76 aa, Glycine max
  Coding DNA Sequence Number=SeqID_87101
MYIVVVKQGQDHLGLPSEVETNVSGRNQSRYLRTDASGDRVTTDRSLPLLCAKQAENVSSPGRAGLAWASHPCTKL

SEQ ID NO: 178787 - protein, 239 aa, Glycine max
  Coding DNA Sequence Number=SeqID_87102
  Gene Ontology: Mol. function=calcium ion binding; Cellular component =cell projection
  Homolog annotation: Hit_ID=UPI00016621D1; Match level="QueryCoverage =97%, HitCoverage=40%, E-value=4e-22, Identity=33%"; Hit description =UPI00016621D1 related cluster
GLHALTFRGLHTFTFRGLHVLTFRGLHVLGFRGLHVLTFRGLDVLAFRELDVLAFKGLNVLTFRGLDVLAFRGLHALAFIGLHALTFRGLHVLAFRGLDVLAFRGLHILAFRGLDVLAFRGLHTLPFRGLDVLAFGGLDVLALRGLHARAFRGLHALTFMGLHALTFRGLHVVAFRGLHALAFRGLHVLAFRGLHALAFKGRHVLNFRGLHALAFRGLCVLTFRGLHICAFRELKALCP

SEQ ID NO: 178788 - protein, 163 aa, Glycine max
  Coding DNA Sequence Number=SeqID_87103
MEDAPASPASSSRRRVGCDRCQHDHDRSVSVETKRARKEKWGRNNELKLRRAKRDKSRVESMCKEKLNLAVSHGQRLEDEHAKVSALQVEREAREKVIESLHGEAVKWMDRFALTMNGSQELPRLLARAKAMANIYLAPDEVHGLFDYCQHMIGLMSHIIRNR

SEQ ID NO: 178789 - protein, 70 aa, Glycine max
  Coding DNA Sequence Number=SeqID_87104
MTVSAESQFRLSCDENPEIGHIQAKGPSGEGRRLIKVILVASTLTYLPSPEVASTLTYLPSPEVASSKPS

SEQ ID NO: 178790 - protein, 72 aa, Glycine max
  Coding DNA Sequence Number=SeqID_87105
MVGYTPSSFADLVFADERIEVSLKRGKFNHPTWMNEKTGVNEEGENEGETHAAIAVPTWKLPTSPTMSLLSQ

SEQ ID NO: 178791 - protein, 65 aa, Glycine max
  Coding DNA Sequence Number=SeqID_87106
MNLVSRVDNKAYLLEIFDGILELFKKLHPPGMSLAQFALTLKMLQGFMVTMYDKLLGKEVVLPSL

SEQ ID NO: 178792 - protein, 100 aa, Glycine max
  Coding DNA Sequence Number=SeqID_87107
MAQERTWMSCVLLEQVRNQPNTEGGYFCGRPAMSFRVCFMRSKPLAESLTTVAILLKEGRHPEERYGFLPPRGHPRISSNSSMVGTNWKSPNVKHLKGWS

SEQ ID NO: 178793 - protein, 291 aa, Glycine max
  Coding DNA Sequence Number=SeqID_87108
MERSMIDAASGGALGDITPAEARNLIEKMASNSQQFSARNDAIVIIGVHELALNQKSVHVARLCGLCSSADHHTDLCPFVQQSGAIEQPKAYAANIYNRPPQPQQQNQPQQNNYDLSNDKYNPGPDVPPPIQLQQQQQKQQQPQKQQIVEAPPEPSLEELVRQMTMQNMQFQQETRASIQSLTNQMGQLATQSGKQYQGPQLVASSSSANEPAQLHSTPEKEDDKNLKTYPSSIPSKSNFQQKNEEVEKEILETFRRVEKLKGSERISKGRNVSALIGKFVAQIPEKWKDP

SEQ ID NO: 178794 - protein, 86 aa, Glycine max
  Coding DNA Sequence Number=SeqID_87109
MEPRRLVERNAGKQVIAESPPQRAAHGGPSVMLPQALMVPQPRQVRRGWPQSLRLAAGHFHKTGSWLARLLLLTFVEDDASPAIGH

SEQ ID NO: 178795 - protein, 158 aa, Glycine max
  Coding DNA Sequence Number=SeqID_87110
MGAYAKMRIADTFFQENLTGVAVTWANEEGENEGKAHVVTAIPIQPSFPPTQQCHYSANNKPSPYPPPSYPQRQSLKQPQISPTTIPLHFAVGRAPPAMAEKGKVDHLKERLRAIEGGEDYAFANLEELFLVPNIITPPTFKVLDFDKYKGLLAPRTI

SEQ ID NO: 178796 - protein, 79 aa, Glycine max
  Coding DNA Sequence Number=SeqID_87111
  Subcellular localization annotation: CTP_CleavageSite=41; ConfidenceScore=5.17e-01
MRVHCYQACRRPSMTTDSPPLLMFPWTQSLSGVANCLTYPSAGGRREGSRVRLPRKEDARSRHQRLFEENVRKPERCGL

SEQ ID NO: 178797 - protein, 230 aa, Glycine max
  Coding DNA Sequence Number=SeqID_87112
  Homolog annotation: Hit_ID=A5ATL8; Match level="QueryCoverage=14%, HitCoverage=26%, E-value=4e-10, Identity=93%"; Hit description =Putative uncharacterized protein
LFLDGGKGYNSAVECHLDVVEVISSSLIIPKPNRTPVEYEAPGYKLCLGMEENSESALSTNKEAISNATRNLMESSILAQDERWRHALHMQVGREVVFPVADGLLREAAVGNFPQWAKADGAMPREGRRPTVRRQIPGLNPGQAVETTKLEYETKARGANGIRYPSSPSRKRWILGAVRIDPCNAVANALSIPPGETLPGLDMPRILLKERGAFGNADTGGAWLSSARAV

SEQ ID NO: 178798 - protein, 265 aa, Glycine max
  Coding DNA Sequence Number=SeqID_87113
  Homolog annotation: Hit_ID=UPI00006A2D9E; Match level="QueryCoverage =45%, HitCoverage=62%, E-value=3e-07, Identity=17%"; Hit description =UPI00006A2D9E related cluster
  Subcellular localization annotation: CTP_CleavageSite=53; ConfidenceScore=5.05e-01
GLHVLALRGLHALTLGTTYPHRQRTTRPRLERTTRPHHQRAACPHLQRTISPRLERATRPHLGGLHVLAVKGSCAFTFVGLHALTFRGLHVLTIRGLHALTSRGLHVLAFKGSCTFNFRGLHVLAVKGSCAFTFVGLHALTFRGLHDYMFPIFKGGHALTFRGLHVLAIIGLHSLAFERRHVLNFRGLHALAFRGLCVLTFRASSFLLTVPGPPPDIGGGPTVRAQPEREAITQLLCIPGQDFIRAAVKRRVRIMRTNMTTLTQI

SEQ ID NO: 178799 - protein, 125 aa, Glycine max
  Coding DNA Sequence Number=SeqID_87114
MGEVEEVQEQMKADMEAMKKKRATMVEAMMSMKKIMEANTVAVAATSAVAKYGRPHDVKIQNKHAFPPYGSPPKEDVNNSAPILIESQQPQYDHAHVSRPIGETHGMPHHNLADFEPCLGYATEG

SEQ ID NO: 178800 - protein, 29 aa, Glycine max
  Coding DNA Sequence Number=SeqID_87115
GQDHLELPSGVETKLEQQKPIKVHRDGCK

SEQ ID NO: 178801 - protein, 53 aa, Glycine max
  Coding DNA Sequence Number=SeqID_87116
MQFLGSDPRSSPNEQCNKYRAIGEEEKLIKFNSNNKTSKRAVLDPQEKTTLET

SEQ ID NO: 178802 - protein, 73 aa, Glycine max
  Coding DNA Sequence Number=SeqID_87117
MTNKAKGKGKEVAGKGSSGKRKGAFDDDKIGGGRKRNKRGPVRMNWCLLLFFLDSLACKHETGDLWRSYGGIL

SEQ ID NO: 178803 - protein, 74 aa, Glycine max
  Coding DNA Sequence Number=SeqID_87118
MTKDNSKPYTGAMKGIVHEPQVNIGTDKKFSPVDYLSPSEDCTSFTLRGLHVLAFRGLHTLTVRRTTRPHRQED

SEQ ID NO: 178804 - protein, 107 aa, Glycine max
  Coding DNA Sequence Number=SeqID_87119
  Subcellular localization annotation: CTP_CleavageSite=41; ConfidenceScore=5.57e-01
MADPLKKRKGSSSTAAAAAHRRHGPSGAPTAPIPPSLSSPRSSTLFSSDDQRLRYLSQFSSRIILDPKYLDVEFFNDETFDCYQVFQNSGLVDFMLSQPTLRREGDA

SEQ ID NO: 178805 - protein, 213 aa, Glycine max
  Coding DNA Sequence Number=SeqID_87120
MTTLTQIWKTLLLSTSSPATIISTSPCPKCQLVYAILTQMSIHVAQLIADAIYIFAGMAPSRHPLDPDKSNRALGFPALITGLCQSFGVPVAPSKAAEAPQPHQAGPAGLFDTEQYLQHLVRQQAANHRAHVQTHDCHYQMSLSLQSQGFTSFPCPTPDQFRAEVAWPGDWPEARAGEAPAEAPAEAPDEADEAREDEEMTDLLDFLGGSGAT

SEQ ID NO: 178806 - protein, 146 aa, Glycine max
  Coding DNA Sequence Number=SeqID_87121
MNSLSEFINTHCMKVELYHTELDDFKDELERRNFHKRLTNLVDGSIDLTLGKEFYANLYSYEDRPPKQSKVRGHLVKIDADSLNAFLETHVVLAEGETLPAYSRYCMLPMDFREIEVALCIPSRGFILNSEGHPGKILMKDLTTLA

SEQ ID NO: 178807 - protein, 210 aa, Glycine max
  Coding DNA Sequence Number=SeqID_87122
MVSNPSRAQKKAKTSKRKQDECSQAALNRLDTWIPKYLDLKWFSQQGFNFPNLLEAQGLSKQVFYTCAHVDIEGNFFSTLNRVEMVIFAAVCKEVASLDMGGVRKFEETPNGYRGMHLDPARNLRKCFNHAQVMDNDLQIVYGLKSGIKMNWVLMIKDIMLKSHCLVDYEFPYVVLSSRFINYFNVDVSNEIVDFTKASSEITERHLKKL

SEQ ID NO: 178808 - protein, 126 aa, Glycine max
  Coding DNA Sequence Number=SeqID_87123
MEVRDMVELLPYRDLDELVQLCIRVERQLKRKPSSKSYGFHSYPRKDQAQEILGAAPSKPKEDKGKIIEKLNPKTFLKQGLATLNASNVLGEETTSSPSSSGSEDEVRGEESSQDVYSHEEFDLLM

SEQ ID NO: 178809 - protein, 79 aa, Glycine max
  Coding DNA Sequence Number=SeqID_87124
MGVKHFEVVKRRSHADKNDPRMKLGGVSSLSSFSISLPFIFQEAKESIDEEDHRPTSSNGAYIRAHQKVNANGIRRCIS

SEQ ID NO: 178810 - protein, 189 aa, Glycine max
  Coding DNA Sequence Number=SeqID_87125
  Gene Ontology: Mol. function=nucleoside-triphosphatase activity; Cellular component=chloroplast
  Homolog annotation: Hit_ID=Q2PMM5; Match level="QueryCoverage=66%, HitCoverage=5%, E-value=1e-59, Identity=91%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISSKRKIPITIRVTFLYIIWMMRFRKAMIDFTELLVLFSLTRWSELHLSSNPTERSTRDQKLLKKEQKKHLVLSGDRKIKK

SEQ ID NO: 178811 - protein, 124 aa, Glycine max
  Coding DNA Sequence Number=SeqID_87126
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLGDCAPPSQLPRVQRVGSSKTFEKPPCKA

SEQ ID NO: 178812 - protein, 146 aa, Glycine max
  Coding DNA Sequence Number=SeqID_87127
MMLRRHRWPIASARRQRVSVTAAHDEPVVPAPDIEADVFLDDPMAPIDVEDIVADIPADIGAEASEDEHEGFLGGLSDPFVLTQYADHVACSVWMGELSSHGRKVHSLGRSVPTIEGLVAGIGLSPLIVCSVDTSNRGLLSSFVDR

SEQ ID NO: 178813 - protein, 194 aa, Glycine max
  Coding DNA Sequence Number=SeqID_87128
VDPWVLVPIAFRGLHVLTFRGLHVLAFRGLHILAFRRLHVLAFRELHVLAFRGLHVLAIRGLHVLAFRGQHVLTFAFVGLDALTFRGLHVLTFRGRHTPRLQRATRPHLQRTARPSEGCTLSPLEGYTFLLSVYGPPPDIGGRPTVQAQPERGGYHAATMHTRARFHPYHCKETSANHAHQHDHYYTDMDNVAT

SEQ ID NO: 178814 - protein, 93 aa, Glycine max
  Coding DNA Sequence Number=SeqID_87129
  Homolog annotation: Hit_ID=Q6UUU1; Match level="QueryCoverage=60%, HitCoverage=38%, E-value=8e-18, Identity=80%"; Hit description =Putative uncharacterized protein
MAYERGGDFLEDARKILNREVRGPRQSRFSIGSAPLTSITKSDAQISGGETRQDYKDTRRFPPGGSLVRSPVPAFRFTGVIPLLWPRFVSFHA

SEQ ID NO: 178815 - protein, 110 aa, Glycine max
  Coding DNA Sequence Number=SeqID_87130
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=88%, HitCoverage=76%, E-value=2e-18, Identity=56%"; Hit description=LacZ protein
  Subcellular localization annotation: CTP_CleavageSite=32; ConfidenceScore=5.02e-01
MTMITPSSKLTLTKGNKSWPGDPLVLERPPPRWSSNSPYSESYYNSLAVVLQRRDWENPGVTQLNRLAAHPPFASWRNSEEARTDRPFPTVAQPEWRMGRALGDRYTCQR

SEQ ID NO: 178816 - protein, 220 aa, Glycine max
  Coding DNA Sequence Number=SeqID_87131
MSHRRLYQQRIKNAFDQKVRPRKFNQGGQECEFSWRRNRVDEFDEEAIAQLLCIPGMPPTRHPLDLDKSNKALGFPALITGLSQSFGVPITPSKVIRPPITRAFIDKYCTPRQAQGDAPHAADASSPPHQADPAGSFGMERYLQHLIRQQVANHRGQLQIHECLYQLSLNQFRAEVAWPRDWPEAQAGEAPTEAPGDANEACMDEEMTDLLGFLGGSGAT

SEQ ID NO: 178817 - protein, 154 aa, Glycine max
  Coding DNA Sequence Number=SeqID_87132
LCHLFGVPVAPTKVIRPPITRAFIEKYCTQRQAQGDAPQAADAPPLPHQPGPAGSFDIEQYLRHLVRQQAANHRAHVQTHDCLYQLSLSMQSQGFASFSCLTPDQFRAEVAWPGDWPEAQAGEAPPRAPDDGEEAHEDEEMADLLDFLGGSGAT

SEQ ID NO: 178818 - protein, 200 aa, Glycine max
  Coding DNA Sequence Number=SeqID_87133
MAPRKLASKRSRKDKAAEGTSSAPEYDSHRFRSIVHQQRFEAIKGWSFLRERRVQLRDDEYTDFQEENRAPAVDITGYPPWPNAIGQLLGYPLVLEEGQECEYGQRRNRSDGFDEEAIARLLCIPGQDFARTAAGRRVQIMRTNMTTLTQIWMTLLLSNILTTDHNSDLPLPKCQLVYALLTRMSIHVAQLITNAIYIFA

SEQ ID NO: 178819 - protein, 186 aa, Glycine max
  Coding DNA Sequence Number=SeqID_87134
NRYNPGWRNHPNLRWSSPQQQQQQPAPSFQNAAGPSRPYIPPPIQQQQQPQKQPTVEAAPQPSLEELMGQLATQLNQQQSQNSDKLPSQAVQNPKNVSAISLRSGKQCQGPQPVAPSSSANEPAKLHSTPEKGDDKNLPNNLCAGESSSIGNSDLQKQHIPPHPFPPRAVSNKKMEEAEKRDLGNV

SEQ ID NO: 178820 - protein, 113 aa, Glycine max
  Coding DNA Sequence Number=SeqID_87135
  Subcellular localization annotation: CTP_CleavageSite=50; ConfidenceScore=5.68e-01
MFIRITTRSFFFTVLLLRHPSLNHCASSSSSFIFFFSLSLSLSPLPNVISSSSSRCHHHPQLRIPPPPPFSPLPLQNPNPQKTQTPLCPPPVELQTKTPTQTPFADPIGVPWA

SEQ ID NO: 178821 - protein, 96 aa, Glycine max
  Coding DNA Sequence Number=SeqID_87136
CVSGVRDLIEDVAAPPPLLEDLPLQCHSLPIIGKFMPFAERFRKKEEYYTLSLYVLILIALTPKPAGRELKPKRTNSAAYWELRWVKELRIEEDDD

SEQ ID NO: 178822 - protein, 127 aa, Glycine max
  Coding DNA Sequence Number=SeqID_87137
  Homolog annotation: Hit_ID=A7PHV0; Match level="QueryCoverage=81%, HitCoverage=32%, E-value=3e-12, Identity=41%"; Hit description =Chromosome chr13 scaffold_17, whole genome shotgun sequence
MYLTVLADLNQVRWYSWGPACLAMLYREMCWATDADAKTMVGYASLLQSWVWYRMPFIATRVNRTPSYPLVTRWSGGGLSFTGTPHGDVIGYRMRLNHMTTEQNGTKRIELNFNSTSDKTYQIPHET

SEQ ID NO: 178823 - protein, 123 aa, Glycine max
  Coding DNA Sequence Number=SeqID_87138
  Homolog annotation: Hit_ID=A0ST23; Match level="QueryCoverage=20%, HitCoverage=51%, E-value=3e-07, Identity=100%"; Hit description =Putative reverse transcriptase
LSIPSTIEGGARYQLLFPLVRVNFELGVIMVIAVSFGKPVVPAALMNRPTRGERRFAYWALAECILAYYVGTDEGVSEVLHVAGEKRLHRGNGFTNGAEISWEDARKILNRGRERAAGKAVFP

SEQ ID NO: 178824 - protein, 474 aa, Glycine max
  Coding DNA Sequence Number=SeqID_87139
  Homolog annotation: Hit_ID=A3J2N0; Match level="QueryCoverage=77%, HitCoverage=31%, E-value=2e-17, Identity=28%"; Hit description =Putative uncharacterized protein
VGDSNATCGFNYIPPLNCFLPRKIDEIGNINQMPNINSPITLKLNILTETGAAVLVNGVAPTPSQGPYPLTGNTQWQTYAIEGITGNVSITSTKAVTAGINGGYSTAGYGGYFAGFSSVPVITKKSGECVPGIVLEVDDGYETYQWYLNGVAIPGAVNSTYTPVQSGNYTVKVTMGSCPVTTPIYKVFTCMKNTTTSINICATKIITPTFSSSTQTPVPSTVSILTAPIHGTAILNPSTGIITYNPAPGYFGPDVIVYTFCGNAPEFIDCETVTINLTVVPFIVKDATLEACQYEDKAYFDLTTANVIDFNLVTKKYYPTLADLNANTNQITNPQNYESTGGVVYVKITSNEGCTGIAKITLIAKPIKKSPTLLDKYICIDSRTNLDAGPGYDSYQWSTGATTQSIEGVGVGEYTVILGKDGCFVTQIVKVIKTQDPVITQIEISNNTATVIVTGGTPPYKYSVDGTSNWQDSN

SEQ ID NO: 178825 - protein, 137 aa, Glycine max
  Coding DNA Sequence Number=SeqID_87140
MKYKRDKEEKLEKQMKKKDNKALSTKAKGKEKEEKDSSKNIVKKENYFATKGDIKRALLLKQSFYLLLTRETSLSTVIPLELKVIPQVKELLDEGLVRIVIHQIPMIGGMMNVLSGETLFCKITHASNIFMIHIHKN

SEQ ID NO: 178826 - protein, 60 aa, Glycine max
  Coding DNA Sequence Number=SeqID_87141
MWVQAIGLFAQATCAPEFGLPRPFNQRLLVLHVGGESLNHTGTTLPLYSGILYNKRPTIS

SEQ ID NO: 178827 - protein, 81 aa, Glycine max
  Coding DNA Sequence Number=SeqID_87142
MTLPLSNLLQKEVEFDFDDRCKEAFDCLKRAVTTTPIIQADHLSRIELTRLLGDAFQAMRSTRFCNSVILLHQVAIMAYRG

SEQ ID NO: 178828 - protein, 118 aa, Glycine max
  Coding DNA Sequence Number=SeqID_87143
MASSALAFKDSMVPRDLQFTPSIAFATFFIDAEPRYPLPRVIAGVCVCREDEEAGRTGRRGHPLPPDGSVDFSQRRGQRTAHVAAIRTLHRTIQSVGATGGVYKGQGRSQRELMTRAY

SEQ ID NO: 178829 - protein, 155 aa, Glycine max
  Coding DNA Sequence Number=SeqID_87144
MASRKRKSIGTRLISQYDTRRFSSLDAWTRYTDNVLGRIILPERKVELYHTELDDFKVELERRNFHKCLTNLAGGSIDLALVKEFYANLYSSEDRPPKQFRVRGHLVKIDVASLNTFLETPVVLAEGETLPAYSRYCRLPTDFREIEAALSIPGR

SEQ ID NO: 178830 - protein, 73 aa, Glycine max
  Coding DNA Sequence Number=SeqID_87145
MAAEWRKGERERRCHFKEKMSLEEAHHHRRPWIRAWRKKEMNEGRGREEHEIFPLIQDQFQDSPLSVLRCHEA

SEQ ID NO: 178831 - protein, 155 aa, Glycine max
  Coding DNA Sequence Number=SeqID_87146
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MALSATSRGFSIERCIVTLELDRARLGYHMSGHEVRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 178832 - protein, 104 aa, Glycine max
  Coding DNA Sequence Number=SeqID_87147
  Subcellular localization annotation: CTP_CleavageSite=23; ConfidenceScore=5.12e-01
MTSIAQSNTSRLGFPALITTLCRARRVVSDSLTFERLSPVINLAYIRKNCWNPENLTVSIRGARRARARPAELPSTSTAPTPASTSAAPSVLAQTDSQRFEAML

SEQ ID NO: 178833 - protein, 58 aa, Glycine max
  Coding DNA Sequence Number=SeqID_87148
MARLGPQKTSGLSLSSPGRAVMKEEEKRRGNKVEALPDHDWDQSLHRSLFGVLRATAS

SEQ ID NO: 178834 - protein, 227 aa, Glycine max
  Coding DNA Sequence Number=SeqID_87149
  Homolog annotation: Hit_ID=A5CAN5; Match level="QueryCoverage=61%, HitCoverage=32%, E-value=8e-14, Identity=30%"; Hit description =Putative uncharacterized protein
MTMSDLFLTMPNMRIGRKDHTECTFCMTTGHTWKTCFNLFGFPNKTTDASKFKRGEPIFSDEDYQEYLRLKASRQAQPPLTSNISTACISQSKDIQGPWVIDSGASDHISAAPSPKLLCDRLGHLNLSKLKQMVPNLSRLQVLECESCQLGHTRVCPSLLASPMMNPSTSSSPPHDDDSDWPIVLRKGIRSTRNPHTIYLSYHRLSSSSHFSFVSSLSPLTIPKNVH

SEQ ID NO: 178835 - protein, 233 aa, Glycine max
  Coding DNA Sequence Number=SeqID_87150
  Homolog annotation: Hit_ID=Q6WAY3; Match level="QueryCoverage=19%, HitCoverage=1%, E-value=2e-08, Identity=62%"; Hit description =Gag/pol polyprotein
  Pfam annotation: Domain name=G-patch; Domain location=33-77; Score =13.6; E_value=0.0043; Accession=PF01585.14; Description=G-patch domain
AAEESLETSFQALEVVSNAYEESPLVQPPSSDAALMVAQVMLGHRYEPEMGLGQNGNGIASLVEFTKNHGRFGLVYEPTRTDKRRITLERRERSSAQPRGPQVERIPFCHIDESFISAGWMCEGRVAVINEETPQDQSIWVWPCPLEFELGNWQDLDVDFEQLINQAEKGEDEDWGLPPELKRMVEQEERELRRMKPEMSLKIKEVVKKQFDAGFLAVAQYPEWVTNIVLVPK

SEQ ID NO: 178836 - protein, 101 aa, Glycine max
  Coding DNA Sequence Number=SeqID_87151
MAPKKLLSKRAGKDATGEGSTIKSWSFLKERRVQLREGEYTEFQEEVARRQWTQLTGPMAKYDLEIVMEFYTNALPTEEGVRDKRSWVRGQWVPFDEDVIN

SEQ ID NO: 178837 - protein, 72 aa, Glycine max
  Coding DNA Sequence Number=SeqID_87152
  Subcellular localization annotation: CTP_CleavageSite=45; ConfidenceScore=5.24e-01
MSLPPLEPHNHSQTHFMLSRWLPLLAQFSASGHVGAFVLSATLARLARISEFWLSARLFDSRWTQAGLALAQ

SEQ ID NO: 178838 - protein, 44 aa, Glycine max
  Coding DNA Sequence Number=SeqID_87153
MPQNFTDYLTMGVNYLEAVKQSCRLSNNGPRTKLGPLVIDYILW

SEQ ID NO: 178839 - protein, 44 aa, Glycine max
  Coding DNA Sequence Number=SeqID_87154
MVQLSVHCYAKPNIFTKVLSAAVALSPNAYWILQLQVGLSARLG

SEQ ID NO: 178840 - protein, 274 aa, Glycine max
  Coding DNA Sequence Number=SeqID_87155
MKEFYQNLYVLDDKFPKKVRVRGHLIKFDVDSLNTFLEIPVVMEQGESLPSYSKFVRLRPDPQGLVARLCIPGRGFVLNVKGLPWKLLRKDLTTLAQTWSVLSHSNLAPTSHTFDLNLDRAKLVYGLVMKMNMNLGTQKSRARRSEASIYFCFSVTTSSSSSSRSLRLEVKAFCVYVAEPASGPTPDHAEFAGCGPATTSYEHGGVSVEAQEPQPDQEDDILEASEPTPPESFIFKTDPVAATPQVTPEPSTVVLDMSSSQPESSAPVPDLTLP

SEQ ID NO: 178841 - protein, 35 aa, Glycine max
  Coding DNA Sequence Number=SeqID_87156
MVSMNEGEKRIGEEQQQLMNAKNSKGAGMQGDEAR

SEQ ID NO: 178842 - protein, 58 aa, Glycine max
  Coding DNA Sequence Number=SeqID_87157
MEPAMEELINKTQLSPKIIPTSSCRLDGSTKESHFSYSTAVILLPQTKVRDHHKYQSQ

SEQ ID NO: 178843 - protein, 92 aa, Glycine max
  Coding DNA Sequence Number=SeqID_87158
  Homolog annotation: Hit_ID=A5ANU0; Match level="QueryCoverage=94%, HitCoverage=15%, E-value=3e-09, Identity=31%"; Hit description =Putative uncharacterized protein
ETGNRLPESKTLHKDAQVKVEYVKRLHEQVKAQIAKENESYAKQANKNRKEVVLEPGDNSEDLRANAFQEGGNDENPKTVQIQGPMTRSRTK

SEQ ID NO: 178844 - protein, 166 aa, Glycine max
  Coding DNA Sequence Number=SeqID_87159
MKLAKYRLKAQVEKDEGPSGEGQSPRVEKDEGPEAETLSRLLIVAEGPRTFGHLIKFGESFSLGSLLNQYQTYQGNPCGVYPDLSSFTGSSVYPDLSSFTGSGVYPDLSSFTGSGVCPDLSSFTGSGVYPDLSSFTGSGVIQTFVACIKRSAPTQVHIIWYQSFGS

SEQ ID NO: 178845 - protein, 124 aa, Glycine max
  Coding DNA Sequence Number=SeqID_87160
MAILRIITIDANGLSIVRVSHYLQGRNDESKIHIGSGNQRVESSDSGNHLVVFEHSMEDFSLLKSFSISIHPPKPYAIKKVLWYPPQPDTIKCNIDGGAKKAPEHARCGHIFNDHCGADLGCFA

SEQ ID NO: 178846 - protein, 116 aa, Glycine max
  Coding DNA Sequence Number=SeqID_87161
  Homolog annotation: Hit_ID=A7PSU9; Match level="QueryCoverage=80%, HitCoverage=41%, E-value=5e-12, Identity=45%"; Hit description =Chromosome chr8 scaffold_29, whole genome shotgun sequence
MSGVVRAALRSTTSVCALVQRSHGLLPLRCFSTEAEQPPLNSTPPPPPFFETDHSEIHRYPLQEAILPESGLTYGNLLGVRKYALKTDIINFLEGCNLTLEDVKMDYDRSFSPVST

SEQ ID NO: 178847 - protein, 17 aa, Glycine max
  Coding DNA Sequence Number=SeqID_87162
MADQQATKSKAKGRGIP

SEQ ID NO: 178848 - protein, 181 aa, Glycine max
  Coding DNA Sequence Number=SeqID_87163
WHQERGLEPDDISSSSIPAPQSAAIGPDVQHSQTLVPMLQSLFRGQLIIMPSLRELAHNRPIISMEHFLEQVAWPEAQLPLVRPNEATPPEPAPARVEPMPAEPRSPVVNPPPSPELEVVPPSPSLIIISDASSDETTALLIHQLEKQLIPLIPQLEELPIFLILHLEKFLLSLIPQFRHC

SEQ ID NO: 178849 - protein, 247 aa, Glycine max
  Coding DNA Sequence Number=SeqID_87164
  Homolog annotation: Hit_ID=A5ZYK7; Match level="QueryCoverage=26%, HitCoverage=97%, E-value=2e-22, Identity=78%"; Hit description =Putative uncharacterized protein
CRKVKEVGDLMTGEPTTEAPVNGGRNYNGPKVAKFLVGLGEIDMSVKMRTTCTWTERPYEASLFPGIGFGLFLRSLGGGQRRPPSGGARAISFLGPDGDWPSSAKAEGSLTARPTRRAGTKVGLSDPTADLPQELTSTEGLAPRCRLFATWGCSMFQGLGCSPIKAVRELGSERRETVRSISGVGVRALRGPFPSTRGPGRTHLWCASYRAHGKRWVAKASGSTAETAMGSLPQRGWSERSFENSRE

SEQ ID NO: 178850 - protein, 62 aa, Glycine max
  Coding DNA Sequence Number=SeqID_87165
MKTKLVFVTCDDVLNWARAIAYEIGFVTVIMRSDTNTSMRGTSFVLIGCERSGQYRSKKKDF

SEQ ID NO: 178851 - protein, 242 aa, Glycine max
  Coding DNA Sequence Number=SeqID_87166
  Gene Ontology: Mol. function=motor activity; Cellular component=cell projection
  Homolog annotation: Hit_ID=UPI00016621D1; Match level="QueryCoverage =98%, HitCoverage=41%, E-value=6e-21, Identity=37%"; Hit description =UPI00016621D1 related cluster
LHALTFRGLHVLHFRGLHAIAFVGLHTLTFRGLHVLTFRGLHILTFRGLHAITFRGLHVLHFRGLHVLAFRGLHVLAIRGLHVLAIRGLHVLAIRGLHVLAIRGLHALAFVGLHALTFRGLHVLTFRGLHVLAFRGQHVLAFALVGLDALIFRGLQVLAFRGLHVLTFRGQHVLAFAFVGLDALTFRGLHVLAFRGLHVLTFRGLHVLTFRGLHVLAFRGLRVLIFRGLHVLTFRGLHALTF

SEQ ID NO: 178852 - protein, 166 aa, Glycine max
  Coding DNA Sequence Number=SeqID_87167
MPKCQLVWRPTRHPLDPDKSNRALGFPALITGLCQSFGVPVAPTKAQGDAPQAAGAPPPPHQAGQAGAFDMEQYLRHLVRQQAANHRAHVRTHDCLYQMSLSMQSQGFASFSCPTPDQFRAEVAWPGDWPEAQAGEAPPEAPGDGEEAHEDEEMTDLLDFLGGSGD

SEQ ID NO: 178853 - protein, 123 aa, Glycine max
  Coding DNA Sequence Number=SeqID_87168
  Homolog annotation: Hit_ID=A5AVU2; Match level="QueryCoverage=44%, HitCoverage=22%, E-value=3e-08, Identity=60%"; Hit description =Putative uncharacterized protein
MTCEDRKVTAQDLRLKLQRKGLHPGGQTGKSSVHGERDLRERLSGTMTQQPKNYDPPKPKVAAKPSSKSIHVETPAVHINRSANPTPKKLSRKNCLAGMSIVVFVMFCCHVFLHIQHCIDLNL

SEQ ID NO: 178854 - protein, 135 aa, Glycine max
  Coding DNA Sequence Number=SeqID_87169
  Homolog annotation: Hit_ID=Q6UUU1; Match level="QueryCoverage=63%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFGYRCHSAVMA

SEQ ID NO: 178855 - protein, 52 aa, Glycine max
  Coding DNA Sequence Number=SeqID_87170
MCRNVPFAGERGRGSRVDKSGAFAPTYPPLERKSDLRSSFLSVNQAILLLEE

SEQ ID NO: 178856 - protein, 164 aa, Glycine max
  Coding DNA Sequence Number=SeqID_87171
  Gene Ontology: Mol. function=protein transporter activity; Cellular component=membrane; Biological process=protein secretion
  Homolog annotation: Hit_ID=A1JJV7; Match level="QueryCoverage=67%, HitCoverage=28%, E-value=3e-24, Identity=56%"; Hit description =Putative type I secretion protein precursor
  Pfam annotation: Domain name=Biotin_lipoyl; Domain location=30-85; Score=-14.0; E_value=0.098; Accession=PF00364.13; Description=Biotin- requiring enzyme
MSALVAHCRENRKTLVTVTHNPRLLPLFDRVLRMSQGRLVAEPTDDARMNDCAEVNVGAQVNGQLKKLYVKQGDRVIQGQLLAEIDPTLQLNELRKSQAELRSAQAQKLASQAQLKQYQLELKRQRALARDRAGVAGDLEKAQAQHDAQLAQLKVNESQIVQAK

SEQ ID NO: 178857 - protein, 113 aa, Glycine max
  Coding DNA Sequence Number=SeqID_87172
MGKAKEVQEKVKAYMEAMKEKMATMMEAMMSMKRIMEANAVTIAATSTVAKVNPMPPSGLNQMNHPTLDMVGKDLGSRDGPHDVQNQNKHAFPPYGLPPNYTPPNVAYTPNED

SEQ ID NO: 178858 - protein, 110 aa, Glycine max
  Coding DNA Sequence Number=SeqID_87173
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=84%, HitCoverage=13%, E-value=1e-37, Identity=83%"; Hit description=DNA -directed RNA polymerase subunit beta'
GAIREQLADLDLRILMDSSLIEWKELGEEGSPDNENEWEDRKVGRRKNFLVRRIELAKHFLRTNIEPEWMVLCLLPVLPPELRPIIQIDGGEIGTRSRDTLLDNGIRGHR

SEQ ID NO: 178859 - protein, 174 aa, Glycine max
  Coding DNA Sequence Number=SeqID_87174
  Gene Ontology: Biological process=transposition, DNA-mediated
  Homolog annotation: Hit_ID=Q1J7G7; Match level="QueryCoverage=18%, HitCoverage=47%, E-value=2e-11, Identity=96%"; Hit description =Transposase
MCRNCPKSSWYHSRAMKTFQLLMENGVTKGEHYPISPAHRLSLPYEIPDEHSSGGQESERSGYRYIEQLTEMPQNVLYDAIGIYQRCWNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 178860 - protein, 242 aa, Glycine max
  Coding DNA Sequence Number=SeqID_87175
APLEEEIAPVISRGFNKTSVETLQKVYKAWEVVRKKDKELRGGNNGPIGGYRKTAKREEVEAPEEDEEVQALRTELKQARTVKERFKSVALNIRKENAELRDINIATTKALEQETKRARREEHGRNKFRGAMWGKTNMLAIVSKYQEELNLATAHEHIVEDEYAQVYAEKEARGWVIDWLHPEARMWMDRFALTLNGSQELPRLLAKAKEMADTYSAPEEILRLLDYCQHMIDLMAHIIRNR

SEQ ID NO: 178861 - protein, 136 aa, Glycine max
  Coding DNA Sequence Number=SeqID_87176
MARRDQVWSFCTHDTRRYLTVICTPLLGRHSCVRWHAETKFGHSAPMIRGDTLWCLAPLRHICESMGTKFGHSALWRSLCTPARQIERDEIVSYLYFFDGKQRPSLVILHPRYAEIPYGYPHPFARQTQFVSDGTQ

SEQ ID NO: 178862 - protein, 141 aa, Glycine max
  Coding DNA Sequence Number=SeqID_87177
  Gene Ontology: Mol. function=kinase activity; Cellular component =cytoplasm
  Homolog annotation: Hit_ID=A2YG45; Match level="QueryCoverage=60%, HitCoverage=30%, E-value=5e-42, Identity=100%"; Hit description =Putative uncharacterized protein
  Pfam annotation: Domain name=DUF1040; Domain location=1-88; Score =208.3; E_value=1.9e-59; Accession=PF06288.4; Description=Protein of unknown function (DUF1040)
MKCKRLNEVIELLQPAWQKEPELNLMQFLQKLAKESGFDGELADLSDDILIYHLKMRDSAKDAVIPGIQKDYEEDFKTALLRARGAFTFQTLHPDTIMDALFEQGIRVDSGLTPLNSYENRVYQFQDEDRQRFVVKIYRPE

SEQ ID NO: 178863 - protein, 124 aa, Glycine max
  Coding DNA Sequence Number=SeqID_87178
YMMNSVIIILYFNGRVYEETDGVIFEDSKKVIQIKREISFNALKKKLEIRFLVSGKYVALQICDDEDVETMLESFQQQNQMSVLELYIEKDVVGGSMFHSANSLISCGNNLSNNEAQPPTNVSN

SEQ ID NO: 178864 - protein, 83 aa, Glycine max
  Coding DNA Sequence Number=SeqID_87179
MDKSLEVGEDEWRERERGGNKIYASSEQANVHLPLRLVSQRALHGRARARLMGALPKGGKMRGVATNVYLWKTSGKPKETGQK

SEQ ID NO: 178865 - protein, 76 aa, Glycine max
  Coding DNA Sequence Number=SeqID_87180
MRQTRPYSGMTPVNERQEQRAHEGAARGKRLGGGAYGKTALPRPSHFPVKYLPGIFQEISAPFVSHFRSPQSNDRA

SEQ ID NO: 178866 - protein, 399 aa, Glycine max
  Coding DNA Sequence Number=SeqID_87181
  Homolog annotation: Hit_ID=Q9AVH2; Match level="QueryCoverage=44%, HitCoverage=74%, E-value=4e-63, Identity=61%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRGLASVRPGTHLVSTRQANEREPTNGEGRSKRQGPESQWIVAARPLCHLQLPVAYLKSSAKGFFPPLDGNCAFKASRRANPPHEGHQRHVPFGGPRPPTAGRQTDRRGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGI

SEQ ID NO: 178867 - protein, 147 aa, Glycine max
  Coding DNA Sequence Number=SeqID_87182
  Homolog annotation: Hit_ID=Q5QJQ3; Match level="QueryCoverage=51%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDLEELVLKSCAGKAKLKGQVLVTALSSQLPRFKSW

SEQ ID NO: 178868 - protein, 132 aa, Glycine max
  Coding DNA Sequence Number=SeqID_87183
  Homolog annotation: Hit_ID=Q6UUU1; Match level="QueryCoverage=71%, HitCoverage=82%, E-value=3e-24, Identity=55%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPRALSVCFGY

SEQ ID NO: 178869 - protein, 349 aa, Glycine max
  Coding DNA Sequence Number=SeqID_87184
  Gene Ontology: Mol. function=protein binding; Cellular component =protein complex; Biological process=ubiquitin-dependent protein catabolic process
  Homolog annotation: Hit_ID=Q8W424; Match level="QueryCoverage=21%, HitCoverage=32%, E-value=2e-25, Identity=67%"; Hit description=26S proteasome regulatory particle non-ATPase subunit8
  Pfam annotation: Domain name=Transposase_23; Domain location=10-69; Score=-9.3; E_value=0.012; Accession=PF03017.5; Description =TNP1ENSPM transposase
MSNQVEEQNKRSLEKMEWELKEAIKIELSQSVAYADDVVKVNVEKVFDGDAQVPFPSSEMQYVKQSLDTFITWPTQLVKLVSHEDSVITPNKLVTLVRRSNNVATNDPLCRLIRSLYDIYDKPIELLFDGTKFGIPDVDGLWMSGVQAWVMVPCMDSLSLSPYTMQKIDVVNVNNTLKHGLRNPNQSAMNTLKTTLHGRIDQAAPKWIEVKLLRHALDAEIVSRELNTDWTMVWGWHTVRQGDHDNNSQEMGIIFFKTYGFLPPIFATFEAIQEGKELGIPTKAYYVVEEVKENATQKSQKVFVYVPFEIAAREVKEIALKGLDARLKEIRGYLDLVIDGKLPLNHEIL

SEQ ID NO: 178870 - protein, 197 aa, Glycine max
  Coding DNA Sequence Number=SeqID_87185
  Gene Ontology: Mol. function=oxidoreductase activity, acting on the CH-OH group of donors, NAD or NADP as acceptor; Cellular component =glyoxysome; Biological process=tricarboxylic acid cycle intermediate metabolic process
  Homolog annotation: Hit_ID=Q5JC56; Match level="QueryCoverage=26%, HitCoverage=14%, E-value=5e-18, Identity=86%"; Hit description =Malate dehydrogenase
  Pfam annotation: Domain name=AhpC-TSA; Domain location=97-197; Score=- 20.4; E_value=0.053; Accession=PF00578.12; Description=AhpCTSA family
  Pfam annotation: Domain name=Ldh_1_N; Domain location=26-117; Score= -49.2; E_value=0.029; Accession=PF00056.14; Description=lactatemalate dehydrogenase, NAD bind
  Pfam module annotation: Pfam domain module=AhpC-TSA::Ldh_1_N; Domain location=97-197::26-117
MVYKGQDSTSQLHWGPHLSLSHPTWILPGRGNVCPIQHLASNDFLVLTEFFHACPLVVNLINLAYSVEIRMVAGLWLSGSCPNAIVNFISNPVNSTVAIAAEVFKKAGTYDPKGLLGVMTVDVVRANTFVVKPHNSFTSEGKRRPCAFTDSYEKFKKAGAVVVGISGHDVASHNALASKYTLPFTLLSDEGNKVREQ

SEQ ID NO: 178871 - protein, 451 aa, Glycine max
  Coding DNA Sequence Number=SeqID_87186
  Gene Ontology: Mol. function=cation transmembrane transporter activity; Cellular component=integral to membrane; Biological process=cation transport
  Homolog annotation: Hit_ID=O64455; Match level="QueryCoverage=97%, HitCoverage=97%, E-value=1e-177, Identity=73%"; Hit description =Ca2+/H+ exchanger
  Pfam annotation: Domain name=Na_Ca_ex; Domain location=104-252; Score= 104.3; E_value=3.7e-28; Accession=PF01699.15; Description =Sodiumcalcium exchanger protein
  Pfam annotation: Domain name=Na_Ca_ex; Domain location=293-426; Score= 117.1; E_value=5.1e-32; Accession=PF01699.15; Description =Sodiumcalcium exchanger protein
  Pfam module annotation: Pfam domain module=Na_Ca_ex::Na_Ca_ex; Domain location=104-252::293-426
MGSRNHEVSMLMENGGGGNIVKGLSKEMRHGRTAHNMSSSSLHKKSDLTLVSKVHSIPLRNVLVNLQEVVLGTKLSILFPAIPLAVVAQCYGFGRPWIFALSLLGLTPLAERVSFLTEQLAYYTGPTVGGLLNATCGNATELIIAIFALSNNKIHVVKYSLLGSIISNLLLVLGTSLFCGGIANIRKEQKYDRRQADINLLMLFVALLCHLLPVLFHYVGASAADTAESSLQLSRAASIVMVIAYCAYLVFQLWTHRQLFEAQDEVDEEGGNESEEAVIGFWSAFAWLVGMTVIIALLSEYVVQTIEDASDSWGLSVSFLSIILLPIVGNAAEHAGAIIFAFKNKLDISLGVSLGSATQISMFVVPLCVIVAWIMGIKMDLNFNILETGSFAVAITITAFTLQDGTSHYMKGLVLLLCYIVIGACFFVQRTPSNVANITLKSATEAVFRAQ

SEQ ID NO: 178872 - protein, 175 aa, Glycine max
  Coding DNA Sequence Number=SeqID_87187
MSFREDHFWKNLLTESFRKTLLPENFRKTLLSKEDFVIPEKIRNTFRKNFIRNVSGRRFFRKITFFFRKEALKIWWSREVGVPYLKIWWSPVKQERIYGYFCVFWLVFREEKQQKVVSGRNFKYRRKKFRNENVVFPKELLPEVTKAVPEEVVPEVFSGTTSPGMGHSNFQKKCF

SEQ ID NO: 178873 - protein, 499 aa, Glycine max
  Coding DNA Sequence Number=SeqID_87188
  Gene Ontology: Mol. function=cation transmembrane transporter activity; Cellular component=integral to membrane; Biological process=cation transport
  Homolog annotation: Hit_ID=O64455; Match level="QueryCoverage=90%, HitCoverage=96%, E-value=1e-142, Identity=62%"; Hit description =Ca2+/H+ exchanger
  Pfam annotation: Domain name=Na_Ca_ex; Domain location=124-272; Score= 82.9; E_value=1e-21; Accession=PF01699.15; Description=Sodiumcalcium exchanger protein
  Pfam annotation: Domain name=Na_Ca_ex; Domain location=312-445; Score= 113.9; E_value=4.8e-31; Accession=PF01699.15; Description =Sodiumcalcium exchanger protein
  Pfam module annotation: Pfam domain module=Na_Ca_ex::Na_Ca_ex; Domain location=124-272::312-445
  Subcellular localization annotation: CTP_CleavageSite=55; ConfidenceScore=5.04e-01
MASRNHEVSMVKENGGGGNNLKGLSKEMRHGRTAHNMSSSSLRKKSDLTLVSKVCSGHVRNVLVNLQEVILGTKLSILFPAIPLAIVAEGYGFGRLDRTLVIINHCTYNFYFRLPLYVCMLILVLFALLVFGTFKFGRQVAFYTGPAVGALLNATCGNATELIIAIFALSHNKIALVKYSLLGSIISNLLLVLGTSLFIGGLANLSQEQKYDRKQADMNLLMLFVALLCHLLPLLFHYVGASAADTGDSSLQLSRAASIVMVIAYCAYLVFQLWTHRQLFEAQNEDDEEGGSDSEAVIGFWSGFTWLVGMTMTIALLSEYVVQTIEDASDSWGLSVSFLSIILLPIFGNATEHAAAIIFGFKNKLDISLGVSLGSSTQISMFVVPLCVIVAWIMGIKMDLNFNLLETASLSLAITITAFALQDGTSHYMKGLVLILCYIVIGACFFVQRTPPKRCVPVSSSMRLFIFIHLFICSPEHKFKIITGSKHNNTQGVSYHIPS

SEQ ID NO: 178874 - protein, 513 aa, Glycine max
  Coding DNA Sequence Number=SeqID_87189
  Homolog annotation: Hit_ID=A7PP47; Match level="QueryCoverage=100%, HitCoverage=81%, E-value=1e-113, Identity=77%"; Hit description =Chromosome chr8 scaffold_23, whole genome shotgun sequence
  Pfam annotation: Domain name=LMBR1; Domain location=11-513; Score =286.1; E_value=7.2e-83; Accession=PF04791.7; Description=LMBR1-like membrane protein
MGDFNLALVIVAIVVCVIVFLFNVYLLVNFQHPDDVNQAYFPKFVVVLGLSVAAISILMLPADVANRQACRHAIYNGACSLTLPMKDLWLAIYILDAVLVFFVIPFAMFYYEGDQDKSVGKRIKSALLWMVTTAIVCALVLGILYVVLSLLFCFVFVCEVGDFDSFMLLITCWLVLGRHRNPLVVVLPALDVKLNTMHPSRNNFHIKEKKFRAIPGLHLRGCVRDINFCSLHLTGLIGKVDFTVRHLSSSTSQFPSTWDFNSGQQCIGSTHQCSAFTASPSSEKTWTMRTTFPEYVVALATIVGSVLFAIFGGVGIACLPLGLIFSFIRRPKAVITRSQYIKEATELGKKAKELKKAAESLHQEERSGSKGRKFRKNVKSVEKELFQLEEDVKLLEEMYPQGEKAETTWALTVLGYLAKFVLGILGLIVSVAWVAHIIIYLLIDPPLSPFLNEVFIKLDDIWVILHDVCILLSSGLLGTAAFAFFCFYLLLAVIAGAMMLGLRLVFITIHPMK

SEQ ID NO: 178875 - protein, 105 aa, Glycine max
  Coding DNA Sequence Number=SeqID_87190
MLTLSAKPTTQQLAAHCRAHIVALIGGVLIPDKLAAGVSLSEACALSENHALSEGLSPLSELGESGGESKKHLQAQHIISSLSETLVSSCAKRAQLAQRMFTYSR

SEQ ID NO: 178876 - protein, 70 aa, Glycine max
  Coding DNA Sequence Number=SeqID_87191
  Gene Ontology: Mol. function=protein serine/threonine kinase activity; Biological process=protein amino acid phosphorylation
  Homolog annotation: Hit_ID=A5YJW0; Match level="QueryCoverage=72%, HitCoverage=6%, E-value=7e-17, Identity=80%"; Hit description=LYK11
MATKRLKKLLEARKSSSRDTSAHSPLSWIIKVQIALNVARGLEYIHEHTKTHYVHRDIKTSNILLDASLR

SEQ ID NO: 178877 - protein, 116 aa, Glycine max
  Coding DNA Sequence Number=SeqID_87192
MTRRLEVGGWNYLTSHGMEEVRVLRGEEIEEGVVGVDGVGAAAGEGSGVGGGGVDKIRMSMSMSVRVSGGQQTRVQCERRRHIIRMSSTSGHDHVEVFLRFEPIDNPKIPHRSCIY

SEQ ID NO: 178878 - protein, 144 aa, Glycine max
  Coding DNA Sequence Number=SeqID_87193
  Homolog annotation: Hit_ID=Q6UUU1; Match level="QueryCoverage=41%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKYQAFPPGGSLVRSPVPAFRFTGVIPLYGRVCLIPRLTLSS

SEQ ID NO: 178879 - protein, 154 aa, Glycine max
  Coding DNA Sequence Number=SeqID_87194
  Homolog annotation: Hit_ID=A5BSR3; Match level="QueryCoverage=38%, HitCoverage=19%, E-value=3e-07, Identity=45%"; Hit description =Putative uncharacterized protein
MTHTKKTGQMTSEAAKEIAEKINSLQEQASQGFFVAHGRQDVLTAAIGRPEYPGRVRAAGAGNNPDTRDSDKCGVYIEENPPCLVALGNVYEGSTTVRNITLLHDQVKVGVEEVRDVDAPIPVPTEEVKLVGQTLNIFLAWLTHLVKRLSEQVF

SEQ ID NO: 178880 - protein, 308 aa, Glycine max
  Coding DNA Sequence Number=SeqID_87195
  Gene Ontology: Mol. function=receptor activity; Cellular component =outer membrane-bounded periplasmic space; Biological process=amino acid transport
  Homolog annotation: Hit_ID=Q6D596; Match level="QueryCoverage=100%, HitCoverage=77%, E-value=1e-162, Identity=87%"; Hit description =Putative substrate-binding periplasmic transport protein
  Pfam annotation: Domain name=ANF_receptor; Domain location=23-289; Score=-59.5; E_value=0.091; Accession=PF01094.19; Description =Receptor family ligand binding region
AADTIKVGIMHSLSGTMAISETPLKDVALMTIDEINAKGGVLGKKLEPVVVDPASNWPLFAEKARQLLTQDKVAVVFGCWTSVSRKSVLPVFEELNGLLFYPVQYEGEEMSPNVFYTGAAPNQQAIPAVQYLMSEDGGSAKRFFLLGTDYDKDIEEMYTPFGYSDYQTIVSNIKKFSAGGKTAVISTINGDSNVPFYKELANQGIKATDIPVIAFSVGEEELRGIDTKPLVGQLAAWNYFESVDNPTNAKFVADYRAYAKAHNLPNASTVVTNDPMEATYVGLHMWAQAVEKAGTTDVDKVRAAMAGQ

SEQ ID NO: 178881 - protein, 121 aa, Glycine max
  Coding DNA Sequence Number=SeqID_87196
MARTRGLGRAIGRLVGRGRHDDHDAADVPERRRPTALARRQRVHQMTADARDMAEDVADMTDDVPDLAAEAPEMRVDVQGADGAKGSDADDAAKGFPGGPRDPSVLASFADHVAHVFWSEQ

SEQ ID NO: 178882 - protein, 105 aa, Glycine max
  Coding DNA Sequence Number=SeqID_87197
MTKLGLCLSSGRPPLDDKRVPNNHKVSRVSWVQNDQTWSLLSSGPPLWMTKGMTKLGLCLSSGPPPLDDKRNDQTWSLLVIRARRLGDRRRGADNRKVSPRATSS

SEQ ID NO: 178883 - protein, 141 aa, Glycine max
  Coding DNA Sequence Number=SeqID_87198
MKSLRGKEITLVKVQWGPDEGDSTWELKDRVRELYPTKRIQKLFSLILTLLFLPFSSTIEASIKAPNFTHHFCSKSQKEAIFGVVKRTSMLWDFKFQLFVKFVESMLNLSCLIKLIKMKGRVNLGLKSENGSDMNGKSVRL

SEQ ID NO: 178884 - protein, 185 aa, Glycine max
  Coding DNA Sequence Number=SeqID_87199
MTQELVARGDTLRLSAPRHSVTPSVIDEQRPMWSSAPFPEMSASSSGDFFKSHKLSRTTHSRVPMARRDKSRSFCTLCHPEAAGPIRGDTKLRSYPPPFAIQTQSCSMARRDQVWSFCTHDTRRYLMGLTQSSAPFVPPGTTKSFTCGNFMVTRDSRQPRGAKLVSYADFRGPLLDDMRPFFWSL

SEQ ID NO: 178885 - protein, 142 aa, Glycine max
  Coding DNA Sequence Number=SeqID_87200
MAHLVRYRVHKALRANAPLSYPQLVTLFLQHFNVPLDEEPFVKVKCSFAIGAAAVASFGYRKDMDGQWVWKQDLSPTVPDESTPSPPPQRDSSSSLLHDVLTKLQDLRAFVGDHFDVMDSCITRLEDDLSFIHQCFDPPVDP

SEQ ID NO: 178886 - protein, 82 aa, Glycine max
  Coding DNA Sequence Number=SeqID_87201
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=31%, E-value=4e-11, Identity=93%"; Hit description=LacZ protein
MESYLGGLTMEAHPPFASWRNSEEARTDRPSQQLRSLNGEWDAPCSGALSAAGVVVTRSVTATLASADVRRAFAVTHHPVSS

SEQ ID NO: 178887 - protein, 61 aa, Glycine max
  Coding DNA Sequence Number=SeqID_87202
MDVMDWCELGRIDGDPVLRETRIWATWEYVSSDGGGQQGMVGLCAHCGRGKLVVHHRPTAT

SEQ ID NO: 178888 - protein, 221 aa, Glycine max
  Coding DNA Sequence Number=SeqID_87203
  Gene Ontology: Mol. function=chloramphenicol O-acetyltransferase activity; Biological process=response to antibiotic
  Homolog annotation: Hit_ID=P62577; Match level="QueryCoverage=71%, HitCoverage=77%, E-value=1e-79, Identity=86%"; Hit description =Chloramphenicol acetyltransferase
  Pfam annotation: Domain name=CAT; Domain location=6-171; Score=225.4; E_value=1.3e-64; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGQSLGGVSPVLIKRGHMDNFFAPFSPWAILYARRQGADAAGDSVVLLHVFPGWTQDDSYRIRRSGRTERGVRAYSPAWSELPTRN

SEQ ID NO: 178889 - protein, 92 aa, Glycine max
  Coding DNA Sequence Number=SeqID_87204
MTKLGLCLSSGPPPLDDKRGQYDKDYGAADKSKALAPTYPPMRNSDLQDAYISGKGADDHIGLCLINHTRGADNRKVSPAGYQLLVMGNQKA

SEQ ID NO: 178890 - protein, 76 aa, Glycine max
  Coding DNA Sequence Number=SeqID_87205
MAVEWRRKGERRRQFKEKMSLEEAHHHRRPWIRAWRKNEMNEGRGREEHKILCSKRALKSKPTNSISSPRFSTKYA

SEQ ID NO: 178891 - protein, 111 aa, Glycine max
  Coding DNA Sequence Number=SeqID_87206
MRVFTCRGMQEGYTTNCLALPWHIQARSKSVDCGGEFMCPPHGLRDMCMISLGLLALNGYRSGVIDILIGSVRHFGWRIVERQAIWREGVLVLNLYIMGAARTSQIFAYHI

SEQ ID NO: 178892 - protein, 165 aa, Glycine max
  Coding DNA Sequence Number=SeqID_87207
  Homolog annotation: Hit_ID=Q84VH5; Match level="QueryCoverage=97%, HitCoverage=41%, E-value=5e-24, Identity=72%"; Hit description =Envelope-like protein
DRYAVSEHQIAKEITAKQVQYWPKKGKLSAGKLSVKYAILHRIGAANWVPTNHTSTIATEIQQVKRIKPRLGLDILTPRAPNLLQVLCPGDLIDLEEVESMKEPIANRCGTGIAESTSKQRREETCLRGTGRIKTMAQKKSTPITPTRSRLKQSQLIPEEGKKFI

SEQ ID NO: 178893 - protein, 86 aa, Glycine max
  Coding DNA Sequence Number=SeqID_87208
MLFLLSFPKTLSFSRRPPNLSQKNDDLGLFHRWIVVKFKNQYSWWEKKESHEDSTSRSFNLFSVSLTFGNSIGAVGGITEGISRNC

SEQ ID NO: 178894 - protein, 88 aa, Glycine max
  Coding DNA Sequence Number=SeqID_87209
MGLAVSGIHKIQKKLNEVEDLASNRNLSDDEIKAKRELQQELWEASIAYESLLRQKSRGRQVETSTQIKNRRQVQALFRPRKLLKCGK

SEQ ID NO: 178895 - protein, 45 aa, Glycine max
  Coding DNA Sequence Number=SeqID_87210
MPEIKRRVFFEAGLLLEEAKKQPISPGRAKVAWASWAATSSPFFL

SEQ ID NO: 178896 - protein, 25 aa, Glycine max
  Coding DNA Sequence Number=SeqID_87211
MEAKAQKWWPRGEKPLIPGLLAQAS

SEQ ID NO: 178897 - protein, 65 aa, Glycine max
  Coding DNA Sequence Number=SeqID_87212
MSMFLLTSALKGFNDKHSNKSKANGKRISVKNFIDPRTLEPQRIKVIHIEWAKCLVRVKNEVLSV

SEQ ID NO: 178898 - protein, 37 aa, Glycine max
  Coding DNA Sequence Number=SeqID_87213
MDEAMKRQCKVNLYRTAFCSLLASAPDHASSIKRCVK

SEQ ID NO: 178899 - protein, 63 aa, Glycine max
  Coding DNA Sequence Number=SeqID_87214
MNPFKKGGNDRGVTSLSIDPLHEIRGSMTRSKTKRMKQTLQDLILKIKEKEDHVVACNYQCIE

SEQ ID NO: 178900 - protein, 133 aa, Glycine max
  Coding DNA Sequence Number=SeqID_87215
MRNCAQTQQQSLSSIDRRGWMVAHQSNELPVCDTFLELANPYLCCSTPVSAQGVRSFDVLVKDAKDTQGEGQKGHFKQFYGLWLAWAPKLLRAEGTSLPRRAAAHLGEPISSGLSISSPRRAAIVPNALISYK

SEQ ID NO: 178901 - protein, 168 aa, Glycine max
  Coding DNA Sequence Number=SeqID_87216
MDKSLKVKEDEWREKERRSMKFCASKELWFSPLIQDQVQDSPLSVLRCHEASHGPKIYPKAHENPKAFSCIPGSIYLESSIQCPCTVGLHQGMSPPPLGISQSLKNSLISLKDENLAPCSALHSLKFTLFRPLSSKQFSWLPHNFVQIRLKKGFLISTSRLAPLLRLA

SEQ ID NO: 178902 - protein, 80 aa, Glycine max
  Coding DNA Sequence Number=SeqID_87217
MSIFLDLKPHEGAAIAFGGIAKGKIFGIGKIGIPSLSSIDNVVYVEGKSGLPENAPDRQVFKIKTDESEYRTQGTSLRQS

SEQ ID NO: 178903 - protein, 108 aa, Glycine max
  Coding DNA Sequence Number=SeqID_87218
MKKSPSASFSSLSYPNFVRGQLFVDMRIFASHIELLKANCCVIRKGVFFSPGPIWAHQEEATNSPGRACCFKLKPPACLGELGGKLLLHFPYKMALEAEGKGFSPFGN

SEQ ID NO: 178904 - protein, 219 aa, Glycine max
  Coding DNA Sequence Number=SeqID_87219
  Subcellular localization annotation: CTP_CleavageSite=48; ConfidenceScore=5.21e-01
MYPLLFSVTKTQVDVPSTCTAKDVPSNVLRQSSQAEKGDTTEFRRLVLCSFGKGRRETQKEFRQLVLVEFFLAKGEERHKRIQAVSPSFFWQREKRMKRYSTLLFSVKEQGLETKKLRKLLAKEEEEEEVQKDVQKVMKKLLKCKSRSCFYRLFMSGQENHWKSYNLEKILRKALEELHLLIFIQNLSLAIDYQNHVIDYTKHFMKRCDSSQLNLNFNV

SEQ ID NO: 178905 - protein, 79 aa, Glycine max
  Coding DNA Sequence Number=SeqID_87220
MAVMNEVRVWSRGGMKPRLFWEAALMECNLKERRKTESEVVDEGDKKLIKQALRSVAFHLLAKPICWLSESPLSATLMG

SEQ ID NO: 178906 - protein, 126 aa, Glycine max
  Coding DNA Sequence Number=SeqID_87221
MGHWVIDYQIVMAAQLIHDRVEMECLEGVWETLEGNTRCRFRGIIRFTMTSLVHPDEPVRTLLRTVEWILPTPTPYRLVEPVQVIEGDEDPLPEVDSPEEVMSASKADSTEDSGPREMATSGGSSS

SEQ ID NO: 178907 - protein, 124 aa, Glycine max
  Coding DNA Sequence Number=SeqID_87222
  Homolog annotation: Hit_ID=Q64N96; Match level="QueryCoverage=95%, HitCoverage=55%, E-value=9e-51, Identity=79%"; Hit description =Putative uncharacterized protein
  Pfam annotation: Domain name=DUF1349; Domain location=1-116; Score =78.8; E_value=1.8e-20; Accession=PF07081.2; Description=Protein of unknown function (DUF1349)
MGLILRVDKENYIKAGIEFVDGKYNLSTVVTHTTSDWSVITLDKIPSAIWIKAVRRLDAVEVFYSFDDKNYIMMRNAHLQDNTPVMVGLMAACPDGAGFNAVFENFKVKHLPDERRLQWLDNHQ

SEQ ID NO: 178908 - protein, 183 aa, Glycine max
  Coding DNA Sequence Number=SeqID_87223
  Homolog annotation: Hit_ID=Q6UUU1; Match level="QueryCoverage=61%, HitCoverage=98%, E-value=3e-20, Identity=47%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKRYQAFPPGGSLVRSPVPAFRFTGPGRQFAPSWTVCTNPPFSPTAAPYPVTIVLSPNPGKDMQKHHWQQPL

SEQ ID NO: 178909 - protein, 162 aa, Glycine max
  Coding DNA Sequence Number=SeqID_87224
  Gene Ontology: Biological process=transposition, DNA-mediated
  Homolog annotation: Hit_ID=Q1J7G7; Match level="QueryCoverage=18%, HitCoverage=42%, E-value=2e-10, Identity=100%"; Hit description =Transposase
LPGINRDTRIYFILRSDLPSQWLLFLSAVPPVQLLTGWCVTAKAPPDISAGKCSGHAARRVPFAIQAAQLLGRAIGAGLFAITPAGERGMCCKAIKLVVTSQQPPLYPYYACGWREKGTEQQMMTYDKDSLTGGLSYESGATKDALTHYPNHKHSHNAGTLS

SEQ ID NO: 178910 - protein, 171 aa, Glycine max
  Coding DNA Sequence Number=SeqID_87225
  Homolog annotation: Hit_ID=A5B5G7; Match level="QueryCoverage=88%, HitCoverage=10%, E-value=5e-07, Identity=28%"; Hit description =Putative uncharacterized protein
MDGHIDVALVKEFYANLYDPEDKSPRQVRVRGKLIKFDVASLNAFLETPPVLEPGEQYIAYTKFCSTRIEPQEMAAKLYIPRKGFVFNAEGVPWKLLGKDLTTLAQTWSILSYSNLAPTSHMSNLNMDRARLVYGLVMRMDMDVGSLISGQISQMAQSNSSKLGFPALITA

SEQ ID NO: 178911 - protein, 37 aa, Glycine max
  Coding DNA Sequence Number=SeqID_87226
MLRNFTDCLTMGVKFLEAVKRRLHAIKQWSPDEIRPK

SEQ ID NO: 178912 - protein, 97 aa, Glycine max
  Coding DNA Sequence Number=SeqID_87227
  Homolog annotation: Hit_ID=UPI0000ECBAF8; Match level="QueryCoverage =42%, HitCoverage=48%, E-value=1e-16, Identity=100%"; Hit description= UPI0000ECBAF8 related cluster
MVIDYQRLISRYHPRYIAGQPPHKPPCFVDFVLLLVDCQELACLGMQAWHWPSFYNVVTGKTLALPNLIALQHIPLSPAGVIAKRPAPIALPNSCAA

SEQ ID NO: 178913 - protein, 223 aa, Glycine max
  Coding DNA Sequence Number=SeqID_87228
  Gene Ontology: Biological process=transposition, DNA-mediated
  Homolog annotation: Hit_ID=Q6UUU1; Match level="QueryCoverage=26%, HitCoverage=40%, E-value=2e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGIRSTPQQDDVELRLVELIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 178914 - protein, 120 aa, Glycine max
  Coding DNA Sequence Number=SeqID_87229
  Homolog annotation: Hit_ID=Q1J7G7; Match level="QueryCoverage=26%, HitCoverage=58%, E-value=6e-07, Identity=68%"; Hit description =Transposase
IFVTGIYSAQSASAVPPVQLLTGWCVTAKAPPDISAGKCSGRVPFAIQAAQLLGRAIGAGLFAITPAGERGMCCKAIKLGNASVFPSHDVVKRRPEFDLALPENIKHMCDQQYIKKLAVL

SEQ ID NO: 178915 - protein, 211 aa, Glycine max
  Coding DNA Sequence Number=SeqID_87230
MGEVKEVQKQMKANMEAMKEKMATMMEAMISMKKIMEANVVVVAATNAFAKVNPMPPSGLNQMNHPTSSMVGKDLGSTGDPYYVQIQNKHAFPPYGLPPNYTPPNVAYTLDEDVNNSTPILIESRQPYHAHVSQPMGDTHEMPHHNLADFEPCLGYATEAKAVGGIPLQNTLEGPQYHPQPHPLHSTAGKNPQAMAEMGEVGSSKGMAQGH

SEQ ID NO: 178916 - protein, 106 aa, Glycine max
  Coding DNA Sequence Number=SeqID_87231
MDTTIVFHGEPVIPYPQDLSGHSTPVGVRSKGTLVNIHLYLLSFPGIHTSEQNHVMQIPMRGQLKHGCQSGKRIGHLILLPRNVVEGYVLEELYELLDVSLVGYHL

SEQ ID NO: 178917 - protein, 168 aa, Glycine max
  Coding DNA Sequence Number=SeqID_87232
  Homolog annotation: Hit_ID=A5BSR3; Match level="QueryCoverage=38%, HitCoverage=20%, E-value=1e-07, Identity=46%"; Hit description =Putative uncharacterized protein
LTRKWALAVDQDSVEDTVCEKYGISKEKWAQFCQTRRHPSWEDVRKKAQASQKQKLLAEKTKKKLEEAAQSGSVDGFIDPPSPVRRHVKWKMARMKKTGEMTTEAAKEIAEKIDSFNEQATQGSFVPHGRQDVLTAAIGCSHLRQSLNLASQSYIRQITSMEKLHSLS

SEQ ID NO: 178918 - protein, 129 aa, Glycine max
  Coding DNA Sequence Number=SeqID_87233
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A7PN41; Match level="QueryCoverage=58%, HitCoverage=42%, E-value=1e-36, Identity=97%"; Hit description =Chromosome chr14 scaffold_21, whole genome shotgun sequence
MGGASSSILVHGFSWLYGSSGGEIELQEIVNGLINTQMYNSPGILIALLFITVGIGFKLSPAPSHQWTPDVYEGVRCYIVGSHPSETTSIIGSIRQQKDHPKMIISWLLRTNQIRWFYFLFLMFSISVP

SEQ ID NO: 178919 - protein, 101 aa, Glycine max
  Coding DNA Sequence Number=SeqID_87234
MKILKGYTKNLHHPEASIVERKNLLGFPSVDKKREWECKWVDSNIGVQTDDFGFTLVDLNKLAYQDVSFIMVDKLSKCFMFKILVMKGGQWFYTENHWCSS

SEQ ID NO: 178920 - protein, 131 aa, Glycine max
  Coding DNA Sequence Number=SeqID_87235
MIMRGQDIYSSQDEATTSPSSSESEEAKGEESSEEIYPQEDGQPLVVKEKCKETLASIATPLGLKFIPQVEKLLDEAPLTELVRNLVPSWEDAQEMGVEGRSPEYEEPRDLRSNPLQGGGNDAILSRRGIG

SEQ ID NO: 178921 - protein, 134 aa, Glycine max
  Coding DNA Sequence Number=SeqID_87236
  Homolog annotation: Hit_ID=Q6UUU1; Match level="QueryCoverage=44%, HitCoverage=40%, E-value=9e-19, Identity=78%"; Hit description =Putative uncharacterized protein
MAFKLSNSSGFCTLPHNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 178922 - protein, 124 aa, Glycine max
  Coding DNA Sequence Number=SeqID_87237
MTCDLSLVLVRCLTPIIRQFVKFQDMPKKPKILMHNPSVHYGKKTSIVTKFVSFRNFTKKRITKKQQRGVYLVKMGVQIAPRPTWALQNIPPEGGCFWRKQPGSPGRAELAWASWAATTSPILL

SEQ ID NO: 178923 - protein, 120 aa, Glycine max
  Coding DNA Sequence Number=SeqID_87238
LRPQAGVGRDTTAAWGWPTSGNRHTAATSGAPQLIYKGWSVAYDPWPTSRRPSPKPKHLDNEGKLELLHMMSNVMSKNKIGAAQCTRQDEMSNEELKLQDPRCRIQCPDIWPENTGRIKL

SEQ ID NO: 178924 - protein, 117 aa, Glycine max
  Coding DNA Sequence Number=SeqID_87239
MPRRPLSGDLSIWYFDLLLGWRQVRIQTFFPNQSLFISFVVLLAQWSNLEEGSWMFFSIYHHYGPYGQIDVVRIIVCPFEKDECPTHVISAKGFVSEVRISALSLLRGSTSLSGQRA

SEQ ID NO: 178925 - protein, 285 aa, Glycine max
  Coding DNA Sequence Number=SeqID_87240
MARTKKTGEMMTTEAAKEIAAKIDSLKEEVTHGSFVPHGRQDVLTTAIGRPEHPGCVHDVGAAVDLANQGPARGVHHGKSDAATHGILLPDAVPEPLVGPSGLRVSTKGSCVDPSGNDPETGDLDRCGLYIEVDLARLVVLGRVYEGSTVVHNTPLLLGQVKVGVEEVTDADAPVPIPTDEVAVSPAKPPPKPDPEVDDPLYLTTLTISELFLRPYQVTWDATVFGVFNPDFPLYIKLEDLSEIAHGGQCLNISVLQLWILHLTETCMRAGNSDIYGFLEPQSIQ

SEQ ID NO: 178926 - protein, 42 aa, Glycine max
  Coding DNA Sequence Number=SeqID_87241
MSVKNLVGHLRVHDKIDHTLVSQVILTRLKGALKPGVFTPKA

SEQ ID NO: 178927 - protein, 184 aa, Glycine max
  Coding DNA Sequence Number=SeqID_87242
  Gene Ontology: Mol. function=calcium ion binding; Cellular component =oxygen evolving complex; Biological process=photosynthesis
  Homolog annotation: Hit_ID=A2Q6H0; Match level="QueryCoverage=88%, HitCoverage=62%, E-value=3e-82, Identity=90%"; Hit description =Putative uncharacterized protein
  Pfam annotation: Domain name=PsbP; Domain location=4-184; Score= -40.9; E_value=0.0097; Accession=PF01789.7; Description=PsbP
MDVGLIPPDANKIPLGEQPPQEGNVQPYKFILPPTWKQARVANILSGNYCQPKCAEPWVEVKFEDEKQGKVQVVASPLIRLTNKPNASIEDIGSPEKLIASLGPFVTGNTLDPDELLETSVEKIGDQTYYKYVLETPYALTGTHNLAKATAKGNTVVLFVVSANDKQWQTSEETLKAVLNSFEV

SEQ ID NO: 178928 - protein, 170 aa, Glycine max
  Coding DNA Sequence Number=SeqID_87243
MCHLTAYVCVHYDDQICNTNEGTTFFSNNTKTFMVNKVITFTQLLELVHQKLDIDPQQHIQHLHFRCPIFESGQRYMYTSFILRDDADVRKMFNIFYNNPSLPFVELFAIICLNNNPPDNQHSSTSNLEDLSDEYETCWVKNHDSDIDSSSRPEGSNLSPSHEPIFKRDW

SEQ ID NO: 178929 - protein, 142 aa, Glycine max
  Coding DNA Sequence Number=SeqID_87244
MAGHNNKEFIGKGYIGTWNGGDEQELLQKIVLLERQDKEKRYESTQQAFKSLEIQVGKLAKEMAKFVATREENFIEVEAHEESLVKEHDSREKDEEKSEERTQQQLEKCSQVEIQQESILQVNTPAHQLIVKEERHGEHDNL

SEQ ID NO: 178930 - protein, 254 aa, Glycine max
  Coding DNA Sequence Number=SeqID_87245
MVPVQKTEVQIEGKAKRVITKPSYLKDYVQSTGVIPVDDLELSVYVLAYLPPSPASGFCCSLPVGVRGPRKSHHQSSFVVPTELFYLWLNSGDPSRGACAPTTNPGAGYRSGSSPGREVVGHSPTFTISGSSTAAHPVEAKLHDDDKGDDKKLKGQSKDEFKMESRTIQDSRRKSSRTLQDSRGKLNSRIKLQESRSRFKIQESREDLIKIRYILCGTSRGYIYLGLTENQKEYISCGSVLVEGTSTKFTENHG

SEQ ID NO: 178931 - protein, 198 aa, Glycine max
  Coding DNA Sequence Number=SeqID_87246
VCTFDDLLPCIEKITLLSEEEDKILEAHEDAPPSQPQFEHQQFNILQQSVETQGLARRWETVDAATYSLSPMPERQHEMYYTLSTFTQEPSQMPPMYSYPHDFQPGYSFAGIFGSSPPFTQSGQVSTPNASLAGPWNVPGDISDMDDFLGFDLRHDFSAEVDQVDERANPRRRNPDRAARNWDRPCGTSSRHHIHSDD

SEQ ID NO: 178932 - protein, 650 aa, Glycine max
  Coding DNA Sequence Number=SeqID_87247
  Gene Ontology: Mol. function=kinase activity; Cellular component =nucleus; Biological process=cell division
  Homolog annotation: Hit_ID=P25011; Match level="QueryCoverage=44%, HitCoverage=75%, E-value=1e-111, Identity=64%"; Hit description =G2/mitotic-specific cyclin S13-6
  Pfam annotation: Domain name=Cyclin_C; Domain location=567-649; Score= 53.5; E_value=7.1e-13; Accession=PF02984.10; Description=Cyclin, C -terminal domain
  Pfam annotation: Domain name=Cyclin_N; Domain location=440-565; Score= 205.0; E_value=1.8e-58; Accession=PF00134.14; Description=Cyclin, N -terminal domain
  Pfam module annotation: Pfam domain module=Cyclin_C::Cyclin_N; Domain location=567-649::440-565
PEVEIRMPMEAFPPVSADVSFISNSFPKYKLDADNQVLEEPVEDNQGPSLKDVIEQEASNLSDQHKRISVRDLASKFDKNLAAAAKLSNEAKLRDVASLEGHVLLKKLRDALESLRGRFAGRNKEDVEKAISMVEALAVKLTQNEGELIQEKFEVKKLVNFLKQASEDAKNLVNQEKSFACAEIESARAVVLRIGEALEEQEKASQASKPQDVDGLVEEVQESRRIKLLHHPSKVMAMEYELRALRDQIREKSIFSIKLQKEMVLKLWVHICESSLAQMKCHRFRNVHFSGTACLLKAAGGKASPGAAVKLCLGDLLVMGSNPETASLHMQGGSNGQQLEERSSKSRFLHLGWDSRSFGAKLLATVQAPAAAENNMKQACANVAGAPPVAKGVALAKRAVAPKPGQKKVTVKPKSEEDQILDIDASDVDNELAAVEYIDDIYKFYKLVENESHPRDNIDSQPEITERMRAILVDWLIQVQTKFELSLETLYLTINIVDWFLAVKNVPKRELQLVGISAVQMATKYEEIYPPQVHNFVFLSGRAYTHEQILIMEKIILAKLDWTLTVPIPLVFLLRFIKASVPDQELENMAHFLSELGLMNYATEMYWPSMVAASAVFAARCTLNKAPLWNETLKLQTGYSQEQLMYVNLN

SEQ ID NO: 178933 - protein, 257 aa, Glycine max
  Coding DNA Sequence Number=SeqID_87248
  Gene Ontology: Mol. function=motor activity; Cellular component=cell projection
  Homolog annotation: Hit_ID=P15305; Match level="QueryCoverage=94%, HitCoverage=46%, E-value=5e-09, Identity=19%"; Hit description =Dynein heavy chain
MFSPFRGLHNLAFRGLDALAFRGVHILPLRGLHALAFVGLHTLTFKGVHVLNIRGLYIVAIRRLHVLAFRGGLHVLAFRGLHVQAFRGLHVIDLRGLHVQHFRGLHVLHIRGLHVLPFGGLHRTTRPHLQRIHNLAFRGLDALAFKGVHILPLRGLHALAFVGLHTLTFKGLHILNFRGLYIVTIRGLHVLAFRGLHVLPFRGQHDLPFRGLHALALTGLHVLTFRGLHNLAFRGLDALAFRGVHILPLRGYTHSPS

SEQ ID NO: 178934 - protein, 139 aa, Glycine max
  Coding DNA Sequence Number=SeqID_87249
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=73%, E-value=3e-24, Identity=67%"; Hit description=LacZ protein
MKHFTDTLISANIITSNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 178935 - protein, 81 aa, Glycine max
  Coding DNA Sequence Number=SeqID_87250
GTSFVVQVEGTSTWVVVTENKRGYISCGSVQVESVEAKLHGESKGDDKKLKDQSKKNSSESRTIQEFKIRIKKNSRLKKKV

SEQ ID NO: 178936 - protein, 150 aa, Glycine max
  Coding DNA Sequence Number=SeqID_87251
MAYPLNYTLHTMHMPNENASHAVPPYPMFAIEGPTCSGMPPPNATAAPQHRLLQPLHFSVRGPPPALEGREKLDLIEERLRAFERFGDYPFMDMAKLCLVPDVVIPPKFKGREAVNAFLLRKFGWGGGHLVYQFGGFSYSLMERLDYCLH

SEQ ID NO: 178937 - protein, 95 aa, Glycine max
  Coding DNA Sequence Number=SeqID_87252
MLVRLIHTRLFAAARGVAQELIKGNYWPLNWERKSRLSIQGQKTLYSLKARTYSPLKVIGTSSQGSTFMRKQEIDSSRGQTHATFVVKLGNADLI

SEQ ID NO: 178938 - protein, 162 aa, Glycine max
  Coding DNA Sequence Number=SeqID_87253
  Homolog annotation: Hit_ID=Q6UUU1; Match level="QueryCoverage=82%, HitCoverage=90%, E-value=3e-45, Identity=72%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGEVRGPRQSRFSIGSAPLTSITKSDAQISGGETRQDYKDTRRFPLAAPSCASPVLPFGLP

SEQ ID NO: 178939 - protein, 146 aa, Glycine max
  Coding DNA Sequence Number=SeqID_87254
  Homolog annotation: Hit_ID=UPI00006A2D9E; Match level="QueryCoverage =58%, HitCoverage=62%, E-value=1e-07, Identity=19%"; Hit description =UPI00006A2D9E related cluster
GLHILAIRGLRALTFRGLHILTYRGLHALAFRGLHVLTFRRLHAFAFRGLHVLTFRGLHALAFRGLHALAFRGLHALTFRGLHALTFGGLQICALRQLKGGYRVATMHIGARFHPDRHRETSADHAHHHNSDLPLPKCQLVCAIMT

SEQ ID NO: 178940 - protein, 106 aa, Glycine max
  Coding DNA Sequence Number=SeqID_87255
MGDLEEVQQPMKADMSALKEQMASMMEAMLGMKRLKQSNAATAVATSTVVEADPALLTATHHPIPNIVGRERSTLGASMHEDMGHITPLILEGEPPWHPDGVHENP

SEQ ID NO: 178941 - protein, 110 aa, Glycine max
  Coding DNA Sequence Number=SeqID_87256
  Subcellular localization annotation: CTP_CleavageSite=28; ConfidenceScore=5.24e-01
MVSGASVASVVLPLNFQKPWVRVFHLTLAKGKRKKNENQIQNTSVRLPLLFRKVRKGGELSNSLRKLPQEASGRQAPPFFPINRGGGLFQKYSSPLGYAFRLFWAKNTFS

SEQ ID NO: 178942 - protein, 127 aa, Glycine max
  Coding DNA Sequence Number=SeqID_87257
MGTNQTGKRFYQVKVKSLDTTSIKELGRLMEPLQMQAFRKTYGKILELTIAEVSIEAIASLTQYYDQPLRCFTFGDFQLGKKTIPFLRVTPLFEQNCNCGQGFSKRFGSHKTDSKRHSGPTTKVPRR

SEQ ID NO: 178943 - protein, 150 aa, Glycine max
  Coding DNA Sequence Number=SeqID_87258
  Gene Ontology: Biological process=transposition, DNA-mediated
  Homolog annotation: Hit_ID=Q1J7G7; Match level="QueryCoverage=22%, HitCoverage=47%, E-value=7e-11, Identity=87%"; Hit description =Transposase
MLFHYGESWNLIRADQRIIFAKSWPRTSWYQQGHQDLFIMRSDLPSQVIQWILFLSAVPPVQILTGWCVTAKAPPDISAGKCSGHAARNHHTRRAYCAATGRVPFAILAAQLLGRAIGAGLFAITPAGERGMCCKAIKMGNARVFPVTTL

SEQ ID NO: 178944 - protein, 185 aa, Glycine max
  Coding DNA Sequence Number=SeqID_87259
MSLCQSFRVPVTPSKVIRPPITWAFIEKYCTPRHTQGDAPQAADAPPPPHQADPAGSLGMEHYLQHLVRQQAANHRGQVQIHECLYRFSLSQLGQGFAPFACPTPEQFGAEVAWPGDWPEAQAGEAPAGSLDDAEEARMDEEMMDLLGFLGGSGATDRALSYFVTAFLRLTISCVLFVYLVVRRK

SEQ ID NO: 178945 - protein, 126 aa, Glycine max
  Coding DNA Sequence Number=SeqID_87260
MQCKNVEKTAVIIFYTVQQMHTQSFTIPQFLKIGLTHKKCPQWSRQLSQHALLRASEARLTGALSKGGKMRGVATNVYLWETSEKPKKTGQKENSKFGSCIYVEEGRQKRGFCSYVPSIEEEIRPT

SEQ ID NO: 178946 - protein, 433 aa, Glycine max
  Coding DNA Sequence Number=SeqID_87261
  Gene Ontology: Mol. function=cation transmembrane transporter activity; Cellular component=integral to membrane; Biological process=cation transport
  Homolog annotation: Hit_ID=A6GY07; Match level="QueryCoverage=89%, HitCoverage=28%, E-value=1e-107, Identity=49%"; Hit description =Probable multidrug resistance protein. AcrB/AcrD/AcrF family protein
  Pfam annotation: Domain name=OEP; Domain location=238-407; Score =17.1; E_value=0.0011; Accession=PF02321.9; Description=Outer membrane efflux protein
MGPAQISREQAKRRIVVGFNVKGRDVQSVVQDIQKKLDKDVKLPAGYYYTYGGQFENLQEASQRLMIAAALIFTAIPMSAIGGIFALLVRGMPFSISAGIGFIALFGVAVLNGIVLIGTFNELEKEGEKDIFKRVMEGTKTRLRPVLMTATVASLGFLPMAISTGAGAEVQKPLATVVIGGLISATFLTLFVLPMLYIIFNTKLRIKKVKMKPFTPVIILGFIMLGQFASAQSRTLTVEQAVEQAVANNPGLKSKDLGIEAARALKPTAKELPKMNFNAQLGQYNSPTFDQSFAISQSIPFPTIFKARKELIAETIKGKQIEKEISMNELVKQVRSYYYQIEYLQYNKAQLKNLDSLYRDFIRIATVRFKAGDIKKIEISTAETQQGEINLLLNQNQTLLNISDDIEVPFNGNYEPLKSGNILDSKRLIITLH

SEQ ID NO: 178947 - protein, 100 aa, Glycine max
  Coding DNA Sequence Number=SeqID_87262
  Homolog annotation: Hit_ID=Q5M9Z0; Match level="QueryCoverage=24%, HitCoverage=20%, E-value=1e-07, Identity=100%"; Hit description =Putative uncharacterized protein orf116
MAEMFSRLLNLCGGPDPLRLRCPTVWSTDHTEGQALKRRTGTSGINVFQFLALHRPSNGPWTKRPLPERTMSRGPPPPHKVHLAPMGRYNYPRRHSKLEG

SEQ ID NO: 178948 - protein, 163 aa, Glycine max
  Coding DNA Sequence Number=SeqID_87263
  Gene Ontology: Mol. function=aspartic-type endopeptidase activity; Biological process=proteolysis
  Homolog annotation: Hit_ID=Q53KJ4; Match level="QueryCoverage=59%, HitCoverage=13%, E-value=2e-09, Identity=40%"; Hit description =Transposable element protein, putative
MHGSPTDNLVPLDLEIKATLRRNRAERRRKLLQDIIVASILEEETIFSDSLSPDSPSSREFATQLPETTSMEDEQHQKITLEDYSSSSVPQFFTSIARHEGNLFQGLPNEDPYEHLATFIEICNTVKIAGVPDEAVRLSLFSFSLAGETKKWLHSFKGNSLKT

SEQ ID NO: 178949 - protein, 77 aa, Glycine max
  Coding DNA Sequence Number=SeqID_87264
  Subcellular localization annotation: CTP_CleavageSite=17; ConfidenceScore=5.30e-01
MAPLPSLQNGQRTTRPRQQRAARPHLQRTTFTLTIERTTRPRLERTTRPHHQRAARPHLPRTTCPRLERATRPHLGY

SEQ ID NO: 178950 - protein, 117 aa, Glycine max
  Coding DNA Sequence Number=SeqID_87265
MSRGRLYQKQVKNAFDKKGFLSSVISHRSFLKENGIEVPVLTLCLKLCQEFDNLSLFAQSMGCPNSRIVLGNGQMSGRIQRQRPIKGWTQVEARITIDGSSSHAQLWTSGKRDWEAA

SEQ ID NO: 178951 - protein, 237 aa, Glycine max
  Coding DNA Sequence Number=SeqID_87266
  Gene Ontology: Mol. function=amino-acid N-acetyltransferase activity; Cellular component=cytoplasm; Biological process=amino acid biosynthetic process
  Homolog annotation: Hit_ID=Q8ZMB8; Match level="QueryCoverage=94%, HitCoverage=50%, E-value=1e-112, Identity=90%"; Hit description =Amino-acid acetyltransferase
  Pfam annotation: Domain name=AA_kinase; Domain location=26-233; Score= 69.4; E_value=1.2e-17; Accession=PF00696.19; Description=Amino acid kinase family
MVKERRTELVEGFRHSVPYINAHRGKTFVIMLGGEAIEHDNFSSIVNDIGLLHSLGIRLVVVYGARPQIDANLAEHHHEPVYHKQTRVTDAKTLELVKQAAGMLQLEITARLSMSLGNTPLQGAHINVVSGNFIIAQPLGVDDGVDYCHSGRIRRIDEEAIHRQLDSGAIVLMGPVAVSVTGESFNLTSEEIATQLAVKLKAEKMIGFCSSQGVYDQHGEIVSESSLSIPSTSRGGP

SEQ ID NO: 178952 - protein, 219 aa, Glycine max
  Coding DNA Sequence Number=SeqID_87267
GRHILAERKVEIYHTELDEFKGELERRNFHKHLTNLADSSIDLALVKELYANLYSPKGPSPKQVRIRGHLIRIDAGNLNAFLETLVVLAEGESFPVYSRYCKMPTDTREIEVALCIPNRGFILNAEGHPGKILRKDLTTLAQVWSVLSYSNLASTSHISDLTMDQARLIFGLVTQLDMNVGALISGHITSMAQSNSSKLGFPALSTALCRTRGVASDSL

SEQ ID NO: 178953 - protein, 157 aa, Glycine max
  Coding DNA Sequence Number=SeqID_87268
MGHQLAPACTDWWSLTAMQQLQRAATPISFQLLDVLVVGLMSYMEFRAAVAVKRAIGGVGVPTVNSNRYSFLPLLDVLLGATRRATSPSLSFMSLLLVDYAHGLRTGATGLLYSNVPSCLYYLLYMEIMMYCPSALLLQPRLSSSTVPSSLNSTLNY

SEQ ID NO: 178954 - protein, 154 aa, Glycine max
  Coding DNA Sequence Number=SeqID_87269
  Gene Ontology: Mol. function=catalytic activity; Cellular component =cellular_component; Biological process=metabolic process
  Homolog annotation: Hit_ID=Q9MB42; Match level="QueryCoverage=35%, HitCoverage=7%, E-value=4e-16, Identity=74%"; Hit description=Beta -amyrin synthase
MEYLANNVSLLNKEDNAPIYSVEDVKNIKEIAARDDAFDLLSDSLAPSIYGHSWIKKGVLLNPTKFLGNIVVEHDYAECTGSAIQALVLFKKLYPRHRETEIKNSIANAVHGMEVGEFATFMALGLHFVVLQQRVKLTLIVLPFAKPLNFYFQH

SEQ ID NO: 178955 - protein, 95 aa, Glycine max
  Coding DNA Sequence Number=SeqID_87270
MVEVTHGDGVVGEAGGDEAAAAMCEGEEDGGWQRRRKRGRLGVFLEIPMVRSSGVKNRSRTHAAPPCVTAIAAAPAATQNHSQRCPSRMGATPPL

SEQ ID NO: 178956 - protein, 810 aa, Glycine max
  Coding DNA Sequence Number=SeqID_87271
  Gene Ontology: Mol. function=metal ion binding; Cellular component =nucleus
  Homolog annotation: Hit_ID=A7QR02; Match level="QueryCoverage=27%, HitCoverage=90%, E-value=2e-55, Identity=51%"; Hit description =Chromosome undetermined scaffold_147, whole genome shotgun sequence
  Pfam annotation: Domain name=GYF; Domain location=733-789; Score =25.2; E_value=0.00023; Accession=PF02213.7; Description=GYF domain
  Pfam annotation: Domain name=Plus-3; Domain location=253-355; Score =95.7; E_value=1.4e-25; Accession=PF03126.9; Description=Plus-3 domain
  Pfam annotation: Domain name=SWIB; Domain location=124-197; Score =39.3; E_value=1.4e-08; Accession=PF02201.9; Description=SWIBMDM2 domain
  Pfam module annotation: Pfam domain module=GYF::Plus-3::SWIB; Domain location=733-789::253-355::124-197
  Subcellular localization annotation: CTP_CleavageSite=66; ConfidenceScore=5.69e-01
SNKANNHKAASSLCPETHTYCSVLRSAPISNNSLKSLFLLESSNDTFSTTLSLSVNFLLQRVERLRAFSGGGLDLGLFMIGRMGDEPRAGSFWTEEINEAVPTPMRRKRKYRTKKKEYQGWGSTSLIWFLESIGRDTSTKIAQSEVANIVMEYVKQHNLFHKTKKKRIECDERLHSLFGRKTISRLKINDLLESHFKENCEESSDGVFFDSEDDENALTACETPRTAPSERKSQPKKPVFEKPRSCFAAIVPANIKLVYMKRSLVMDLLKDPETFETKVVGSFIRIRCDPNDYLQKNSHQLLQVTGTKKSSEVNGEIHLQVSGFIKDIRIQMLSDDNFSESPDEQERLLREFPQVIADEQESESTTPDVLDKNVENNLQEFWQATYTKSSSVTEVPNEVANSKLDIADLVKQQSNSPKSIPILHRAPEVPLLDMTNNSTMLNCISRDTIEHQSRGLSVQLPPEQHTVFAYKNYMSKPGDSQALPDKQMWSPQIQVIRLSNGLSVRQSPEQQTDIAYKNDMSKPANSHEAKISQALPDKQMWSSQIRAIRLSDGLPVQQSPEQQTDFAYKNGTSKPAESQEEKISQALPNKQIRPAQLEFIELSDDLSVQQPPEQQTNFTYKNDMSKPANSHEAKISQALPDKQMWSSQIRAIRLSDGLPVQQSPEQQTDFAYKNGPSKPAKSQEEKISQALPNKQIRPSQLEFIELSDDLSVNSLQSKNKTYKYCPAVQLDTLMWHYRDPTGNVQGPFSLISLKRWSDAGYFPRGFKVWQSGNRQDEDVLLAMVFQSSDCLSYSEKYQLGKEVDAIDMTP

SEQ ID NO: 178957 - protein, 80 aa, Glycine max
  Coding DNA Sequence Number=SeqID_87272
  Homolog annotation: Hit_ID=A7PVN8; Match level="QueryCoverage=46%, HitCoverage=7%, E-value=1e-07, Identity=70%"; Hit description =Chromosome chr9 scaffold_33, whole genome shotgun sequence
MSSELQRQHQDMDPYEIVEHLKKMKKTGTVMVVGKSSKMKGKVPKRKNLGPKVGMTKPKNKRNKIDQTDAECFFCKEKVH

SEQ ID NO: 178958 - protein, 701 aa, Glycine max
  Coding DNA Sequence Number=SeqID_87273
  Gene Ontology: Mol. function=voltage-gated chloride channel activity; Cellular component=integral to membrane; Biological process=chloride transport
  Homolog annotation: Hit_ID=A7QR06; Match level="QueryCoverage=98%, HitCoverage=95%, E-value=0.0, Identity=62%"; Hit description =Chromosome undetermined scaffold_147, whole genome shotgun sequence
  Pfam annotation: Domain name=CBS; Domain location=521-688; Score =52.8; E_value=1.2e-12; Accession=PF00571.19; Description=CBS domain
  Pfam annotation: Domain name=Voltage_CLC; Domain location=92-488; Score=236.6; E_value=5.7e-68; Accession=PF00654.11; Description =Voltage gated chloride channel
  Pfam module annotation: Pfam domain module=CBS::Voltage_CLC; Domain location=521-688::92-488
MTTECLFFNFRIFDNEILKNDWRSKKKVQIIHYVMLKWGFALLIGLGTGLVGFFNSFAVENIAGFKLLMTTGLMSKHRYLDAFLAYAGANMCLAAAAAALCAFIAPAAAGSGIPEVKAYLNGVDAQNILAPSTLFVKIFGSILGVSAGFVVGKEGPMGGSHKYHLTCTWLRYFKNDRDRRDMITCGAAAGVAAAFRAPVGGVLFALEEAASWTFFTTAVVAIVLRVAIQFCATGKCGLFGEGGLIMYDVSSANITYSASGIFAVLLLGAIAGILGSIYNYLVDKVVRTYSIINGKGAFSKISLVVTIALLTSCCYYFLPWIAKCIRCPSNSTVICPSVDESGDYKSFQCPPGYYNDLASLFLNTNDDAIRNLFSPRIIKEFHITSLFIYFATIYCLGIITYGIAIPSGLFIPVILAGAAYGRLFGRLFETITELDRGLFALLGAASFLGGTMRMTVSLCVILLELTNDLLLLPLVMLVLLVSKSVADSFNKGVYDQILKIKGLPYLEAHAEPYMRNLVTRDVVSGPLITFSGIEKVANILQALNTTGHNGFPVIDEPPFSDSPELCGLVLRSHLLVLLKEKIFSRDRGFANQRIFQRISTLDFGKAGSGKGIKLEDLDIQEEEMDMYVDLHPITNASPYTVVETMSLAKAAILFRQHGLRHMCVVPKSQGRPPVVGILTRHDFMPEHVLGLHPDIMPHKWK

SEQ ID NO: 178959 - protein, 77 aa, Glycine max
  Coding DNA Sequence Number=SeqID_87274
MPFCGRARRGSWVCFPREERCAESPPTFICEKRQKNRRKPVIKNIPSSGVVFTFEEGRQKQGSCSYVPSNEEEIRPT

SEQ ID NO: 178960 - protein, 204 aa, Glycine max
  Coding DNA Sequence Number=SeqID_87275
MQFDAFDRTDHLALRLVVVADAFGAAVRVDDVVVLAHGNRVVRALGLANVAIDAFFGDGQGHDGGATESGRDTAIVLPGPRRPGQAPGADLPMARRCGQPKCREGAQGALREGSVRRRAGRSARPGLLAAFLGLFLQPAFHRREHEFADVAAQLGDFAHDGAGDELVLIRRRHEQGLDVRNQVAVHAGHLEFVFEVGHGAQAAQ

SEQ ID NO: 178961 - protein, 310 aa, Glycine max
  Coding DNA Sequence Number=SeqID_87276
  Gene Ontology: Mol. function=sulfuric ester hydrolase activity; Cellular component=integral to membrane; Biological process =metabolic process
  Homolog annotation: Hit_ID=A6T6M3; Match level="QueryCoverage=97%, HitCoverage=54%, E-value=3e-95, Identity=55%"; Hit description =Putative transmembrane protein
  Pfam annotation: Domain name=Sulfatase; Domain location=10-309; Score= 234.0; E_value=3.3e-67; Accession=PF00884.14; Description=Sulfatase
MDAQRAPGPRPKLVILVVGETARSQNFQLNGYPRATNPRLSRKEGVISFNDVSSCGTATAISVPCMFSQMTRGQYDDVRAATEENVLDMLQRTGIRVLWRNNNNGGCKGVCERVPTEDMPALKVAGQCVNADGTCYDDVLLHQLGARIDAINGDALIVLHQLGSHGPTYFERYPAASRAFSPTCDSNQIQHCSNEALVNTYDNTLVHTDHLLGKAIDLLQGYADQRDVALIYVSDHGESLGERGMYLHGTPYFIAPREQTQVPMVMWFSPEFSRNAGLDLACLHQNALHRAHSHDNLFHSLLGLFAVNSG

SEQ ID NO: 178962 - protein, 106 aa, Glycine max
  Coding DNA Sequence Number=SeqID_87277
  Homolog annotation: Hit_ID=Q84VH5; Match level="QueryCoverage=57%, HitCoverage=9%, E-value=5e-25, Identity=93%"; Hit description =Envelope-like protein
HPNMLNYTDSVIKRESPLSLHYKLFEGTHVPDIVSTSGKAASGAVSKDALIAELKDTCKALREWALMMKKQLRKKEAAEEEEEAAEEEEDAAEDTESDDDDSEATP

SEQ ID NO: 178963 - protein, 248 aa, Glycine max
  Coding DNA Sequence Number=SeqID_87278
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRWGNSTSSSNARPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 178964 - protein, 111 aa, Glycine max
  Coding DNA Sequence Number=SeqID_87279
  Homolog annotation: Hit_ID=Q8GEG1; Match level="QueryCoverage=68%, HitCoverage=84%, E-value=4e-26, Identity=57%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPLPGKTCKSTTGSSHW

SEQ ID NO: 178965 - protein, 104 aa, Glycine max
  Coding DNA Sequence Number=SeqID_87280
MDISEPYTKAMRGTLHEPQANLGADQKFSPGFVSNPRVASLYKFFHDQYMSSSFNGIDKPLASLYDLKSGKFHLVIYQSVTIHCHPSMGRTIDPQSLMFSGCAE

SEQ ID NO: 178966 - protein, 289 aa, Glycine max
  Coding DNA Sequence Number=SeqID_87281
  Gene Ontology: Biological process=transposition, DNA-mediated
  Homolog annotation: Hit_ID=Q6UUU1; Match level="QueryCoverage=36%, HitCoverage=90%, E-value=4e-27, Identity=55%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSVRSPVLPFGLP

SEQ ID NO: 178967 - protein, 181 aa, Glycine max
  Coding DNA Sequence Number=SeqID_87282
MAPKKLSAKRSRRDTAAEGTSAAPEFDSHRFRSAEHQQHFEAIKGWSFHKERRIQLRDDEYTDFQEEIARRRWTSLVTPMAKYDPDIVLEFYANAWPTEEGVRDMRSWVRGQWIPFDADALSQFLGDPLVLEEGQECEFSQRRNRADGFDEEAIAQLLCMSGQDFSRTATGRRVCHPPGTL

SEQ ID NO: 178968 - protein, 40 aa, Glycine max
  Coding DNA Sequence Number=SeqID_87283
MEERRPEKKIAYPLSANLVLSAISSRAKPSLLALSAKTPD

SEQ ID NO: 178969 - protein, 225 aa, Glycine max
  Coding DNA Sequence Number=SeqID_87284
MIQGTNRLRILCLNTLEGTSFVVLVEGTSTWVVIQRTREGTSLVDQLNWRVHPLDCSKRTREALSKVIYEVWEVGAKLEKDSTLQVWASIFKFFLRIFKGSPSTFNSNPLPGIRKRAASTCSSGLNLVNLECRDLTFGGRATRDSRMHILREEGAQSRHQRLFEENVEKVGTCSLRTSSMKGSGVVFMHEEGVVDKSGVFAPTYPRFGVTNSDLRSSCKSGKVMC

SEQ ID NO: 178970 - protein, 239 aa, Glycine max
  Coding DNA Sequence Number=SeqID_87285
MGDQEETQEQMKADMSALKAHMASMMEAMLGMKQLMEKNAATAAAVSSAAEADPILLATTHQPPPNIVGRGRDTLGHDGSPHLGYNRAAYPYGLPPNYSPPIMQEDAGHIASPVHEKEPPQQPDEVHKDPQDYARRDVEFYPPIPEGPAPGTLPQPNIAASPIVLSMEGPPPATEEKRKLDLLEERLRAVEGFGDYPFADMTDLCLVPDVVIPPKFKVPDFDKYKGTTLSQKPSQDVLP

SEQ ID NO: 178971 - protein, 438 aa, Glycine max
  Coding DNA Sequence Number=SeqID_87286
  Gene Ontology: Mol. function=methyltransferase activity; Cellular component=cytoplasm; Biological process=biological_process
  Homolog annotation: Hit_ID=Q1GYZ3; Match level="QueryCoverage=66%, HitCoverage=95%, E-value=1e-114, Identity=68%"; Hit description =Methyltransferase
  Pfam annotation: Domain name=Methyltransf_5; Domain location=145-436; Score=415.6; E_value=7.1e-122; Accession=PF01795.10; Description=MraW methylase family
  Pfam annotation: Domain name=MraZ; Domain location=1-66; Score=37.1; E_value=6.5e-08; Accession=PF02381.9; Description=MraZ protein
  Pfam annotation: Domain name=MraZ; Domain location=67-138; Score=8.3; E_value=0.0073; Accession=PF02381.9; Description=MraZ protein
  Pfam module annotation: Pfam domain module=Methyltransf _5::MraZ::MraZ; Domain location=145-436::1-66::67-138
LDAKGRLSVPAKHRDALTAGGQGEVVLTAHPHRCLILYPQAAWEPIETKLTSLSSFNPQTSGIQRMVVGQADVMHLDSAGRLLVNAVLRKFAKLDKDVMMVGQAGKPDGDRPAADTARARRILAMTRGAKSAPASLTETSVSPVAASHITVLLHEAVDALNVQADGVYVDGTFGRGGHSRLILSKLGSKGRLIGLDRDLAAVAHGQTIADARFTMVHAHFSTMATVLVGLGVQAVDGILLDLVFRFDGPLDMRMDQSRGKTAAEWLVTMSEKQLGEVIRDYGEERFAKQVARAIVKEREDGRAITTTGQLAKVVAGAIPKNEPGQNPATRTFQALRIFVNQELEELSLVLPDCLKLLRPQGRLPVISFHSLEDRIVKRFIQSEEDRDNLPAGLPVRAKDLPQPRLVSVGRAIKPGKAEVTANVRSRSSVLRVAERTHV

SEQ ID NO: 178972 - protein, 94 aa, Glycine max
  Coding DNA Sequence Number=SeqID_87287
MASYTIQVYYMPYKLMPRITCPGFVCQSIMKCLLEWTFVFIFAMNLDVSLPPSLLEKQHSTLVIWDQLHRLTTIAIGDVVKRGRLFYIGCQGSS

SEQ ID NO: 178973 - protein, 691 aa, Glycine max
  Coding DNA Sequence Number=SeqID_87288
  Gene Ontology: Mol. function=nucleoside-triphosphatase activity; Cellular component=spliceosome; Biological process=riboflavin biosynthetic process
  Homolog annotation: Hit_ID=P43329; Match level="QueryCoverage=100%, HitCoverage=53%, E-value=0.0, Identity=83%"; Hit description=ATP -dependent RNA helicase hrpA
  Pfam annotation: Domain name=DUF1605; Domain location=219-319; Score =67.0; E_value=6.2e-17; Accession=PF07717.7; Description=Domain of unknown function (DUF1605)
  Pfam annotation: Domain name=HA2; Domain location=85-179; Score =101.2; E_value=3.2e-27; Accession=PF04408.14; Description=Helicase associated domain (HA2)
  Pfam module annotation: Pfam domain module=DUF1605::HA2; Domain location=219-319::85-179
VQRLPIEPISQASANQRKGRCGRVSEGICIRLYSEDDFLSRPAFTDPEILRTNLASVILQMTALGLGDIAAFPFVEAPDKRNIQDGVRLLEELGAITLSDEGAYKLTPSGRSLAQLPVDPRLARMVLEAQKFGCVREVMIIAAALSIQDPRERPVEKQQASDEKHRRFADKESDFLAFVNLWNYLQEQQKALSGNQFRRQCKSDYLNYLRVREWQDIYTQLRQVVRELGMPLNSEPAPYREVHCALLTGLLSHIGQKDAEKQEFTGARNARFAIFPGSGLFKKPPKWTVVAELVETSRLWGRVAARIDPEWIEPLAQHLLKRSYSEPHWEKAQGAVMATEKVTLYGLPIVQARKVNYSRIDPQLSRELFIRHALVEGDWQTRHAFFRNNLKLRSEIEDLEHKSRRRDILVDDETLFAFYDRRIGSEVVSARHFDSWWKQASKDNPDLLSFDKQMLIKDGAEKVSQLDYPNFWYQGNLKLKLSYQFEPGADADGVTVHIPLPLLNQVDEAGFEWQIPGVRRELIIALIKSLPKPVRRNFVPAPNYAEAFLGRVTALEQPLLDALEREFRRMSGVTIERDAWQWDQVPDHLKMTFRVVDEHNRKLQEGKDLHQLKQVLKGKVQETLSNVADDGLEQRGLHLWSFGDLPQSYEQKRGNYQVKAWPALVDEKDSVAIRLFDSEREQQKMMWRGQR

SEQ ID NO: 178974 - protein, 137 aa, Glycine max
  Coding DNA Sequence Number=SeqID_87289
MWHTLSMKISITPLRYSLRTNKPHQAHISQTMGETHEIPHHNLADFEPWLGYATEGQAVGGIPFENTLEGPQFRPQPQPLHFAVGRAPPAMAEKGKADHLKERLRAIEGGEDYAFANLEELFLIPKHGHSQVQGAGL

SEQ ID NO: 178975 - protein, 194 aa, Glycine max
  Coding DNA Sequence Number=SeqID_87290
MQQSGAIEQPEAYAANINRYNPRWRNHPNLRWSSPEQQQQQPAPSFQNAAGPSKPYVPPPMQQQQQQQPQQQQQQRQQSTETPSQPSLEELVRQMTIHNMQFQQETRASIQSLTNQMGQMATELNQAQSQNSDKLPSQAVQNPRNVSAITLRSGKQTKVPIPVAEPTPERENEIDAQKRQPPDHVGPTSSNSDV

SEQ ID NO: 178976 - protein, 144 aa, Glycine max
  Coding DNA Sequence Number=SeqID_87291
MVVAVEVAVVHLRQAAAVLLPQMCLPWHAPFLNERPINGRLDWLCGHNRHPIELAETCDQSWKSQCSIGLFWVHWVVYMNTDLGQDSVDQLAFRQWKIRIMVAGKDVVEEKRHPDLCQSGHASAHDPHPPSCYTSCKVLSRGAQ

SEQ ID NO: 178977 - protein, 151 aa, Glycine max
  Coding DNA Sequence Number=SeqID_87292
MYPPLELIYKRCTLSCSQSTTQVEVPSTCTTKDLPSNVLRQRSQAIKPLILCEWGYKRILRREKGDTKEFRQLVFCSFGKGRRETQKEFRRLVLGEFFLAKGEEMKIMNSTSFQGLEKPENFGKLLAQRRSSKRFKGCKGLYSKGYSRYLK

SEQ ID NO: 178978 - protein, 168 aa, Glycine max
  Coding DNA Sequence Number=SeqID_87293
MLLALRPDKFMDSLCKKPLNSMNKLRERAKGYIQMEEMSRLKNKVRQDESKRDRREGGTDKATSATSSQVEGDKDTISKDVINNLSKNEPVQQISGVINTITSRFSYGSDVALCGTCKPWIFFINEVLCFLKLDGSGMEKEKDDWRRPFKEKMSLEEAHHHRKPWIRT

SEQ ID NO: 178979 - protein, 80 aa, Glycine max
  Coding DNA Sequence Number=SeqID_87294
MTSFQILLLQLKTSKLVAKGGCGGGIITGVVIVAIEDETGRMLTLVAIGRQRQKLSMIWNEKIIGQGNVGKYKEKEKNEK

SEQ ID NO: 178980 - protein, 158 aa, Glycine max
  Coding DNA Sequence Number=SeqID_87295
MTILQGSLAQARYRPLKPAQTKEKTKFCRGISHLSDERTRYVATCPSRARLTGALSKGGKGRSLPPSSPRRARLLPPEATASWRNLLEGPSGPAFEEVTETHGLRKNTSFRLPPHYGISRIAQACFLLISETSQDFIYCATKDAKYLKAANQRLHVIK

SEQ ID NO: 178981 - protein, 167 aa, Glycine max
  Coding DNA Sequence Number=SeqID_87296
  Gene Ontology: Mol. function=nucleic acid binding
  Homolog annotation: Hit_ID=A7QBD1; Match level="QueryCoverage=64%, HitCoverage=20%, E-value=2e-13, Identity=37%"; Hit description =Chromosome chr13 scaffold_74, whole genome shotgun sequence
MSELETTDNFRSFVNGDGANDDGDYENDDDYQDDVGVQDEEEVDSELQNEDDGDYDEFWIPGHRKMSASDIMQVENYRKVGIRPPHMYAAFANQCGGYEKVGFIRKDIYNEEGCMRRQHSSDARGALKYLYDLCKKEPMMYVSCTADEESRLQRLFWSDTESQLLYQ

SEQ ID NO: 178982 - protein, 257 aa, Glycine max
  Coding DNA Sequence Number=SeqID_87297
  Homolog annotation: Hit_ID=A7PFU6; Match level="QueryCoverage=91%, HitCoverage=33%, E-value=1e-15, Identity=24%"; Hit description =Chromosome chr6 scaffold_15, whole genome shotgun sequence
  Pfam annotation: Domain name=SWIM; Domain location=18-54; Score=19.6; E_value=0.0028; Accession=PF04434.8; Description=SWIM zinc finger
  Pfam annotation: Domain name=zf-CCHC; Domain location=180-197; Score =19.3; E_value=0.0018; Accession=PF00098.14; Description=Zinc knuckle
  Pfam module annotation: Pfam domain module=SWIM::zf-CCHC; Domain location=18-54::180-197
MATFSVFTIVKYCSGSVWRVSYCPSTIEFTCTCMRMQSIGLPCDHILAVLVSLNFMELPSSSVLNRWSKLATKQIKDKYPDSAMYWDSQLMGRYATLVEVSREVCAAAYRDEEEYDKMLHFLSNEATRMKSKQNSEHCVDDNQTHQQDDDFAGILDPVVVRSKGCGQVGMDESGRQRRIQKCRQCGGIGHNKRSCTNHPRNVNGCMSSTEQTSSMLQATHENYSEVVMITICILLMLDKMQEPQTQSFVAGSSRVGP

SEQ ID NO: 178983 - protein, 278 aa, Glycine max
  Coding DNA Sequence Number=SeqID_87298
  Pfam annotation: Domain name=Peptidase_C48; Domain location=96-246; Score=-33.8; E_value=0.069; Accession=PF02902.10; Description=Ulp1 protease family, C-terminal catalytic domain
  Subcellular localization annotation: CTP_CleavageSite=42; ConfidenceScore=5.54e-01
MQQTRGSSSGNMTNNNPSWMFHRSRTTSSRGYTHTIPKDMPCCFKPTVDMNLTFEETQVCAYVLNPNLDPSGKEILYRVGNNLGTRQTFQSLCPNKPVREEIILFMCLKVAYSQLYRTRSVWCMPPAFAVDVINGSPVETLIEHYGKDWMPPFSDLKLIYIPIIQNSAHWYLMVIDMNDRNIYHLDCDLTSQTAYQRKDAIKIMANVMLSVLEIVFPTQEFVIGFDGMDCWDIIEARGIPNCGSRRKGRQNEGGNDPAVRDTQPVQGRVDYKCRAQLA

SEQ ID NO: 178984 - protein, 24 aa, Glycine max
  Coding DNA Sequence Number=SeqID_87299
MILKGNELAIQNTRFLKKNVYAPE

SEQ ID NO: 178985 - protein, 62 aa, Glycine max
  Coding DNA Sequence Number=SeqID_87300
  Subcellular localization annotation: CTP_CleavageSite=45; ConfidenceScore=5.43e-01
MKNGGKSSQNRPRKRLGSVTKAPRLGFSSRKQFFSLILRKKREVVAAQLAQASWVASTRRPK

SEQ ID NO: 178986 - protein, 330 aa, Glycine max
  Coding DNA Sequence Number=SeqID_87301
  Homolog annotation: Hit_ID=Q1SN17; Match level="QueryCoverage=33%, HitCoverage=23%, E-value=5e-09, Identity=33%"; Hit description =Transposase, putative
MVVVAVVGLVVNGDMLKVFATQDDILHWARSVAYDIGFVALIMRSGQYRSRKKDFVRRDTSSRKCVYPFKLDGKLVVGGQGWMVKLMCESHNHEMEKPLVGHPYAGRLTKDEKIIIANMTKSMDEDVIHDIFWCPPDAVKHDVLHRVIVTDRDLALMNAVKTVFPECMNLLCMFHIDKNVKAKCTSLVELDVCDKVTLKSKLWEIAYPDLNSMCSPLENVTPKYVDALHSVQNNNSSVKRSASSSDLAIPRRTMPMLDQFHLYIHNSIENIVNVKADGNCGYRAIAALLGMGEDSWSLMCNHLLKEFTKWSDEYINLLGGIDIFEELKWS

SEQ ID NO: 178987 - protein, 59 aa, Glycine max
  Coding DNA Sequence Number=SeqID_87302
MVSGAMQNLLDLKVVPEGVDRLIQATKFWTTPLPDREDKSGRCHKNYLDKSEIGSARNP

SEQ ID NO: 178988 - protein, 187 aa, Glycine max
  Coding DNA Sequence Number=SeqID_87303
MGPKSTLRLIRTLGPSLASLAQSTWSFSIQCPCGVGLHQEGQCRGLLRLGNKAKIRLLLHLPLVKVKKQKGKNLVKKSTPKKKDNLLMVKEKCKEVSVSSKRLAKKESHFAIKTNIKETSPLRQPPHLLLCKKTLVNTATTLGLEVIPQIKELLDEGLVGKSLNPCALLVPKIGIIRHQIPKIGVIP

SEQ ID NO: 178989 - protein, 120 aa, Glycine max
  Coding DNA Sequence Number=SeqID_87304
MGDQEETQEQMKADVSALKEQMASMMEAMLGMRQLMEKNVATAAAVSSAAEADPTLLVTAHHPPPNAVGRGRSTLGHNNNPHLGYNRAAYPCRLPPNYTPPIMHDDAGHASSPILEREPP

SEQ ID NO: 178990 - protein, 140 aa, Glycine max
  Coding DNA Sequence Number=SeqID_87305
MEEGNLHTRVFILVRQQPGAYLQSPSDLRSLRFLSTLEWEESKEFSDCVVLNSLTREKGDTKEFKRLVLCSFGKGRRETQKEFRRLVLGKWQREKRMKRMNSTSFQGLENQKTSESFWYKEEEEVQRDSKRFKACKGLYE

SEQ ID NO: 178991 - protein, 240 aa, Glycine max
  Coding DNA Sequence Number=SeqID_87306
  Homolog annotation: Hit_ID=Q84VH5; Match level="QueryCoverage=86%, HitCoverage=34%, E-value=5e-94, Identity=76%"; Hit description =Envelope-like protein
MDLIKAAGLLKTVTKLGDCYESLVREFIVNIPSDITNRNSDEYQKVFVRGKCIRFSPAVINKYLGRPTEGVVDIAVSEHQIAKEITAKQVQHWPKKGKLSAGKLSVKYAILHRIGTANWVPTNHTSTVATESFAVKIPIAFPTVLCGIMLSQHPNILNNIDFVKKRESPLSLHYKLFEGTHVPDIVSTSGKAAASGAVSKDDLIAELKGHMQGAGGNHQSQHKEENGAGTPDQKTLRQWR

SEQ ID NO: 178992 - protein, 63 aa, Glycine max
  Coding DNA Sequence Number=SeqID_87307
MGIQKNSQSGEGRHKRIQAVSPSFFCKREKRDTKRIQTVIPWRISFWQRKKGMKKMNSTVFKV

SEQ ID NO: 178993 - protein, 247 aa, Glycine max
  Coding DNA Sequence Number=SeqID_87308
FDEFKEELERRHWDEKLIDFDDSSIDIAIVKEFYANLYDPKDKSPKQELAAKLCIPGRGFELNADGQPLKILRKNMTTLAQTWSVLSFSNLIPTSHTSDVTLDRAKLIYGIMMKMDMNARGVQSDSRSLENMSPAINLAYIKKNYWNLDDPTMTFRGPRKARGKRSEVPTTSAPETPAPYFSTTPVPPIQTPFIPPTSTQRPLPAPISARPLDFYLHHRHFMPCPSAYTGGSPSSCRAFKAWACHPL

SEQ ID NO: 178994 - protein, 63 aa, Glycine max
  Coding DNA Sequence Number=SeqID_87309
MELGLRCDALKGSLSKVALGMILREEPLSTSTLATMWSKHLTNMCKALLCPLPLTGISSSAKV

SEQ ID NO: 178995 - protein, 51 aa, Glycine max
  Coding DNA Sequence Number=SeqID_87310
MTEARQKGVRKVNENENKREELATQLAQASKVASSRSNRLLEEETGRPKWS

SEQ ID NO: 178996 - protein, 68 aa, Glycine max
  Coding DNA Sequence Number=SeqID_87311
MTLLLSNILPSDCNTDLPLRKYQLGSFPQDTQWTRRHPTGPWGFQLGLQASVNPTGRPSPHQVHAIVT

SEQ ID NO: 178997 - protein, 95 aa, Glycine max
  Coding DNA Sequence Number=SeqID_87312
VRGCEHATAAGHAAQPRDIGYLGRQRADVGGFFLPFAWRRIPPWNCVVVLVWKRNRSNYRGGLVDNLLGVVTSFKVLLKGQPSGFYQTLDLVLKG

SEQ ID NO: 178998 - protein, 77 aa, Glycine max
  Coding DNA Sequence Number=SeqID_87313
  Subcellular localization annotation: CTP_CleavageSite=36; ConfidenceScore=5.45e-01
MRVRCNQASRRPSMITDSPPLLMFPRARSPMESPTVATYPSAGGRRGARRCVFQERNTRGVSTNVYLRKTLEKLEKT

SEQ ID NO: 178999 - protein, 137 aa, Glycine max
  Coding DNA Sequence Number=SeqID_87314
MGEVEEVQEQMATMMEVMMSMKKKIMEANAVTVAATSAVAKVNPMPPSGLNQMNHPTSDMTVGETHEIPHHNLADFEPYLGYATEGQAVGDIPLQNTLEGPKFRPQPQPLHFTAGKIPPIMEGKGKVGSSGGKAQSH

SEQ ID NO: 179000 - protein, 288 aa, Glycine max
  Coding DNA Sequence Number=SeqID_87315
MDRDRLVYGLVTHMDMNIGALTPSQISSIAQSNSSRLGFPTLITALCRARGVICDSLTYESLSLAINLAYIKKNYWNMDDLTVNFRGARKARARLADVPSSSTPPAPPTYATPTPAPPGPSAQDSQCFESMLLSLYQGQILLMQSLQVVWPGTQPSLVREGGGSGAQVPQQVQDASLEATILVPFVFKVGGTQVRQEAATPERSPQISPDPPSPMMDQSSPQQLADSPTTVHEMPADLSTPLLEIPEDPATPVLGLTTTPPATPVLHFTDEEATQDQDTQQDDQSQEF

SEQ ID NO: 179001 - protein, 273 aa, Glycine max
  Coding DNA Sequence Number=SeqID_87316
  Gene Ontology: Mol. function=sequence-specific DNA binding; Cellular component=intracellular
  Homolog annotation: Hit_ID=A1FWY0; Match level="QueryCoverage=32%, HitCoverage=86%, E-value=9e-41, Identity=97%"; Hit description =Competence protein ComEA helix-hairpin-helix repeat protein precursor
MAVEQDGVVAGFGAGSRNFQEDQRGTAFQAHHFNLQAGQLLGLGPVLHQRDRLFHVAVLHPIGVEHRRLVGNADVVDQLRDDLAVPLVIDELAELGAKSRKPIGCVHVVTDTVPTDGIAGRDGQNHKEIHVVPWFVVLRALVLVVGIAGAHAAEPIDINRADAQALQQGLTMVGAAKAEAIVEHRRRHGPFHRVEDLTQVKGIGKAIVERNRQRITVGNRLLPADPVPGSVPESSEPAGSWFTGHGQDACDHRPPQDAAPITRMVESQTCGRG

SEQ ID NO: 179002 - protein, 195 aa, Glycine max
  Coding DNA Sequence Number=SeqID_87317
  Homolog annotation: Hit_ID=A2Q243; Match level="QueryCoverage=42%, HitCoverage=50%, E-value=2e-07, Identity=32%"; Hit description =Nucleic acid-binding, OB-fold
MVMDNYSWCYLACGQCYKKADIETVSFTCPCGKDNDQPLLRYRVEVMVNHQGEQTKFFIWDRECAQLIGQSTDEVNRLKIEVAIHFYSSFSCKDGDVDLNASPQALDRLLGCFLAFKVKVQPRFRNFVVLKYSDESDLINVVLDMIPDSESCCKIENSILESTDPTELESQSMSVTADHDCSMLNSYVAPTELDL

SEQ ID NO: 179003 - protein, 408 aa, Glycine max
  Coding DNA Sequence Number=SeqID_87318
  Gene Ontology: Mol. function=nucleoside-triphosphatase activity; Cellular component=chloroplast
  Homolog annotation: Hit_ID=Q2PMM5; Match level="QueryCoverage=100%, HitCoverage=17%, E-value=0.0, Identity=96%"; Hit description=Protein ycf2
MDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDL

SEQ ID NO: 179004 - protein, 72 aa, Glycine max
  Coding DNA Sequence Number=SeqID_87319
MDKSLKVGDDEWRERERRRMKFCALNEMMEACLRSFYGGWIFELQQGASMVIFRHGVAAKDKGEEVRGGAIH

SEQ ID NO: 179005 - protein, 376 aa, Glycine max
  Coding DNA Sequence Number=SeqID_87320
MSSAWLAGGRNRAQQLAIEHHQRQDQRAGQQEIEQHALARGAAHAVPALRTDVLRGHRRARGADRHRRHLQVVPQLQRGAVARAGVGTVLVDHGHQQDHRQRDQHHLQAHRYALDHQRLEDGQVELEQAHVGTAQPQRVALVPHVQQQAGQRQRLRDQRGPGRAGNAQRRERAHAEDQYRVQHDVQCHRDHQETERRARVTGTAQRGGEEGERIQRRPRQEDDLQVGLGQRQRGGRRAHRRQQRMGHEPAGDGDDHRQADEEGGAGADHAPPLRDVARADRLADQDGRGHAEAEHRADEEEHDVVGVRGGGQCRLAEEAPDPDRIHRTVQRLRDVACQDRQGKQQEIAADRPESGQSRFGHGVVDRIPERTLSHQA

SEQ ID NO: 179006 - protein, 29 aa, Glycine max
  Coding DNA Sequence Number=SeqID_87321
MGVQIETRPTRAFQDVPPEGRGGVKEKNV

SEQ ID NO: 179007 - protein, 167 aa, Glycine max
  Coding DNA Sequence Number=SeqID_87322
  Homolog annotation: Hit_ID=Q5QJQ3; Match level="QueryCoverage=64%, HitCoverage=85%, E-value=5e-59, Identity=100%"; Hit description =Putative uncharacterized protein
QKARNRKKAALLAFSIGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPVTFGKRVGSS

SEQ ID NO: 179008 - protein, 326 aa, Glycine max
  Coding DNA Sequence Number=SeqID_87323
  Homolog annotation: Hit_ID=Q5XM22; Match level="QueryCoverage=38%, HitCoverage=74%, E-value=2e-34, Identity=56%"; Hit description =Resistance-like protein HAAS-2
LRAETARSRGAYVRLGWVRDIYEMRCEARWWIVAARAYLLHLVGCTFFANKSATYVHVVHLEAFRNLGQSGGYAWGVTALVHMYDQLDEASRTTTRQITGTFLVCISVSQMMHTSRRPHMLTVTYVCWLPYNEHRGVRGFELISSFQGQLRWGPMVVTARLERVLRQFGYIQSIPSSPVSASLSYDDIDDRWMHFADHVLAVGELCVVPEQVSADYMEWFFRISHPFMILTQAGDQPKHAPTADHEEYMQPPIPQVPVAFDPPPHAMDDYDGYEAIAERLERVLSLRMVIAGTELHDIMQDCLTIAKGGANADGSVKARQRRRTEH

SEQ ID NO: 179009 - protein, 575 aa, Glycine max
  Coding DNA Sequence Number=SeqID_87324
  Gene Ontology: Mol. function=RNA binding; Cellular component =nucleolus; Biological process=ribosome biogenesis and assembly
  Homolog annotation: Hit_ID=A7PHE5; Match level="QueryCoverage=78%, HitCoverage=89%, E-value=0.0, Identity=83%"; Hit description =Chromosome chr17 scaffold_16, whole genome shotgun sequence
  Pfam annotation: Domain name=NOP5NT; Domain location=3-69; Score =103.7; E_value=5.6e-28; Accession=PF08156.4; Description=NOP5NT (NUC127) domain
  Pfam annotation: Domain name=NOSIC; Domain location=170-222; Score =118.9; E_value=1.5e-32; Accession=PF08060.4; Description=NOSIC (NUC001) domain
  Pfam annotation: Domain name=Nop; Domain location=266-437; Score =288.4; E_value=1.4e-83; Accession=PF01798.9; Description=Putative snoRNA binding domain
  Pfam module annotation: Pfam domain module=NOP5NT::NOSIC::Nop; Domain location=3-69::170-222::266-437
MALFLLYESASGYALLEAHGLDEIGHTTEAVRNSVSDLNRFGKVVKLRSFNPFTSALDALKQCNAVSEGLLTDELRTVLETNLPKVKEGKKSKFSLGVSDPKIGSQISELTKIPCQSNEFVAELLRGVRLHFDRFVSDLKSGDLEKAQLGLGHSYSRAKVKFNVNRVDNMVIQAIFLLDTLDKDINSFSMRVREWYSWHFPELVKIINDNYLYAKVAKFIEDKSKLSEDKISSLTDIVGDEDKAKEIVEAAKASMGQDLSPVDLVNVQQFAQRVMDLSEYRRKLYDYLVAKMNDIAPNLASLIGEVVGARLISHAGSLTNLAKCPSSTLQILGAEKALFRFLTSPSPDITTSNSKAKGVIDDKALKTRGNTPKYGLIFHSSFIGRASAKNKGRIARYLANKCSIASRIDCFSERGTTTFGEKLREQVEERLDFYDKGVAPRKNIDVMKSAIESVETEYTAMETEAPVEVSGKKAKKKKHKASVTDDGDNMAVDKITETTNGDALEDHKSEKKKKKKEKRKLDLEVELNDQAMDGGANGVESEQDGAVKKKKKKDKRGDNGEVLEAAIETKKKKKK

SEQ ID NO: 179010 - protein, 524 aa, Glycine max
  Coding DNA Sequence Number=SeqID_87325
  Gene Ontology: Mol. function=phosphoethanolamine N-methyltransferase activity; Cellular component=cytoplasm; Biological process =phospholipid biosynthetic process
  Homolog annotation: Hit_ID=A7PH63; Match level="QueryCoverage=81%, HitCoverage=91%, E-value=1e-179, Identity=66%"; Hit description =Chromosome chr17 scaffold_16, whole genome shotgun sequence
  Pfam annotation: Domain name=CMAS; Domain location=274-481; Score= -117.9; E_value=8.2e-07; Accession=PF02353.11; Description =Cyclopropane-fatty-acyl-phospholipid synthase
  Pfam annotation: Domain name=Methyltransf_11; Domain location=299 -395; Score=91.3; E_value=3e-24; Accession=PF08241.3; Description =Methyltransferase domain
  Pfam annotation: Domain name=Methyltransf_11; Domain location=99-197; Score=57.0; E_value=6.6e-14; Accession=PF08241.3; Description =Methyltransferase domain
  Pfam annotation: Domain name=Methyltransf_12; Domain location=299 -393; Score=62.2; E_value=1.7e-15; Accession=PF08242.3; Description =Methyltransferase domain
  Pfam annotation: Domain name=Methyltransf_12; Domain location=99-195; Score=37.7; E_value=4.2e-08; Accession=PF08242.3; Description =Methyltransferase domain
  Pfam annotation: Domain name=Ubie_methyltran; Domain location=263 -449; Score=-103.1; E_value=7.9e-05; Accession=PF01209.9; Description= ubiECOQ5 methyltransferase family
  Pfam module annotation: Pfam domain module=CMAS::Methyltransf _11::Methyltransf_11::Methyltransf_12::Methyltransf_12::Ubie _methyltran; Domain location=274-481::299-395::99-197::299-393::99 -195::263-449
MEVRTNEVAKQRIEDEGYRAHNNPFGLNLFLFSSFCQPYMASLATVQDERCVQRSYWIEHTTDLSVESMMLDSNASDLDKEERPEVLSLLPAYEGKSVVELGAGIGRFTGELAKKAGQLLAVDFIESAIKKNESINGHHKNVKFMCADVTSPNLHISEGSVDLMFSNWLLMYLSDKEVENLAARMIKWLKVGGYVFFRESCFHQSGDSKRKYNPTHYREPRFYTKICWIWKKVRSQDDRGFQRFLDSVEYNHKDILLYESVFGQGFVSTGGLVQVLIPCTETTKEFVAKLGLKPGQKVLDVGCGTGGGDIYMAENFDVEVVGIDLSINIISLAIERAIGLKCCVEFECADCTKKTFPVNTFDVIYSRDTLLHIKDKPSLFRSFYKWLKRGGTLLITDYCKSEGSLSLGYAEYIKKGGYYIHDMKTYCRMLENAGFDDVVAEDRTNLFMKTLQQELNALHSKKDDFIDDFSEEALEGKIIVKTQSSISHYGIRLTVKGSVNLQVRGGSAGVVESFYGVIKPIPIV

SEQ ID NO: 179011 - protein, 52 aa, Glycine max
  Coding DNA Sequence Number=SeqID_87326
MAIGTIVVEVTTMLLVDNAISGVYVDAVTTTMILMTMYGGGINDVGSVVIGV

SEQ ID NO: 179012 - protein, 235 aa, Glycine max
  Coding DNA Sequence Number=SeqID_87327
  Gene Ontology: Mol. function=peptidase activity; Cellular component =anchored to membrane; Biological process=lipid transport
  Homolog annotation: Hit_ID=Q1PFD8; Match level="QueryCoverage=35%, HitCoverage=57%, E-value=3e-13, Identity=44%"; Hit description =Protease inhibitor/seed storage/lipid transfer protein family protein
  Pfam annotation: Domain name=Tryp_alpha_amyl; Domain location=50-122; Score=23.7; E_value=0.00067; Accession=PF00234.13; Description =Protease inhibitorseed storageLTP f
MMNNMAYPNKAFFLFVMFFSASLHLGMFDTSLDQLLPGLGQGAFLQDAKCMQRLLPCQEYLKSPNNPSPACCEPLKEMQENNTQCLCNFVNSTTLFQSLGGSKDEILKLPQACGINFDPSKCNNTGGGGSQVASTPSLARMLTHLRRAAAACGGATSDHFLALRQFSSAVVAVSSVSDSDPTLPSSSDSQRKASRWLLFLPGAITFGLGTWQIGRREEKGEGIGGRKGMMLIDTM

SEQ ID NO: 179013 - protein, 207 aa, Glycine max
  Coding DNA Sequence Number=SeqID_87328
  Gene Ontology: Mol. function=protein binding; Cellular component =membrane; Biological process=vesicle-mediated transport
  Homolog annotation: Hit_ID=A2Q354; Match level="QueryCoverage=70%, HitCoverage=84%, E-value=8e-50, Identity=64%"; Hit description =Harpin-induced 1
  Pfam annotation: Domain name=Hin1; Domain location=31-171; Score =113.5; E_value=6.5e-31; Accession=PF07320.4; Description=Harpin -induced protein 1 (Hin1)
MCFRSRCSFCYIFFTIYTLMLMFILSIILFWIIISPSSVKFHVTDASLTQFNLTSNNTLYYNFKVNVTMRNPNNNIIVYYRRITAISWYKDNAFGWVSLTPFDQGHKNTTFLQAVFEGQRVIKLKSKQLGEYKDETSVGIYKDLAVDFDLRIRAKYAKFKSSRFNTPIVQCRRLRVPLISNGKSVPPFSVTRCKSAYFFSDRDAADG

SEQ ID NO: 179014 - protein, 107 aa, Glycine max
  Coding DNA Sequence Number=SeqID_87329
QRDEAPQVASNPSTLPSSSQEQQFKGPRIEEVDISSLKKDSGKRLSIWKYQVDQIFFINEFLCFLENDNGMEKEERKEMPLQGEDDSRRSSPLYEAMDKSLEEEGDE

SEQ ID NO: 179015 - protein, 548 aa, Glycine max
  Coding DNA Sequence Number=SeqID_87330
  Gene Ontology: Mol. function=G-protein coupled photoreceptor activity; Cellular component=membrane; Biological process=regulation of transcription, DNA-dependent
  Homolog annotation: Hit_ID=P42499; Match level="QueryCoverage=29%, HitCoverage=18%, E-value=4e-62, Identity=67%"; Hit description =Phytochrome B
  Pfam annotation: Domain name=PAS_2; Domain location=40-128; Score =97.0; E_value=6e-26; Accession=PF08446.2; Description=PAS fold
MEDARPHAVFERSGESGRSFNYSESIRITSESVPEQQIMAYLVKIQHCGFIQPFGSMITVDEPSICILGYSDNAHDMLGITLQSVPLLDDKNDAAFSLGTDVRALTSGKPFYGILHRIDGIVIDLEPVLTEDPALSIAGAVQSQKLAVRAILQLQCLPSGDAKLLCDTVALKSHTSQGGRAGRRGIDERGICILMVDEKMEPSTAKNMVKGVADSLNRFCQIMVYSSILLEILMILKLRKQIEFEPEYLVEFDNPDIDEKEPIPLRDALEKAKPFLMSYEGIQSQEVWEKTMEETMARVPLLKKIVDHYSGPDRVTTKKRQEELDRVAKTLPESAPSSVEQFTNRSVISLQCSEFLPLASIAATSLVEDSINDKSLKRLMEHDESFTNIAKRKELKRWHPCKFRVVVVLDMPQWRCGKQKVGLGSKSPIWGYIAGSQPKWLMGLKNPIATKERLLLGAPSKIAGAPSNSMNLQKRLFLPRAPNNLHSCFLFPDIGLLPPRPDFLLNLKFGEEAVVEDEGSSARRKGASGNSRGRSVEGSFADSRGRSL

SEQ ID NO: 179016 - protein, 166 aa, Glycine max
  Coding DNA Sequence Number=SeqID_87331
  Homolog annotation: Hit_ID=A2Q2B7; Match level="QueryCoverage=57%, HitCoverage=91%, E-value=2e-11, Identity=31%"; Hit description =Ovarian tumour, otubain, putative
MSEEVDMNDENEEEACVNEENGEELEVHQQDEDVVRDIFCSHPDAMKLSNASNLGERLNNVVWTLKRFRGIFLRRDALLGVIATDKDLALMNAVKTIFLESTNLLWRFHIDKNVKEAWGNLVDCPSEQQFDECLMKFEIACSPWPVFVDYVKQTWLIPHKEIFVKV

SEQ ID NO: 179017 - protein, 46 aa, Glycine max
  Coding DNA Sequence Number=SeqID_87332
MREESECGKILMWEIDKDKGKVVEEVLWWRRVEMRTSPIEDLGKGS

SEQ ID NO: 179018 - protein, 1286 aa, Glycine max
  Coding DNA Sequence Number=SeqID_87333
  Gene Ontology: Mol. function=transcription factor activity; Cellular component=nucleus; Biological process=regulation of transcription, DNA-dependent
  Homolog annotation: Hit_ID=A7PHC3; Match level="QueryCoverage=77%, HitCoverage=91%, E-value=0.0, Identity=70%"; Hit description =Chromosome chr17 scaffold_16, whole genome shotgun sequence
  Pfam annotation: Domain name=C1_3; Domain location=311-341; Score =13.0; E_value=0.016; Accession=PF07649.3; Description=C1-like domain
  Pfam annotation: Domain name=zf-NF-X1; Domain location=427-445; Score= 20.0; E_value=0.0089; Accession=PF01422.8; Description=NF-X1 type zinc finger
  Pfam annotation: Domain name=zf-NF-X1; Domain location=482-501; Score= 31.4; E_value=3.4e-06; Accession=PF01422.8; Description=NF-X1 type zinc finger
  Pfam annotation: Domain name=zf-NF-X1; Domain location=546-565; Score= 27.6; E_value=4.5e-05; Accession=PF01422.8; Description=NF-X1 type zinc finger
  Pfam annotation: Domain name=zf-NF-X1; Domain location=604-623; Score= 30.7; E_value=5.4e-06; Accession=PF01422.8; Description=NF-X1 type zinc finger
  Pfam annotation: Domain name=zf-NF-X1; Domain location=702-721; Score= 16.5; E_value=0.099; Accession=PF01422.8; Description=NF-X1 type zinc finger
  Pfam annotation: Domain name=zf-NF-X1; Domain location=759-777; Score= 14.2; E_value=0.18; Accession=PF01422.8; Description=NF-X1 type zinc finger
  Pfam annotation: Domain name=zf-NF-X1; Domain location=812-828; Score= 13.4; E_value=0.23; Accession=PF01422.8; Description=NF-X1 type zinc finger
  Pfam annotation: Domain name=zf-NF-X1; Domain location=851-872; Score= 15.7; E_value=0.12; Accession=PF01422.8; Description=NF-X1 type zinc finger
  Pfam module annotation: Pfam domain module=C1_3::zf-NF-X1::zf-NF -X1::zf-NF-X1::zf-NF-X1::zf-NF-X1::zf-NF-X1::zf-NF-X1::zf-NF-X1; Domain location=311-341::427-445::482-501::546-565::604-623::702 -721::759-777::812-828::851-872
MTSSSVKNEDEEKGSLAGSSKTEIFRDSAKHSVSNALFCSFFGLIMRLQNDIVEEDYRDMSSQIRRERREWSRVPPQGATRQEWVPRGAAAAAASTNVAQPSNLHSNNNADAGSSNLGVAVAAPSVSRSRSNNHGNDVGSSNQGVAVAALPVSRGRSNNHGNDAGFSNQGVAVAALPVSHGRSNNHGNDAGPSNQGVAVASPPVSHGRSNNPGNGAGSSNQGLAVAAPPVNRGRSKNHGKDSVSSNQGVAVAALGSRGRSNNHGSHWMEMEKDKGSRSGSQVEKGLRVGVRDSSLPQLVQEIQEKLMKGTVECMICYEMVQRSVPVWSCSSCYSIFHLNCIKKWARAPISSDLSLSVEKNHELNWRCPGCQSVKFTSSKEIRYVCFCGKRIDPPSDLYLTPHSCGEPCGKPLQREVLVPGGNRDDLCPHACVLQCHPGPCPPCKAFAPPRLCPCGKKNITTRCSDRQSVLTCGQCCGKLLECGRHRCERICHVGSCDPCKVPSSATCFCSKNMEVVLCGDMTVKGEIEAKGGVFSCSSYCLKILGCGNHVCSEICHPGSCVECELLPSRVKTCCCGKTRLENERQSCLDPIPTCSKVCGKLLHCGMHSCKEACHVGECPPCLVEVSQKCCCGSTSRTVECYKTMMENEKFMCEKSCGIKKNCGRHRCSERCCPFSNSNHYNTFSGDWVPHFCSMPCGKKLRCGQHVCECLCHSGHCPPCFQTIFNELACACGRTSIPPPLPCGTPPPSCQLPCSVPQPCGHSVSHSCHFGDCPPCSVPVAKECIGGHVVLRNIPCGSKDIRCNHPCGKTRQCGLHACGRTCHPPPCDNLSGVVQGFKAPCGQTCGAPRRSCRHTCMAPCHPSSPCPDIRCEFPVTITCSCGRITANVPCDVGGSSSNYNADAIHEASIIQTLPVPLQPVDANGKKVPLGQRKLICDDECSKLERKRVLADAFDITAPNLDSLHFGDNSLSSELLLDFFRREPKWVLAVEERCKILVLGKTRGTGTTHGLKVHIFCPMLKEKRDAVRLIADRWKLAITAAGWEPKRFIVISVTPKSKAPARVIGVKGTTTLNVPLPPVFDPLVDMDLRLVVSFPDLPRDTEINSLVLRFGGECELVWLNDKNALAVFHDPARAATAMRRLDYATVYQGAVLVAPNAGALVASSATNAWGGAGAMKGGGALPALKGNSWKKAVAQDSGWEDSWGGEEWIAGSVNIQPSVWKKEAPLAASLNRWNVLEQESSSSLSSTTVRAEVSGKKTENAGEEGGSKEEEKLDAASEVVDDWEKAYE

SEQ ID NO: 179019 - protein, 443 aa, Glycine max
  Coding DNA Sequence Number=SeqID_87334
MTNSVAESERHYLIFIVAMMHSKNGFVDVCLRHENLVKPLPEIEFREPRCVTQFIQELVYGRHRKLIFDCDRVKSSVGDGYGGQWCEVEVRLWAHETRGQNDRGVWFNDVVEAGNQDRWSLAEMFWYGAQILQPLDPKHNICTIKAQDEEVDLKGGGEVQKVGDTWLYKVVCTTIIHKNCHLVDECGGLRGSSGGVSTGNKVSRPLSQHTANSSDDKRFTGTRNGEGHVGGGMENKGGVWPLRQLGATVEVARLGPLNGVQDIADQDVRKPLRDIHWFRQRAGPSMKNDAMVVVVGLVVSAVMEERISKAVDGLLKTFGGSQMGIVFGHDGYDRAAGLLGPKIQVPNEMQRLGSMRHGAATTVDEHLLEHVVMSMDHHRHRVADEIDVDADSVEVHRGEVVVCDDQGDGLGGAVLLPQLVQRHTLKSFITHTRWKMKVKEDKE

SEQ ID NO: 179020 - protein, 169 aa, Glycine max
  Coding DNA Sequence Number=SeqID_87335
  Gene Ontology: Mol. function=DNA binding; Cellular component=nucleus; Biological process=regulation of transcription, DNA-dependent
  Homolog annotation: Hit_ID=A7PHC1; Match level="QueryCoverage=56%, HitCoverage=46%, E-value=1e-23, Identity=62%"; Hit description =Chromosome chr17 scaffold_16, whole genome shotgun sequence
  Pfam annotation: Domain name=KNOX1; Domain location=42-83; Score =24.2; E_value=0.00049; Accession=PF03790.4; Description=KNOX1 domain
  Pfam annotation: Domain name=KNOX2; Domain location=88-139; Score =36.5; E_value=9.5e-08; Accession=PF03791.4; Description=KNOX2 domain
  Pfam module annotation: Pfam domain module=KNOX1::KNOX2; Domain location=42-83::88-139
MESERPSTINETYKQQQELEEEEEEDDDDDNEEEEEEEENNEILKRRISNHPLYGLLVEAHLDCLKVGDISNLERELKIDQMQATEKQNLGMFSQSELDLFMEAYCLALGKLKEAMVEPQQKSMAFINNMHSQLRELTKATLPAPNNAEPAAATTSSTSESKFRRKPTI

SEQ ID NO: 179021 - protein, 435 aa, Glycine max
  Coding DNA Sequence Number=SeqID_87336
  Gene Ontology: Mol. function=ATP-dependent helicase activity; Cellular component=nucleus; Biological process=mRNA catabolic process, nonsense-mediated decay
  Homolog annotation: Hit_ID=A2Q465; Match level="QueryCoverage=57%, HitCoverage=88%, E-value=4e-86, Identity=71%"; Hit description =Helicase, C-terminal
  Pfam annotation: Domain name=DEAD; Domain location=264-408; Score =88.0; E_value=3.1e-23; Accession=PF00270.20; Description=DEADDEAH box helicase
MGPGPWIGPRAYLFMRTKKKDTGEEEQDVTRVSTKDATPHVVEMPVPPPSITNPMIKREPIPENEQCELLKWILEEKRKVKAKDAEEKRKIDEEKALLKKLIRSKSIPNYRFVNLRVQGPDILNCHLQNFGCDVIWIFNIFIGFVNKAKFELEPQHMASAEAGAPTGFGGSVQHSSSNRRDYDDGGSPKRNLSLDGLPHFEKNFYIESPAVRAMTDAEVNEYRQQREITVEGRDIPKPVKSFHDAGFPEYVMEEITKAGFTEPTPIQSQDPGDGPIVLVLAPTRELAVQIQQEATKFGASSRIKSTCIYGGVPKGPQVRDLRKGVEIVIATPGRLIDMLESNHTNLQRVTYLVLDEADRMLDMGFDPQLRKIASQDYVHRIGRIGRAGAKGTAYPYFTAANARFAKDLIAILEEAGQKVSPELAAMGSGAPPPPF

SEQ ID NO: 179022 - protein, 145 aa, Glycine max
  Coding DNA Sequence Number=SeqID_87337
  Gene Ontology: Mol. function=protein serine/threonine kinase activity; Biological process=protein amino acid phosphorylation
  Homolog annotation: Hit_ID=Q1ERH6; Match level="QueryCoverage=97%, HitCoverage=47%, E-value=3e-22, Identity=43%"; Hit description =Mitogen-activated protein kinase kinase
MALIRRRHPNLCLPISKPIQCRPHFPLYLTLTTTKRTTNDAITIDDLAKLIILGHGNGRTVYKVYHKVTSITYELKIIHGEIDAITHCHALLEASILRRTIDCLHVDHFHSSFEMPIGDVAILMEYMGGGSLETALTINSIFFAE

SEQ ID NO: 179023 - protein, 118 aa, Glycine max
  Coding DNA Sequence Number=SeqID_87338
MSDEVDMDMDDTVKNEDCSKIFTTMKVNFDKKNGVCCLCQTQENNLEGRHFSSWVVRGVANIDIKKDAKAVTRTRKCDCSFRLKGRPLKTSEGWVHRVLCGSHNHDIAKTLIGHPYVG

SEQ ID NO: 179024 - protein, 231 aa, Glycine max
  Coding DNA Sequence Number=SeqID_87339
  Homolog annotation: Hit_ID=A2Q1D6; Match level="QueryCoverage=46%, HitCoverage=15%, E-value=5e-07, Identity=33%"; Hit description =Ovarian tumour, otubain, related
MDCPTECVDEDHLTKFEVACAPWREFVAYVKETWLILHKERFVKAWTDKVMVLGVEFAHWALKWFLQTSMYALNHIADEVHKMHFVGVDTSRCGCIVRSTHGLPYACKLAWLSFNDMESTDLNDEFFVQQEFDVITKRLKEVKTKSLQKSHASKFERSTKHHPSLFKHVDALHSQHDSSSSWKSPDIVDVRSDGHCGYWEIPALLGMGENSWPLVHNDLHKELGQWRDEND

SEQ ID NO: 179025 - protein, 57 aa, Glycine max
  Coding DNA Sequence Number=SeqID_87340
FVFFFLPHSISAIPSLHHYSATTKAKARCSVLVRGGRGDNAKWNDGEVRGRDDVEGS

SEQ ID NO: 179026 - protein, 737 aa, Glycine max
  Coding DNA Sequence Number=SeqID_87341
  Gene Ontology: Mol. function=transporter activity; Cellular component= synaptic vesicle; Biological process=embryonic development ending in birth or egg hatching
  Homolog annotation: Hit_ID=A7PGU5; Match level="QueryCoverage=97%, HitCoverage=98%, E-value=0.0, Identity=57%"; Hit description =Chromosome chr17 scaffold_16, whole genome shotgun sequence
  Pfam annotation: Domain name=C2; Domain location=420-498; Score=71.0; E_value=3.9e-18; Accession=PF00168.21; Description=C2 domain
  Pfam annotation: Domain name=C2; Domain location=550-617; Score=46.0; E_value=1.4e-10; Accession=PF00168.21; Description=C2 domain
  Pfam module annotation: Pfam domain module=C2::C2; Domain location =420-498::550-617
MSLKKRALSINIEEAAVDFFNHLLQEKPRIPVFIPLILIAWAIERWVFSASTWVPLALAVWTTIQYGRYQRKLLVEDLDKKWKRIILNVSPITPLEHCEWLNKLLTEVWSNYFNPKFSIRISAIVEERVELQEFSLGSCPPSLALQGMRWSTIGDQRFLQLGFDWDTNEMSILLLAKLAKPLIGTARIVINSLHIKGDLLASPILDGKALLYSFVSTPEVRIGVAFGSGGSQSLPATEWPGVSSWLTSRRQPNGTSNGCSEDNFDDKDLQTFVEVEIEELTRRTDVRLGSTPRWDAPFNMVLHDNAGTLRFNLHESSPNNVRCDYLASCEIKLRHVEDDSTIMWAIGPDSGVIAKQAQFCGEEIEMVVPFEGSNSGEVSIVVKEWQYSDGSHSLNSLRSSSSQQSINGSPNFQLRTGRKINVTVVEGKDLAAKDKSGKFDPYIKLQYGKVVQKTRTVHTPNPAWNQTFEFDEIGGGEYLKIKGFSEEIFGDENIGSAHVNLEGLVEGSVRDVWIPLERVRSGELRLQISIRADDQEGSRGSGLGLGNGWIELVLIEGRGLVAADVRGTSDPFVRVIYKTLNPQWNQTLEFPDDGSQLMLYVKDHNALLPTSSIGECVVEYQRLPPNQTADKWIPLQGVKRGEIHIQITRKVPEMQKRQSLDSEPSLSKLHQIPNQDGNLEGLSATLSELETLEDTQEGYIVQLETEQMLLLSKIKELGQEIINSSPSLSRRSYSIGN

SEQ ID NO: 179027 - protein, 216 aa, Glycine max
  Coding DNA Sequence Number=SeqID_87342
  Gene Ontology: Mol. function=structural constituent of ribosome; Cellular component=ribonucleoprotein complex; Biological process =translation
  Homolog annotation: Hit_ID=A5AWN5; Match level="QueryCoverage=88%, HitCoverage=100%, E-value=1e-92, Identity=87%"; Hit description =Putative uncharacterized protein
  Pfam annotation: Domain name=Ribosomal_S7e; Domain location=31-216; Score=310.6; E_value=2.9e-90; Accession=PF01251.9; Description =Ribosomal protein S7e
MLRIFGLFMLDMFCNLAEIDGRFVKMYTSRKKIHKDKDAEPTEFEESVGQALFDLENTNNELKSDLKDLYINSAVQIDVSGNRKAVIIHVPYRLRKGFRKIHVRLVRELEKKFSGKDVILIATRRIVRPPKKGSAVQRPRTRTLTAVHEAMLEDIVLPAEIVGKRVRYKIDGSKIMKVFLDPKERNNTEYKLETFAAVYRKLSGKDVVFEYPTTEA

SEQ ID NO: 179028 - protein, 484 aa, Glycine max
  Coding DNA Sequence Number=SeqID_87343
  Gene Ontology: Mol. function=RNA binding; Cellular component =endosome; Biological process=protein targeting to vacuole during ubiquitin-dependent protein catabolic process via the MVB pathway
  Homolog annotation: Hit_ID=A7PGV7; Match level="QueryCoverage=89%, HitCoverage=88%, E-value=1e-141, Identity=57%"; Hit description =Chromosome chr17 scaffold_16, whole genome shotgun sequence
  Pfam annotation: Domain name=Mov34; Domain location=326-428; Score =20.2; E_value=0.00023; Accession=PF01398.12; Description=Mov34MPNPAD- 1 family
MQGPYWITGVRGPCKQLTLGCGQKSVMSMVYSELCSWLAIVLGCIVGQCLVSETIPRHRDYRSSPPRQKESLKKKLLISLNELENLKPVVQQKINELNSKLAYQQNGQGKFSSNNSLDFSPVKKQTSASYGLIKAVRPTAGEFVYQGSRSQPFSYVRPVEEHARRLSLTLPPPKEETLSRHSILGPNGLKGQWRPPIIDKGIKYPSNIDLSPVELPSLQHSLEDESLKKKDNSIAEHHKSELDSILTQSEDCQPHPQPQPQHDQEPPSLISFETTETSARIEVIRQPSPPPVLAEVQDLVPAVSPCVNEAGCKTEIPSSDSSVHVEAPMQLHISTALMESFMKLAKSNTKKNLETCGVLAGLLKNRKFYITALIIPKQESTSDSCQTTNEEEIFEVQDKRSLFPLGWIHIMLPESVAIVMAPRDSSRNHGIFRLTAPGGMSVIKQCDQRGFHPHSQPPDGGPIYKTCTDVYMNPDLKFEVIDLR

SEQ ID NO: 179029 - protein, 993 aa, Glycine max
  Coding DNA Sequence Number=SeqID_87344
  Gene Ontology: Mol. function=metal ion binding; Cellular component =cytoplasm
  Homolog annotation: Hit_ID=A0ZT53; Match level="QueryCoverage=80%, HitCoverage=91%, E-value=0.0, Identity=57%"; Hit description =Putative E3 ubiquitin ligase
  Pfam annotation: Domain name=Hemerythrin; Domain location=20-87; Score=17.5; E_value=0.05; Accession=PF01814.14; Description =Hemerythrin
  Pfam annotation: Domain name=Hemerythrin; Domain location=304-365; Score=31.5; E_value=3.1e-06; Accession=PF01814.14; Description =Hemerythrin
  Pfam annotation: Domain name=Hemerythrin; Domain location=375-467; Score=27.1; E_value=6.3e-05; Accession=PF01814.14; Description =Hemerythrin
  Pfam annotation: Domain name=zf-C3HC4; Domain location=778-815; Score= 0.4; E_value=0.081; Accession=PF00097.16; Description=Zinc finger, C3HC4 type (RING finger)
  Pfam annotation: Domain name=zf-CHY; Domain location=649-726; Score =147.7; E_value=3.2e-41; Accession=PF05495.3; Description=CHY zinc finger
  Pfam module annotation: Pfam domain module=Hemerythrin::Hemerythrin::H emerythrin::zf-C3HC4::zf-CHY; Domain location=20-87::304-365::375 -467::778-815::649-726
MIVKQKSIAEDKVIFPAVDGKFSFFQEHAEEESQFNEFRSLIESIQSEGATSSSETEFYSTLCSHADHILETIQRHFHNEEVQVLPLARKHFSFKRQRELLYQSLCMMPLKLIERVLPWLIRSLTEDEAQMFLKNMQSTAPAIDSALVTLFCGWACKARKDGLCLSSSVSGCCPAQRFTDIEENTVHSSCTPASALSGRVCSVLAESDGTQQRSVKRNISEVHKNEDVSKTSESESFQKQCCSAQSCCVPALGVNKNNLGLGSLSTTKSLRSLSFTASAPSLNSSLFIWETDNSSCEVGSTERPIDTIFKFHKAIRKDLEYLDIESGKLCDGDETIIRQFSGRFRLLWGLYRAHSNAEDDIVFPALESKEALHNVSHSYTLDHKQEEKLFEDISCVLSELSVLHENLQRAHMSVDLSENDFGISDANDDDNIKKYNELATKLQGMCKSIRVTLDQHIFREELELWPLFGKHFTVEEQDKIVGRIIGTTGAEVLQSMLPWVTSALTQDEQNKMMDTWKQATKNTMFNEWLNECLKESPVSTSQTEASERSTSQRGGDYQESLNLNEQMFKPGWKDIFRMNQNELESEIRKVYRDSTLDPRRKAYLVQNLMTSRWIASQQKLPKAPSGESSKQIEGCSPSFRDPEKQIFGCEHYKRNCKLRAACCGKLFTCRFCHDNASDHSMDRKATLEMMCMQCLTIQPVGPICMSPSCNGLTMAKYYCNICKFFDDERNVYHCPFCNICRVGQGLGIDYFHCMKCNCCLGIKSASHKCLEKGLEMNCPICCDDLFTSSATVRALPCGHYMHSSCFQPLHMSNLQQITGRYGGVLERGSSFGNHFVGSSLLLLGAHLAVSLPIQVYFGMLDALLAAEELPEEYRDRYQLFEREKEKLQEQPYCSKQRIYSAMTVIERALHASTGYITNVDLVAHTIPGTELVNICIANPIFPKPGNWLPFILYTMRVTSNETSHELTCLLLKVHLKCALALLYTAIVGRRETK

SEQ ID NO: 179030 - protein, 72 aa, Glycine max
  Coding DNA Sequence Number=SeqID_87345
MALEEGKALGVIKLTLAMNVGFNIVNEKTTIGHDGDLFLLKILRSENPTYMLTKVVTTDKMRLCIASVSLRG

SEQ ID NO: 179031 - protein, 215 aa, Glycine max
  Coding DNA Sequence Number=SeqID_87346
  Gene Ontology: Mol. function=protein binding
  Homolog annotation: Hit_ID=A7PGW5; Match level="QueryCoverage=99%, HitCoverage=54%, E-value=4e-92, Identity=68%"; Hit description =Chromosome chr17 scaffold_16, whole genome shotgun sequence
  Pfam annotation: Domain name=DUF266; Domain location=1-205; Score =312.4; E_value=8.5e-91; Accession=PF03267.5; Description=Arabidopsis protein of unknown function, DUF266
MQEVRWGENSMIEAERRLLANALVDFTNQRFVLLSESCIPLFNFSTIYTYLMNSTKTFVEAYDLPGEVGHGRYSPQMRPQIRLSQWRKGSQWFQIDRSLALQIVSDHQYFSVFKKYCKPSCYSDEHYLPTLVSIKFWKRNSNRTLTWVDWSRGGPHPSRYFRTDVTIEFFNKLRFGRSCEYNGRTTNICHLFARKFTPHALDRLLRFAPKIMQFN

SEQ ID NO: 179032 - protein, 810 aa, Glycine max
  Coding DNA Sequence Number=SeqID_87347
  Gene Ontology: Mol. function=unfolded protein binding; Cellular component=cytoplasm; Biological process=response to stress
  Homolog annotation: Hit_ID=A8IXR4; Match level="QueryCoverage=34%, HitCoverage=38%, E-value=3e-46, Identity=53%"; Hit description=Heat shock protein 81-4
  Pfam annotation: Domain name=HSP90; Domain location=292-683; Score= -78.4; E_value=1.9e-12; Accession=PF00183.9; Description=Hsp90 protein
  Pfam annotation: Domain name=tRNA-synt_2b; Domain location=122-320; Score=-40.5; E_value=0.02; Accession=PF00587.16; Description=tRNA synthetase class II core domain (G, H, P, S and T)
  Pfam module annotation: Pfam domain module=HSP90::tRNA-synt_2b; Domain location=292-683::122-320
MSQSIDNTVLRTLAMVTKTAKSPEGLLEKVIVDEVNLGFGDEIYEDARMEEQQLFEFHPSLFKIHESIVGVSILANNLVQIQVQVYDSECMRTHDNNLLGQFESDVNVVNALIIMYVQCGNINTARLVFDKMPNQDRTLWSALISSYFEYKEPFLLRYDLTTPFAMFVAMTSRISFERYQIAKVYRRDHPSKGRYNEFYQCDFDVACTPGLSEIIGLDYSNGVILEVVSQKDAQLGSIATSSQYDNLIGMIGSRSVPRVGVSMGIEGVLVILEQLQTDIHYIIEESKETVATFLFLERLKKNNYEVLFMVNAIVEYAVGQPKDNNGKKLASATKERLKLDDETVEEKKKVANKKKSFDELYKGLVVEKVDRIDTKEHFAAKHFSVAGQLEFMVVLFIPLKEPFDLFDTRKMPSKIKLFVRGIVDSEDLPLNIYRALLQQNKILKAIRKNLVKKGIEMFLEIAENKENYNQFYAAFSKNLKLGIHEVSPNKTKLTELLKYHPTKRGVQIAAIGPQSDQLCLAIILSRSEEGTGSWRKRKEGVLRARVTMDCKEHIPKLRTLVLTVCWLLLITLPYCEAAYNYSECKEQTYKCGNLINISYPFWGNHQRDSECGGGDLFELKCYDDDTTLLIGSQNYTVKEINITTYTMRLVRTDLARDVCSPQFGDTYLNPTLFSYTPKVYNVTIFYDCPITYPPPTHSITCGYAVPNIGEGFQDQVLEQCKRRLHVPTDVPQVDYGGGENSLDKGFEVKYTVSQDCTTCLGSEGNCSRHDAHFYQNLCHYCPDGSHALHCSKSMSSILSSLLFSPTNLLL

SEQ ID NO: 179033 - protein, 64 aa, Glycine max
  Coding DNA Sequence Number=SeqID_87348
MDTARLGKMCSQLSSFSQCQVNKLYDSYFLTGTRCKFKSKEMAKYEEDFATTVSWLEKRGARIG

SEQ ID NO: 179034 - protein, 144 aa, Glycine max
  Coding DNA Sequence Number=SeqID_87349
  Gene Ontology: Mol. function=protein serine/threonine kinase activity; Biological process=protein amino acid phosphorylation
  Homolog annotation: Hit_ID=A5BW80; Match level="QueryCoverage=84%, HitCoverage=38%, E-value=3e-15, Identity=31%"; Hit description =Putative uncharacterized protein
MNLPLLQPLSSFINTLFFFSLFFPTYVSSDSEGYSACEPFSCGQIDNISYPFWNSDHQPSYCGHPKFKLDCQQDSVTIGMVSQRFHVIEIDQTYKVLKIARLDLWIDPCTDEYSDVKLDSDFFNYTSNDDEYTLLYDCGRPVLN

SEQ ID NO: 179035 - protein, 78 aa, Glycine max
  Coding DNA Sequence Number=SeqID_87350
AKEEKVKEADDSLSEVDSLSEMHPLSKASSSLSGWETLEEDKSKICTPSAQPASPARMLSLHALNMPTLAKWKFTNSR

SEQ ID NO: 179036 - protein, 296 aa, Glycine max
  Coding DNA Sequence Number=SeqID_87351
MASRKRKSSTSLPQEPYDTTRFVFEVAWERYEQNVHAKNILLERNVDLYMTQYNEFRKELEMRRWHKALTRQLDGCIDVALVKEFYAYLFDPEDKSLRQVRVRGKLIKFDDETLNTFLETLVVLEPGERYSIYSRFCHSHTNPQELASKLCIPGARLVYGLVMKMDMDVGSIICSQISQMAQSNSSRAFMIWLSIDPSSTWRISWPRWPGQESSLILQGEVRLLPQPGPEVTPEDTLVATPLEATNEGDTTVDVDYVADMTTTQITWDPWPTSAQDSIPTPAQDAPSTPQDDLALA

SEQ ID NO: 179037 - protein, 105 aa, Glycine max
  Coding DNA Sequence Number=SeqID_87352
  Subcellular localization annotation: CTP_CleavageSite=37; ConfidenceScore=5.06e-01
MDLHCNILLLKREFFFHSSYSMKLAKRLSLLLVSTCRRNNAAKKRRELQDRTANLNSERIFSSESSSSFPTKLREIDVHASKANIMAEDQQQRVTLEDYSSSTMP

SEQ ID NO: 179038 - protein, 170 aa, Glycine max
  Coding DNA Sequence Number=SeqID_87353
  Gene Ontology: Mol. function=protein serine/threonine kinase activity; Biological process=protein amino acid phosphorylation
  Homolog annotation: Hit_ID=A7PGX2; Match level="QueryCoverage=53%, HitCoverage=17%, E-value=3e-16, Identity=46%"; Hit description =Chromosome chr17 scaffold_16, whole genome shotgun sequence
MDIGIGIPWWWVQAACLSDGTTVQVSKERLSYGRDSHLKGKLLEYKCEDEKFCPKISGFGLAKLCPINESITSRSDARGTSGCEIMLLEMVGGRKNINIEASKASEIYFAHWIYGRLEHGRDLRPDEVIAVEENEIYSKENDGSGSIDTNVQAYKQVQKQEAQQQNRRCG

SEQ ID NO: 179039 - protein, 284 aa, Glycine max
  Coding DNA Sequence Number=SeqID_87354
  Homolog annotation: Hit_ID=A7PGX0; Match level="QueryCoverage=71%, HitCoverage=51%, E-value=8e-53, Identity=42%"; Hit description =Chromosome chr17 scaffold_16, whole genome shotgun sequence
MEKEEREWWFRRRSFAFIDSYGGENRGHHFQRTCIYVWKRHDLCVNGVAGKSKNGLQRAYPHALYDVLSSNPKFEPCTPRNCGNGPPIKYPFWIPYEQESFCGYSNFSFTVANIDVYEDKCPVPLDNYTFYQTPFTYRSENWNLSFFYNCSIEPKNYPTFEVDCAKNATHYSLAVFHKEALEHKTYSLNECQFMVNVPLNMNAAINFTSLLRMNYPEILKMGSLLNWIAPDCQDREKSGGRCGSDGNQFLCNCKDKSYLKSCGSVRGKRKPTNLRLAPHLLEDV

SEQ ID NO: 179040 - protein, 128 aa, Glycine max
  Coding DNA Sequence Number=SeqID_87355
PTETFAVNTEMKPKKECKVILIEEDVEEEKKEEIERNEEKTQQWEKYSQVEIQQESILQINNPPHQLIVKEERHEKHEKALSIIPSLITSTSLATIWKVFPTYMSFMVSLAKRRKCKEDVCYVTFMPP

SEQ ID NO: 179041 - protein, 161 aa, Glycine max
  Coding DNA Sequence Number=SeqID_87356
  Gene Ontology: Mol. function=phosphatidylinositol binding; Cellular component=Golgi apparatus; Biological process=clathrin cage assembly
  Homolog annotation: Hit_ID=Q8LF20; Match level="QueryCoverage=46%, HitCoverage=11%, E-value=3e-11, Identity=55%"; Hit description =Putative clathrin assembly protein At2g25430
MALTMIRMAIRVVKDQTNIGIAKVASNMARKMEVTILKAMSHDDNPASDKQKGVNLESVAAGVSLSLGHALSEYRPLSETLACLASKRNLEGNFPCKHVLGTSSARPKKAVPVLEEPCSSESSSTFPQTRESHTGASEAHRMAEDQPRRVTLEDYSSSTMP

SEQ ID NO: 179042 - protein, 514 aa, Glycine max
  Coding DNA Sequence Number=SeqID_87357
  Gene Ontology: Mol. function=protein serine/threonine kinase activity; Biological process=protein amino acid phosphorylation
  Homolog annotation: Hit_ID=A2Y771; Match level="QueryCoverage=91%, HitCoverage=49%, E-value=2e-33, Identity=25%"; Hit description =Putative uncharacterized protein
MSKPFCALFALSIILVTCHAQTLNTSTTCEPSKCGNLNISYPFWKKSNTNVQEFCGYPEFGLECLDDQAIMIFPTDRYQVTDINYDIHSITLLDIDVLGQPCPRARHNVSLHNLPLSFSSLDFNLSFYFNCSSYPSSIQHIGCMEHDKYQSYVFKTGDEAESNGFDWLRHCEEHVVVTVKQDEIEISSLITGFGDAMQKGFVLDWMRAQDCAVCEESNGYCRFDQATKQSRCLCSDGRTEAKSCKKGYSACEPFSCGQIDNISYPFWNSDHQPSYCGHPKFKLDCQQDSVTIGMVSQRFHVIEIDQTYKVLKIARLDLWIDPCTDEYSDVKLDSDFFNYTSNDDEYTLLYDCGRPVLNTSRVNIEGTIPFTCPIGGGFPNAFCLLSKDVGNLKGLGCKNRINVSVLREAMKDALLVQKVLEGGFEVGWSGVDEDRCDGCIKSGGRCGHNESKDAFMCLCLNQQSSDEVCSKSLARSPLAAQTPRPTTAKSLIPPNSPIFPKQSPHAPSMYSSLI

SEQ ID NO: 179043 - protein, 290 aa, Glycine max
  Coding DNA Sequence Number=SeqID_87358
MNTLWHSESVGRNRKEMSLRVEIGVLKTSEKRPRERGVSTRKEKSVTGMEKGQKGVESAQMIEKGEEVSISTNKVVEYKCEVKSHIGSPYVVARGPQVARMASGTARPVGEAGLRCGRDSHLRGRCVEYKCEVSLCGGSWSTGVPLESPNKSLHDTRIKGSMSLNRASCGNLFTFAPMLLEQLLPLYAKLGSPTASSLHGCTRPLGTKMAYSVCLKLDCCSESTRDYGENVDYSTRTPLMSCKLTPKELHAQQSSVARVTEKGSVFGGIFASGVGELDTWQQLGELASGD

SEQ ID NO: 179044 - protein, 62 aa, Glycine max
  Coding DNA Sequence Number=SeqID_87359
  Gene Ontology: Mol. function=dUTP diphosphatase activity; Biological process=nucleotide metabolic process
  Homolog annotation: Hit_ID=Q10FF9; Match level="QueryCoverage=66%, HitCoverage=23%, E-value=5e-10, Identity=75%"; Hit description =Deoxyuridine 5'-triphosphate nucleotidohydrolase, putative, expressed
MEALDRCGSGRDRRGLQGSRRVKVGDRVAQMIIQQIVMPEVVEVQDLDSTLRAEGGFGSTGV

SEQ ID NO: 179045 - protein, 112 aa, Glycine max
  Coding DNA Sequence Number=SeqID_87360
  Homolog annotation: Hit_ID=A7PGX7; Match level="QueryCoverage=37%, HitCoverage=11%, E-value=5e-07, Identity=61%"; Hit description =Chromosome chr17 scaffold_16, whole genome shotgun sequence
MQQGRWIRSVVDYDNIVRGNGSTQAPILVYPNDMDGGVPKISLPTFAMASYKLKGSIYLDTKWTEKMSSSQVKNEIEIAKKNCHISGRALMGKGGKAKHTAKEIHQEEYMWD

SEQ ID NO: 179046 - protein, 96 aa, Glycine max
  Coding DNA Sequence Number=SeqID_87361
MAQRAQPVLATTDVFQKGDIHWKQFNVETSTASSSPPKPLLIFTPAVPGSYPGFQPLLLENVKAKLEKLVLSGHGGKTAFAVALDHAKQTSNFQHS

SEQ ID NO: 179047 - protein, 86 aa, Glycine max
  Coding DNA Sequence Number=SeqID_87362
MATPLGTIRELSHLIKVALFTHDTYTYTFCTQFEILGHIPRSPTCLMTVNPHLEFFSLGKALPLVVPITTVLLPKRMISLEASEVT

SEQ ID NO: 179048 - protein, 68 aa, Glycine max
  Coding DNA Sequence Number=SeqID_87363
MGAMTLEEGKVKIEKEKKLYQPLSGVKLDDMKQEEWNLLDRQALGVIRLTFSPERRVQHRKREDYCRL

SEQ ID NO: 179049 - protein, 124 aa, Glycine max
  Coding DNA Sequence Number=SeqID_87364
  Homolog annotation: Hit_ID=O65411; Match level="QueryCoverage=51%, HitCoverage=15%, E-value=8e-07, Identity=46%"; Hit description =Putative uncharacterized protein F18E5.80
  Subcellular localization annotation: CTP_CleavageSite=48; ConfidenceScore=5.08e-01
MNANLLRNLSFHARRLRFSPTPTVTAPTCFSSRSHAPDKPHSLVEDISDEELKRRVAKLQEGDAEAIPSVFEAILQRYLAGKPIEADQELMRGILGKWTLSEDEEDESDSHWEEIDDTDNEDGV

SEQ ID NO: 179050 - protein, 222 aa, Glycine max
  Coding DNA Sequence Number=SeqID_87365
MKLVYDIEEEEGDLVSRDVRGWVMKSIERSSHIPEGIVNGCNKPADFPGKGVIIIDLDTPLVEDQTIMEKEVREISGTSLTKHVESGAGVMRNRASAMTLEFIKSYKLRWSVRMMNACPRRYWRHLLTAAAIGLAFYINTVPMATPEASISITNGIVKSRGVNTGANVIDWPLCHGGNFGRVKFNAVTGDDMTQIFQVTFPEETFGPLEEELMTEESIQHLF

SEQ ID NO: 179051 - protein, 340 aa, Glycine max
  Coding DNA Sequence Number=SeqID_87366
  Gene Ontology: Mol. function=structural constituent of ribosome; Cellular component=ribonucleoprotein complex; Biological process =translation
  Homolog annotation: Hit_ID=Q8GTE3; Match level="QueryCoverage=43%, HitCoverage=67%, E-value=3e-50, Identity=65%"; Hit description =Ribosomal protein S3a
  Pfam annotation: Domain name=Ribosomal_S3Ae; Domain location=159-339; Score=141.8; E_value=1.9e-39; Accession=PF01015.9; Description =Ribosomal S3Ae family
MLIVSLRKGDCAKRCNGRAKVFQESASKGGGGLSLISSPLLSVLSLLSAADVEPIVIVKITIVERSCSGSDPIPERGVPVDVRIPPQGLRQIPVHEGTHVNICYYSKSKNKPLLQSLDDANLKLPRYFDKLSIPLNEQKSLANVIIDVVLNSVFIATTHCKTLEKVDIIFCSIFEAIKNLLKEQNEESGLVKRSIASRTLFLLCFGLKHRVFEVSLVDLQGDEDHAFKKIRLRAEDVQGKNVLTNLWTTDNYTLRMFCIGVTKRITNQVKRTYYAQSSQIRQIYRKMREIMTNQTTSYDLKELVRKFILQIIRKEIEKATSSIYPQQNVFDCKVKILKHC

SEQ ID NO: 179052 - protein, 94 aa, Glycine max
  Coding DNA Sequence Number=SeqID_87367
MAKPIVGQNLASPLSLLPVAIEGEKGRIIVTRIGSLSTGVVEGLTFSRGSELPSPTWCESINLSKEKDPLLEDLWHTSFDEESPIEMTSRSTRI

SEQ ID NO: 179053 - protein, 103 aa, Glycine max
  Coding DNA Sequence Number=SeqID_87368
MPTTIGRHSRLTLSTSQGGVKHLVTFSEHPQTTGQVEATNKFILKALRTRFYKSKGTTERRKYTGGIRDKGRSLRDGQNQGRGHQALSMMKIQYQGLTSSFST

SEQ ID NO: 179054 - protein, 166 aa, Glycine max
  Coding DNA Sequence Number=SeqID_87369
  Subcellular localization annotation: CTP_CleavageSite=38; ConfidenceScore=5.15e-01
MGLNQAHAFKKRFSSSQGKKWRKERALRRPYRTRVRVRVMSEIEEVHEQMKVDMEAMKEQITTMMEAMMSMRRMMEVNATTFVAASTAIEVDLTHPSGLNQVNHLVSDMVGQGCEALGSTSGPHFVQAQSKHSFPPYGLPPNYTPPNVAHALDENVDNFDPIPIES

SEQ ID NO: 179055 - protein, 73 aa, Glycine max
  Coding DNA Sequence Number=SeqID_87370
MAPLDFVALEDLHNSANNLLHSPMVQQAIFHQIEEKWLDNVLESSLRMLERSENDQHLHCGITFVPCFLTLVG

SEQ ID NO: 179056 - protein, 216 aa, Glycine max
  Coding DNA Sequence Number=SeqID_87371
  Gene Ontology: Mol. function=translation initiation factor activity; Cellular component=intracellular; Biological process=translational initiation
  Homolog annotation: Hit_ID=A7PS11; Match level="QueryCoverage=45%, HitCoverage=22%, E-value=3e-36, Identity=82%"; Hit description =Chromosome chr14 scaffold_27, whole genome shotgun sequence
  Pfam annotation: Domain name=GTP_EFTU; Domain location=1-72; Score= -85.5; E_value=0.082; Accession=PF00009.18; Description=Elongation factor Tu GTP binding domain
  Pfam annotation: Domain name=Usp; Domain location=7-157; Score=15.7; E_value=0.05; Accession=PF00582.17; Description=Universal stress protein family
  Pfam module annotation: Pfam domain module=GTP_EFTU::Usp; Domain location=1-72::7-157
MSHAKANIVPIVVAINKCDKAGANSEKVKLQLASEGLLLEEMGGDVQVVEVSATEKIGLDNLEEALLLQADMMDLKARIHGLAQANVMEARLDKGRGPLVLEVLVEVVEGDARNVLCDVVDRHRASILVLGSHSYGAIKRFSNSCMFESLKDEIFTSIISIIFLLVFKIQVLVLHNKPKDNDSDHNVDFAAGNVKLITTKEAWDQYLEEARRDGKI

SEQ ID NO: 179057 - protein, 117 aa, Glycine max
  Coding DNA Sequence Number=SeqID_87372
MKKKKVEAAGVSLSEAYALSEQTNNPAGKRLEVRKVIHDRPPLGELEQVACGIGLDGVAVAFAVGLGKVEEEEEESSSINDSWLEVSLVMESSMQSQLDLERVDSTMGGQGLNESTS

SEQ ID NO: 179058 - protein, 78 aa, Glycine max
  Coding DNA Sequence Number=SeqID_87373
  Gene Ontology: Mol. function=methionyl aminopeptidase activity; Cellular component=cytoplasm; Biological process=proteolysis
  Homolog annotation: Hit_ID=Q9SLN5; Match level="QueryCoverage=79%, HitCoverage=15%, E-value=1e-20, Identity=77%"; Hit description =Methionine aminopeptidase 1A
MVLPFYILLVRIGALNETHFVGNVDEESRQLIKCTYECLEKAISIVKLGVRFREIGEAINRHASMFGFSMVMIYFFVL

SEQ ID NO: 179059 - protein, 221 aa, Glycine max
  Coding DNA Sequence Number=SeqID_87374
  Homolog annotation: Hit_ID=A5BP71; Match level="QueryCoverage=26%, HitCoverage=14%, E-value=2e-08, Identity=50%"; Hit description =Putative uncharacterized protein
  Pfam annotation: Domain name=zf-CCHC; Domain location=197-214; Score =18.2; E_value=0.0027; Accession=PF00098.14; Description=Zinc knuckle
MASLGLHPADVYRQFHHPPPLPSLASHSEPQRDVSNLHDDEDDDDDYVVSNSYVEESIDEDNSVDGISNIDDEVTDMIQLVTIVHPREGVEGIQNPFWNDALHYNNINWSHPDEEDICGLEMLSSFNVGQELYVGMNFDSKDAVKNALKQYVMKRQFLLPMTHGHVPDPTTICAKGRPKSTRKRNEMDWLESSEHRKKCSRCGAEGHNRRRCPMQSERGSC

SEQ ID NO: 179060 - protein, 21 aa, Glycine max
  Coding DNA Sequence Number=SeqID_87375
GGGAAFWLQPEPGPGESLGGG

SEQ ID NO: 179061 - protein, 61 aa, Glycine max
  Coding DNA Sequence Number=SeqID_87376
MARTSLSSLSIPFLILLIITFTFFAQLAPVSADLKMRKLGPMQNPPPSPSHSHGPGPGHGR

SEQ ID NO: 179062 - protein, 99 aa, Glycine max
  Coding DNA Sequence Number=SeqID_87377
  Homolog annotation: Hit_ID=A7NUD4; Match level="QueryCoverage=57%, HitCoverage=22%, E-value=1e-09, Identity=57%"; Hit description =Chromosome chr18 scaffold_1, whole genome shotgun sequence
MQHPTCDRTGHRIEKEEHTKVDHVLDLTQMKPTECRVYLRTKRVLHVKERVKGQTTFRTKAKEYHADQNQDNILATEAKFKEVLTSYEAIKQERRNHHM

SEQ ID NO: 179063 - protein, 140 aa, Glycine max
  Coding DNA Sequence Number=SeqID_87378
  Homolog annotation: Hit_ID=A7R828; Match level="QueryCoverage=26%, HitCoverage=25%, E-value=7e-11, Identity=75%"; Hit description =Chromosome undetermined scaffold_2200, whole genome shotgun sequence
MTWKLEWNSETIELADIEWDNLGFGLQPTDYMYIMKCTRGGTFSKVSTCTESTQALNLVLERKDCIDLILIEVHMPTMNGYEFLHRASKEIDVPVIAWKMMSEAENGARIILNLVLLLLLETKAIAVPRKLMNQSIVFPQ

SEQ ID NO: 179064 - protein, 101 aa, Glycine max
  Coding DNA Sequence Number=SeqID_87379
MAVAEKNELGSKGAHGSSSCAMFCVIDTAITEMEKDECSMKDQLEEDDNFVKRVEDSFDCMQVERVEDSFDNIQDEADSCLQEDKMQVGSSEVDQDMAPLW

SEQ ID NO: 179065 - protein, 109 aa, Glycine max
  Coding DNA Sequence Number=SeqID_87380
  Gene Ontology: Mol. function=polynucleotide adenylyltransferase activity; Cellular component=nucleus; Biological process=RNA 3'-end processing
  Homolog annotation: Hit_ID=A7PGZ4; Match level="QueryCoverage=90%, HitCoverage=19%, E-value=2e-36, Identity=79%"; Hit description =Chromosome chr17 scaffold_16, whole genome shotgun sequence
  Pfam annotation: Domain name=PAP_central; Domain location=13-107; Score=-122.4; E_value=0.00054; Accession=PF04928.8; Description =Poly(A) polymerase central domain
MGIPGLSNQNNGQQRLGITEPISLAGPTDDDAIKTLELEKYLQGVGLYESQEEAVVREEVLGRLDQIVKIWVKNISRAKGFNEQLVHEANAKIFTSGSYRLGVCSLARE

SEQ ID NO: 179066 - protein, 104 aa, Glycine max
  Coding DNA Sequence Number=SeqID_87381
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q45NG9; Match level="QueryCoverage=53%, HitCoverage=34%, E-value=2e-19, Identity=76%"; Hit description=Beta -mannosidase
MVSLTPLCFFFTVLIAGGSVIRCAAGADAAAEPETVRFDTGGLSRETFPKGFLFGTATSAYQVEGMAHKDGRGPSIWDLFIKKPAFTSYTYGFSGEKQDANAMR

SEQ ID NO: 179067 - protein, 362 aa, Glycine max
  Coding DNA Sequence Number=SeqID_87382
  Gene Ontology: Cellular component=anchored to membrane
  Homolog annotation: Hit_ID=A7PH45; Match level="QueryCoverage=77%, HitCoverage=75%, E-value=1e-93, Identity=64%"; Hit description =Chromosome chr17 scaffold_16, whole genome shotgun sequence
MSLTLFLKTLFLFFPCYLCLLDSATTTTTLKPILLTPSKPATTIPAFPEQSDVSGCPLTLSDELFDGIKSACSGAKSGADMELHHSRCCPVLAAWLYSAYSATALGSMAGHSHSHSNNAHGHGHATSAYDMMPLLPDDSETCVNELGKALVVRGVELTKPNETCDVVYCFCGIRLHHLTCPDSFSVGQSGELVGDAIVRRLEKNCLSSSTNVNGLPGLGGCSKCLNTLYLFIIVTWNLMDLIEKLKKIKMLNKKTSNSSKAEDRTTKIHNKDCELMGLTWLLAKNRTAYMHTVSAVLRALMLNTDGSYPQSCSLNSDGMPLAVDSSEISDHSSSNNLQPPISLSLLFLCLLLLPMHLTMLSS

SEQ ID NO: 179068 - protein, 319 aa, Glycine max
  Coding DNA Sequence Number=SeqID_87383
  Gene Ontology: Mol. function=sequence-specific DNA binding; Cellular component=nucleus; Biological process=regulation of transcription, DNA-dependent
  Homolog annotation: Hit_ID=A7PH59; Match level="QueryCoverage=100%, HitCoverage=89%, E-value=6e-88, Identity=55%"; Hit description =Chromosome chr17 scaffold_16, whole genome shotgun sequence
  Pfam annotation: Domain name=Homeobox; Domain location=79-140; Score =64.1; E_value=4.6e-16; Accession=PF00046.20; Description=Homeobox domain
MWMMGYEGGEFNMVEHSLITGRKLKPLMPRPMTTSLNNAPTTTTPSLSQIHGNDFLSQYHYHHLEQNKREFNGAAPVVVSSRWNPTPEQLRALEELYRRGTRTPSAEQIQHITAQLRRFGNIEGKNVFYWFQNHKARERQKRRRQMESDAETPEKKDLAASRTVFEVERTKNWTPSTNCSTIAEESVSTQRTAKAVAAESRTDGWLLLDEGELQQRRNVFERNARWHVMQLPCPSPSSAPVTHLINTPPNASVASSMATTTTTVTTRKMDPNLIKTHDLSFFISPQRENSAIYFSGSSSTSEEDNCVESQTLQLFPLRS

SEQ ID NO: 179069 - protein, 72 aa, Glycine max
  Coding DNA Sequence Number=SeqID_87384
MGGNTGEIPNVGLHLTLVLQHISHSSSLHALATCGTCTAAPSAGHVAWTHRQEEFRYMGSPKLRSITAILLV

SEQ ID NO: 179070 - protein, 151 aa, Glycine max
  Coding DNA Sequence Number=SeqID_87385
  Gene Ontology: Cellular component=mitochondrial respiratory chain; Biological process=electron transport
  Homolog annotation: Hit_ID=A9P8N3; Match level="QueryCoverage=64%, HitCoverage=90%, E-value=2e-46, Identity=85%"; Hit description =Putative uncharacterized protein
MGRKKGYVEFEESPPDDFDPANPYKDPVAMLEMREHIVREKWIQIEKAKIIREKLRWCYRIEGVNHLQKCRHLVNQYLESTRGIGWGKDGRHPSLHGHPSLFQFQSTRLPRLTLLSLNDLPVDNNNKKKGFDKFYIGWIGNGYEIIGGVSS

SEQ ID NO: 179071 - protein, 279 aa, Glycine max
  Coding DNA Sequence Number=SeqID_87386
MLKEKLLSVASDYHVFDPCFWRLDVNPNTLIVLYPQANNAKRLEVLLSRLITKKDTQPSSLKRIIRGGLRSCSIEKRPKRQFRSLSTKHECLEEKGALLTILEASNNGFPENLVKVSPSNRKVKDASVPWASLPSSIAKLGRANLLKTLFFLPLLAFLTLCCQEVMKQRDAAHMAATEAIQEAAAAESLLQCLRKKGKRRDGKRGRRGGCVPSLRWKGRVPREPASSSSSYIWQELSNSAKEQNPQLAVEEFLTLHASLNTAARGVVESVEFRDEFGFC

SEQ ID NO: 179072 - protein, 33 aa, Glycine max
  Coding DNA Sequence Number=SeqID_87387
MEMTELHIQVWFSYHDVHDQAKVGRLWLRGLMD

SEQ ID NO: 179073 - protein, 112 aa, Glycine max
  Coding DNA Sequence Number=SeqID_87388
  Pfam annotation: Domain name=AT_hook; Domain location=29-41; Score =17.8; E_value=0.02; Accession=PF02178.10; Description=AT hook motif
  Pfam annotation: Domain name=AT_hook; Domain location=60-72; Score =0.7; E_value=18; Accession=PF02178.10; Description=AT hook motif
  Pfam annotation: Domain name=AT_hook; Domain location=79-91; Score =6.2; E_value=2; Accession=PF02178.10; Description=AT hook motif
  Pfam module annotation: Pfam domain module=AT_hook::AT_hook::AT_hook; Domain location=29-41::60-72::79-91
SGGCSRCRGYRVCAAAETVPVDAAAALGPRARGRPKKYADEMVAAGRGRGRGRGRGGGGGRGRGRGRGQLPAQLRKSGARPVGRPKKILFACCYITYRGNIVAVCQKYICTL

SEQ ID NO: 179074 - protein, 115 aa, Glycine max
  Coding DNA Sequence Number=SeqID_87389
MSSPPFSSSSSNRNLHSEHEVWSLSHQRDAIEVVSNLGRDVVGVGVVVADVELAEGEEVFELGCDVAGDLVAGEGEVLEVLYSGGIWPEKKLPRGEGGRGGAWQRQREKFPNSLP

SEQ ID NO: 179075 - protein, 96 aa, Glycine max
  Coding DNA Sequence Number=SeqID_87390
DSPHVSASPHQLDFAPYASKSYSAQWNVPKLIHDMHMLRSSRILRKWRLRKPIRGYGYHSIMGARMAFVDNWVVGKEKGCYWLSNDIIGLVGNLAV

SEQ ID NO: 179076 - protein, 91 aa, Glycine max
  Coding DNA Sequence Number=SeqID_87391
MVVIVPKEHLVVWFCSLHNRPDNYLKEIINSALKGLDDAPQPKSKAPARWIVVKCNRQKGIFNDPRPLEPERLKALRIQWAQYYLRVRAQS

SEQ ID NO: 179077 - protein, 302 aa, Glycine max
  Coding DNA Sequence Number=SeqID_87392
  Gene Ontology: Mol. function=protein serine/threonine kinase activity; Biological process=protein amino acid phosphorylation
  Homolog annotation: Hit_ID=A7QXA6; Match level="QueryCoverage=38%, HitCoverage=23%, E-value=5e-19, Identity=79%"; Hit description =Chromosome undetermined scaffold_217, whole genome shotgun sequence
  Pfam annotation: Domain name=Remorin_C; Domain location=120-225; Score=-10.5; E_value=0.0094; Accession=PF03763.4; Description =Remorin, C-terminal region
PAATLTRSSSSLPRPLPSSLRKRERGGDFFQKKNDGDDDGVKRSGGNNGNKNARTCLACDMDAMFSFVFSGDRAPYSPAKFLYRSVYGDGVTLQTLPLMNNRMHMIFSFPCLMESIRRWRRYQREEAKIQAWVNLENAKAEARYQREEAKIQAWVNLENAKAETRRGSRAAFVSLEGQIDAHVLDNYYFPKEGFTYQDLLEATRNFSEATVLGRGACGIVYKAAMSDLQIKMRIKMDFFKKYAYTMKVTEKCSFGVVLLELVTGRSPVQPLEQGGDLVTCVRRAIQASESPLDEDDGISSKG

SEQ ID NO: 179078 - protein, 303 aa, Glycine max
  Coding DNA Sequence Number=SeqID_87393
MNCDLAGGEHHKDNCYFYSINNFDRRQELVMYDYHEKERAPDLESILANFMTFQASSKGYCYSMQQQGTQFERNQSFESYQWESYRQPYYHNKAEGVLNLDDLLMQFKDTVKSMQQAFRRTETQISKLVDEMTNAAARKEEEHAEIEIHQESIHQVTSIHHQLTNEEEKPEVSSTPEYPYLATVGYVGGKDKGRLELSVEDQKISFDLFEAMKHLDMGDAHFEEEEVEREIALSTSTMVVFEELKKLRPAENPKAELKTLLAHLKYVFLEEDETKPVIISNSLKKEEEEDQLVHISKRLKAAI

SEQ ID NO: 179079 - protein, 108 aa, Glycine max
  Coding DNA Sequence Number=SeqID_87394
MMSMVEKEAMGKGGSSNNSNDSHVCNVECYYRLKVVIRTSKISKSPKSILLMRGEYGKTESEDECLANRVEDNQILCFSFAFSHGRFKGGKRVMEHVVYFLLIMVQIL

SEQ ID NO: 179080 - protein, 70 aa, Glycine max
  Coding DNA Sequence Number=SeqID_87395
MRGVATNVYSRKTSKNPEKTWSTNFKCERFGSCIYAQGRGKEGGGCRPARPGELGCFHQKTPPSVGTPWK

SEQ ID NO: 179081 - protein, 270 aa, Glycine max
  Coding DNA Sequence Number=SeqID_87396
MVQNKDQELRGSSNGPIGGCHRWLKAYTQGLDWLPNLRTTKGVEVEVTKEDEEVQALRTELEKAQTVKEKFKSIALRIRKENAELRDVNIATTKALEQETKRARREEHGRNKFRGALWGSNSELKLRREERDQSRVDSLIWKDELRICLRSKRSLSQRLCETETNMLAIIRKYQEELNLATAHEHKVADKYARVYAEKEARGRVIDSLHQEATMWVDRFALTLNRSQELPQLLAKVKAMADAYSTPEEIHRLLSYCQHMIDLMAHIIRNR

SEQ ID NO: 179082 - protein, 94 aa, Glycine max
  Coding DNA Sequence Number=SeqID_87397
MAGESGGGDEYHQLDGAQHMLLDAMNAQMQRLLDRNNEEVFGRLELLENQANQNARRNTGGNRGRSDSDAYLDWEMKMSMYLPAMTTLKNRKSS

SEQ ID NO: 179083 - protein, 148 aa, Glycine max
  Coding DNA Sequence Number=SeqID_87398
MTSKIILIMPKIQELSKFQRIKSKKASRIKSRRIKIQEQLSFKIQDSRTIKIKIQDSRFKIQEKLISRFKRRNREATVKTSQGKGYIYLGCSTENKREYISCGSVQVEGTSTWLFKENKGGYIPCGSLTCKGFYKVERNLKNRWLLGD

SEQ ID NO: 179084 - protein, 78 aa, Glycine max
  Coding DNA Sequence Number=SeqID_87399
MEAIKEQMATMMKAMMSMKKIMEANAVIVAAISAVAKPTSSLGSDIPLKGKQLVVYPTKPFGGPSVSPTTAPLAFHSG

SEQ ID NO: 179085 - protein, 86 aa, Glycine max
  Coding DNA Sequence Number=SeqID_87400
MKNGEEQQKTFTDSLTETSRKRYGRKGGRRLPPSSPRRAGLLLEAIQLRKIPWKTHFKISKLLFAPPILICSLPFFRNLRESYGSL

SEQ ID NO: 179086 - protein, 104 aa, Glycine max
  Coding DNA Sequence Number=SeqID_87401
IMVRTRGLGHALGHVTGRGDCDDSDDAPQLHDEPVLPAPNVEADVFPDDPMVLADVEDTGADIPADTGAQAAKDEHEGFPGGPSDPSVLTQYADHVACSVWTGE

SEQ ID NO: 179087 - protein, 132 aa, Glycine max
  Coding DNA Sequence Number=SeqID_87402
PSPTVELSASQALSEQPNVDAKHGIKHEGAETGALSARSERAKRESQVSQRALRGRARARLTGALSKGGKVRGVATNVYLWKRRETKGTGQNEILSSGVDKSGAFAPTYPPLERKSDLRSSSLYMDQVILFT

SEQ ID NO: 179088 - protein, 31 aa, Glycine max
  Coding DNA Sequence Number=SeqID_87403
MAIISPTKISQPPFPRGYNPNMTCTYHGGAG

SEQ ID NO: 179089 - protein, 103 aa, Glycine max
  Coding DNA Sequence Number=SeqID_87404
SVFNFERLDILRDSIRHPSKKLLSFEFAQNFELRYSILSVSRYYVTQSDIRVKRASVFNFERLDILRDSIRHPSKKLLSFEFAQNFGILSSVSTYYGTQSDIR

SEQ ID NO: 179090 - protein, 91 aa, Glycine max
  Coding DNA Sequence Number=SeqID_87405
MPYADLLPSLLSNQMVVVSPGKVYQPHFPRWYDPSATCAYHGGVPGYSIEHCVAFKHKRLGGECSGRMGVLGAEADRECVNFQAIHIGSIV

SEQ ID NO: 179091 - protein, 119 aa, Glycine max
  Coding DNA Sequence Number=SeqID_87406
AHENPKAFSCISGPIFVESSIQCPCKVGLHHSLPLEKDFDASSIGACRPRIFFINGFLCFLKDEWQRNGERKRERRHHFKEKMSLEEAHHHRRPWIRAWRKKEMNEGRGREEHEFLCSK

SEQ ID NO: 179092 - protein, 28 aa, Glycine max
  Coding DNA Sequence Number=SeqID_87407
MNICNFGHNTLSTREWPQGNLPQEIQEG

SEQ ID NO: 179093 - protein, 215 aa, Glycine max
  Coding DNA Sequence Number=SeqID_87408
  Homolog annotation: Hit_ID=Q2JIC4; Match level="QueryCoverage=57%, HitCoverage=19%, E-value=7e-09, Identity=46%"; Hit description =ISSoc9, transposase
LHALAFRRLHVLAFRGQHILAFRGLYILAFRGLHVLAFRGLHVLAFRGLHVLAFRGLHVLAFRGLHALAFRRLDILTFRGQDVLAFRGPHALAFRGQHGIAFRGLHALATCPRLQRATRPRHKRATRPHLQRRAACPHLHRAARPRLQRTTRPRLQRATRPRLQRAARPRLHKAASLAFIGLHTVTFKGLHALTFKGLDVLAFRGLHALAFRGLH

SEQ ID NO: 179094 - protein, 161 aa, Glycine max
  Coding DNA Sequence Number=SeqID_87409
MEKGFSHGSVPIILGKPFMKIARTKIDVYAGTLSMEFGDIVVHFNILDAMRHPSEDHSVFRDEIIDQIVDDYMFDFDSILHGRKHPFLSDLHTCHSLCIESESEFEFDPSECTNHVAESTYTSDLLYEEKFLVIISASLDAEQEEKLLLVLKKHKKAIGWT

SEQ ID NO: 179095 - protein, 212 aa, Glycine max
  Coding DNA Sequence Number=SeqID_87410
MAPRKLASKRSWKDKAAEGTSSAPEYDSHHFRSAEHQQRFEAIKGWSFLRERRVQLRDDEYTDFQEEIVRWRWASLVTPMAKFDPDIVLEFYANAWPTEEGVRDMRSWVRGQWIPFDADALSQFLGYPLVLEEGQECKYGQRRNRSDGFDEEAIAQLLCIPGQDFARTAAGRRVRIMHTNMTTLTQIWMTLLLSNIQPSDHHSDLPLPKCQL

SEQ ID NO: 179096 - protein, 186 aa, Glycine max
  Coding DNA Sequence Number=SeqID_87411
  Pfam annotation: Domain name=Transposase_23; Domain location=46-111; Score=-10.2; E_value=0.016; Accession=PF03017.5; Description =TNP1ENSPM transposase
  Subcellular localization annotation: CTP_CleavageSite=29; ConfidenceScore=5.14e-01
MASFSQLQSQMQSQAPPEPLVGPGPSGPRVSTKGSCVDPSGNDPETGDSDRCGLYIEADPARLVAVGRVYEGSILVHNTPLLPGQVKVSVDEVKDADAPVPVPTAKVAVSPPKPPPKPDPEVDDLLYLMTLTIPELFLRPYQVRWDVTVFGVVIPDFSLYIMHEDLSEIEHDGQCLSILVLQLWIL

SEQ ID NO: 179097 - protein, 151 aa, Glycine max
  Coding DNA Sequence Number=SeqID_87412
MVNVSASLLYNYGFCKSLSLWHVTKTSMRVGNADVYEFLKPQFIPRSRQSQFEAESYIKNWMQNSKRDVYLGAYLNGLDNYLKEIINKLVVFFNTFTLALVENINMLIVQYTSMFVLNNALKRFDDTPQSKSKAAARWIVVKTNFYLTLNV

SEQ ID NO: 179098 - protein, 55 aa, Glycine max
  Coding DNA Sequence Number=SeqID_87413
  Gene Ontology: Mol. function=transferase activity; Cellular component= transcription factor complex; Biological process=positive regulation of transcription, DNA-dependent
  Homolog annotation: Hit_ID=A2WSM9; Match level="QueryCoverage=94%, HitCoverage=5%, E-value=4e-17, Identity=80%"; Hit description =Putative uncharacterized protein
  Pfam annotation: Domain name=TPR_1; Domain location=8-41; Score=23.1; E_value=0.001; Accession=PF00515.19; Description=Tetratricopeptide repeat
  Pfam annotation: Domain name=TPR_2; Domain location=8-41; Score=20.0; E_value=0.0091; Accession=PF07719.8; Description=Tetratricopeptide repeat
  Pfam module annotation: Pfam domain module=TPR_1::TPR_2; Domain location=8-41::8-41
MENDLKSHVCCSVYGLLYLSEREYRETIKCYRNALRIDPDNIEIVSDLSHLQVAS

SEQ ID NO: 179099 - protein, 72 aa, Glycine max
  Coding DNA Sequence Number=SeqID_87414
MASYIIQLYYMPYKLIETTFYIGYLGPTTSIDDHRHRGRRQKGSPILRRLPRTVLESSVFYIGPSVVTDVEC

SEQ ID NO: 179100 - protein, 68 aa, Glycine max
  Coding DNA Sequence Number=SeqID_87415
MAVLVNGVITSASFSGSSSSSTESESQCDVQPLKEAFEKLDFKEGSGSTTRNISFYDTYPMMVLSGLP

SEQ ID NO: 179101 - protein, 56 aa, Glycine max
  Coding DNA Sequence Number=SeqID_87416
MLSLMSGYLQKCHRYRFNNIGIAPMLLSNLPKIPNPAKFITETSISRLAGVTSTNW

SEQ ID NO: 179102 - protein, 187 aa, Glycine max
  Coding DNA Sequence Number=SeqID_87417
  Gene Ontology: Mol. function=transferase activity, transferring glycosyl groups; Cellular component=cytoplasm; Biological process =metabolic process
  Homolog annotation: Hit_ID=A4F1R4; Match level="QueryCoverage=95%, HitCoverage=53%, E-value=2e-52, Identity=50%"; Hit description=UDP -glucose:anthocyanidin 3-O-glucosyltransferase
MPQDLLIVGERETVFSRTLVSLAKVLPQAKAVVMNFFEELDPPLFVQDMRSKLQSLLYVVPLPSSLFPPSDTDSSGCLSWTKMRGKVVSWAPQSKVLAHDSSGVFVSNCGANSVTESVFGEVPMICRPFFGDQGVAGRLIDVWEIGVVMEGKVFTENGLLKSLNLILAQEEGKKIRDNGEADCARCN

SEQ ID NO: 179103 - protein, 34 aa, Glycine max
  Coding DNA Sequence Number=SeqID_87418
MTTGDPPQQKTSQGNEKKKEDENITQEENSDTTK

SEQ ID NO: 179104 - protein, 47 aa, Glycine max
  Coding DNA Sequence Number=SeqID_87419
MWTTTGEEVAAQLAQASQLLPPEATAFWRNLLEGPSGPGCYLHPHFY

SEQ ID NO: 179105 - protein, 91 aa, Glycine max
  Coding DNA Sequence Number=SeqID_87420
  Subcellular localization annotation: CTP_CleavageSite=27; ConfidenceScore=5.16e-01
MLLSSNVIYICVRVVMLVRMIRTRLFAAARVKSCPGMHSSCVIASLSGSARTVLLRPISGGGPGTVWIWGPLRARTRSPLKARACSPLKFR

SEQ ID NO: 179106 - protein, 223 aa, Glycine max
  Coding DNA Sequence Number=SeqID_87421
MAESLYTGFRLARQEKRDLLKKNSSLVATDVRKECAGLREENAATAKALEQETKRARKEEHGRDKFRGALWGSNSELKLRREEKDRSRAHSMVVKEELAACSRSKRNLTQHLCETETNMLAIITKYQEELSLATAHEHRVADEYAQVYAKKEARRRVIDSLHQEATMWMDRFALTLNGSQELPRLLAKAKAMANTYSAPEEIHKLLDYCQHMIDLMAHIIRNC

SEQ ID NO: 179107 - protein, 101 aa, Glycine max
  Coding DNA Sequence Number=SeqID_87422
MSKSFEFGRTGSLNESISYFLIRMDPRVLVPWSSEDYTSSPTEGCTPSLSEDCMSSPSEGYTPSPSEDCMSSPSEGYTPSPLEDHMSSPSEGYTPSLSEDC

SEQ ID NO: 179108 - protein, 64 aa, Glycine max
  Coding DNA Sequence Number=SeqID_87423
MGSLDGHSSTGEGFFVEEMDARWMQFGDYIAPVGKICVVPSQYSLDYMEWFYIILHQFNVEVKL

SEQ ID NO: 179109 - protein, 97 aa, Glycine max
  Coding DNA Sequence Number=SeqID_87424
MSKSCGFGMTGPLDESISCFLIRVDPWVLVPITFRGLHVLANRGLHALTFRGLHVLALRGLHVLTIRGLHALTSRGLHVLALRGLHALTLGTSYPHR

SEQ ID NO: 179110 - protein, 51 aa, Glycine max
  Coding DNA Sequence Number=SeqID_87425
MGVDFVVDSGMAFVDNWVVFGHVGMAVAAWFLLHSHPLHLPQFSQSSKQDG

SEQ ID NO: 179111 - protein, 156 aa, Glycine max
  Coding DNA Sequence Number=SeqID_87426
MFREETGQKHEIGSVFSKVGNSNLRPSGTIWKLGCLRKKQLGDKLLHVLLKNGFRGFRGFRNPSIKFPKTLGKHISLNIGEREEKKDENQIRNTSIRQAPTVKYEKGGELSHWGALRNLPQEASGRKAPTFFPINRGGVLFQNISDPLAMHFSCFG

SEQ ID NO: 179112 - protein, 136 aa, Glycine max
  Coding DNA Sequence Number=SeqID_87427
  Homolog annotation: Hit_ID=UPI00006A17C9; Match level="QueryCoverage =52%, HitCoverage=100%, E-value=9e-09, Identity=34%"; Hit description= UPI00006A17C9 related cluster
MHSSCTIASLSGYACTVGRPPISGGGPGTDKRKLLAPHPGAQALIKHQGRRTLSSLKAQMWSPMKARACNPMKVRACSPQKARTCSPLKARACSPLKVRMCSPQKVRACSPTKARACSPLKGRTCSPLKVRICDAI

SEQ ID NO: 179113 - protein, 32 aa, Glycine max
  Coding DNA Sequence Number=SeqID_87428
MELVEVEALVRIHIEADVPLRRRHTASARRQR

SEQ ID NO: 179114 - protein, 114 aa, Glycine max
  Coding DNA Sequence Number=SeqID_87429
  Gene Ontology: Mol. function=intramolecular transferase activity, phosphotransferases; Biological process=carbohydrate metabolic process
  Homolog annotation: Hit_ID=A4BZU2; Match level="QueryCoverage=97%, HitCoverage=19%, E-value=3e-28, Identity=54%"; Hit description =Phosphoglucomutase phosphomannomutase
  Pfam annotation: Domain name=PGM_PMM_I; Domain location=41-114; Score= -32.5; E_value=0.0087; Accession=PF02878.7; Description =Phosphoglucomutasephosphomannomutase, alphabetaalpha domain I
MTTLEKAKLWLSETFDQETRDAVKLLIDSNSPDLEDSFYRELEFGTGGMRGIMGVGTNRLNKYTLGQATQGLANYMLKQFPNEEIKVAIAYDVRHNSKEFGKLVADVLTANGIK

SEQ ID NO: 179115 - protein, 170 aa, Glycine max
  Coding DNA Sequence Number=SeqID_87430
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=58%, HitCoverage=11%, E-value=2e-09, Identity=36%"; Hit description =Gag/pol polyprotein, 3'-partial, putative
  Pfam annotation: Domain name=G-patch; Domain location=65-106; Score =13.7; E_value=0.0041; Accession=PF01585.14; Description=G-patch domain
MDHVMAKVLIDNGEEDILVNCPSSMPYVEAAEESLEIAFQSFEVASIAFVDSFSGQPCLFDMAVMVARVMLGNGYEPRMGLGKDSGGRTILISARGNRGKFGLGYKPTQAGIRKSIAGRKSGAQGSRLGREVEGGPPCHISRSFISAGLGHEGQVVAICEDDSPSGSDLV

SEQ ID NO: 179116 - protein, 152 aa, Glycine max
  Coding DNA Sequence Number=SeqID_87431
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMGIL

SEQ ID NO: 179117 - protein, 235 aa, Glycine max
  Coding DNA Sequence Number=SeqID_87432
  Pfam annotation: Domain name=Retrotrans_gag; Domain location=46-133; Score=0.1; E_value=0.053; Accession=PF03732.8; Description =Retrotransposon gag protein
MAQPPPRERTLREMAALDFTYESLCIQYPNEDVPYVLKTGLIHLLLKFHGLAEGVAKDWLYYLAPRSITSWDDLKRVFLEKNFLTSRTTTIRKDISVETKKLEGKLDALVNLVTQLALNQKSVPVARVCGLCSSADHHTDLCPSMQQPRAIEQPEAYAANIYNRPPQPQQQNRPQQNNYDLSSNRYNPTWRNHPNLRWSSPQQQQQQPAPSFQNVACPSKPYIPPPIQQQQQPQK

SEQ ID NO: 179118 - protein, 186 aa, Glycine max
  Coding DNA Sequence Number=SeqID_87433
  Subcellular localization annotation: CTP_CleavageSite=23; ConfidenceScore=5.12e-01
MVSRPARPGELSSPSMSRNFTNCLMMGAKHLTRTKQRSHVIEQRSPDKIRRSKRSVVKATKKRKGKEKIIPDANVGGWLLNEKGTLQHLLECSMVASSWNKNPSHGLMEHYEMDFINEKYDILSSSNKVHESVLHHMCLVEKDGHWFLMMVWQVYQVFRVDNHKWVVISTGIGRYYNNFYYFNENS

SEQ ID NO: 179119 - protein, 188 aa, Glycine max
  Coding DNA Sequence Number=SeqID_87434
MAETIDEDAQSINNPFLLELFKEGNSSGVMLDLDKGTWNVVKMEDFKSKNIGNRSNYATSHALDIQSERKLSSLAVQNSDPMKTSQLGYLTVKTGKEKGRRRKRKSLGVKLAALCEVSSSQGRSGSTIPKRVATSFPYSSYQKLKRKSYKTYRIKNVKWNNELANPQTHQPTNQEPRLWLKPMKQRTH

SEQ ID NO: 179120 - protein, 139 aa, Glycine max
  Coding DNA Sequence Number=SeqID_87435
MVNESKRRGFFGGMRLGKTLWNLNESCAKVLPLLCFSLCKLGGVDGDPVLRGTRIRATQEYWYLEICRGGQETLGMSDGVLLPKTKLGQSRPNPGIVSQGEPVTYLSRRAPGSQPIKEQSPRSKEACVAAGQLFILGVI

SEQ ID NO: 179121 - protein, 112 aa, Glycine max
  Coding DNA Sequence Number=SeqID_87436
MCMISLGLLALNGYRSGVIDILIGSVRHIGWRIVERQAIWREGVLVLNLHIMGAAHGGIGSTLASALPITLALAQALGAMMQSYTARALGRRLQVDWARDPREGPRVLMSLR

SEQ ID NO: 179122 - protein, 177 aa, Glycine max
  Coding DNA Sequence Number=SeqID_87437
MASESLFDAWDSYKALIRSCPRHDYYDYTQISMVIKGTIDEYRRMINASARGYHANGTGTKVKKIIEEVAFSERGRDCNRTSPNGIHKEDIKDESLKQQTQMKAMMENEVAKEAKFMRQSTTKLEEAVVNLSTTSYSNLENTMEGEDEKPTIISSILHKEEEKRLMEVLKKHNQALG

SEQ ID NO: 179123 - protein, 158 aa, Glycine max
  Coding DNA Sequence Number=SeqID_87438
  Gene Ontology: Mol. function=transferase activity; Cellular component= mitochondrion; Biological process=embryonic development ending in seed dormancy
  Homolog annotation: Hit_ID=A7QH77; Match level="QueryCoverage=93%, HitCoverage=93%, E-value=2e-44, Identity=31%"; Hit description =Chromosome chr18 scaffold_96, whole genome shotgun sequence
  Pfam annotation: Domain name=PPR; Domain location=23-57; Score=23.8; E_value=0.00062; Accession=PF01535.11; Description=PPR repeat
  Pfam annotation: Domain name=PPR; Domain location=58-92; Score=29.3; E_value=1.4e-05; Accession=PF01535.11; Description=PPR repeat
  Pfam annotation: Domain name=PPR; Domain location=93-127; Score=49.0; E_value=1.7e-11; Accession=PF01535.11; Description=PPR repeat
  Pfam module annotation: Pfam domain module=PPR::PPR::PPR; Domain location=23-57::58-92::93-127
GNIKGAMKLQDEMKTLGISSHNVAMSAIVRGLANSKKIENAIWVLDLMLEMQIIPTVATFTTLMHVYCKEANVAKALELRSIMEHCHVKLDVVAYNVLISGLCANGDIEAAFKLYEEMKQRDLWPNTSIYIVLIDSFCAGNYQIENEAEPTVLLLIKM

SEQ ID NO: 179124 - protein, 35 aa, Glycine max
  Coding DNA Sequence Number=SeqID_87439
MESPTVATYPLAEGDAGITGKVLAPHTSITRDDKA

SEQ ID NO: 179125 - protein, 58 aa, Glycine max
  Coding DNA Sequence Number=SeqID_87440
ELVWTEVVCTEDDVNLRVATSLLAVIDKGCRRRYSKRKFAGYRRVSPPATELLGHDNK

SEQ ID NO: 179126 - protein, 353 aa, Glycine max
  Coding DNA Sequence Number=SeqID_87441
  Gene Ontology: Mol. function=motor activity; Cellular component=cell projection
  Homolog annotation: Hit_ID=UPI00016621D1; Match level="QueryCoverage =90%, HitCoverage=41%, E-value=8e-17, Identity=31%"; Hit description =UPI00016621D1 related cluster
LHVLAVRGLHVLTFRGLHIQTFKGLQALAFIGLHAPTFRGLHALTFSGLHVLAFRRLHVLTIEGLHILPFRGQQALTFVELHDLAFRGLHVLAFRGMHALAFRGLHIHIFKGLHALAFRGLHAFNFRGQHLLVFRGLFVLAFRGLHVLVIRGVHIFPFRGHHVHIFRGLHALAFRGLHALAFRGLHVLAFRELQLLTLRGQHVLTFKGLHALTFRGLHVLSFRGIHVLTFRGLHVLPFRGLQALTFVGLHALTFRGLHVLAVRGLHVLTFRGLHLLAFRGLFVHAFRGLHILAFRGLHVLPFRGLHIHIFRGLHALTFIRLCRNLPFGGRATRDSRDACSTKGIRAESPPTFI

SEQ ID NO: 179127 - protein, 201 aa, Glycine max
  Coding DNA Sequence Number=SeqID_87442
  Subcellular localization annotation: CTP_CleavageSite=41; ConfidenceScore=5.25e-01
MEESSKKRNGSSSTTTAIGHRRHGPSEAPTTPIHPSLSSLRSSSLFSSDDQRLRYLSQFSSRIILDPKYLDIDFFNDETFDCYQDDIISSEVHGISMIIDQSLFFSLTKLPSQGAPFEGTIVDDWKFDYSSHDARHMVCNDQTEMTGRLLTGSLTFDNRMMRYIIVRILLPRSSNLAQASEEDLILMWAFLTGRQIDWAHL

SEQ ID NO: 179128 - protein, 54 aa, Glycine max
  Coding DNA Sequence Number=SeqID_87443
MSPVESPTVATYPSAGGRHRAHRCVFQGRKMSGVATNVYSRKASEKSERVVYEL

SEQ ID NO: 179129 - protein, 377 aa, Glycine max
  Coding DNA Sequence Number=SeqID_87444
  Gene Ontology: Mol. function=metallopeptidase activity
  Homolog annotation: Hit_ID=A6TFD9; Match level="QueryCoverage=99%, HitCoverage=74%, E-value=0.0, Identity=81%"; Hit description =Putative uncharacterized protein yhjS
MILNSANDTDKQLSPLLRQYRALSGLASIRYQGDSHLFDIAWWGSEKGISAQQQLVILHDDEGWRLAQNEEAVVQPRSDEKIVLSNLRVLEGAPALSEYWTLFETNDAVFEAGRTAQSATLLFSITQNEQIEQLGRYIHTLRRQRGSALKIVVREQTPSLRATDERLLLSSGANMVIPCSAGLSRCLTLIESVQKQKFTRHVPEDFNTLLTWSRPLKLRGYQKWDAFCEAVGNIMANTLLPPDSKGVMVALRPAPGLRVEQALTLCKPNRMGDIVTIGNNRLVLFLSFCRVNDLDTALNHIFPLPTGDIFSNRMIWFEDKQISAEILLMRGLSPDNWNTPLPLTIGKNEALNVKHDGRQWRRIPEPWRLSTDGEPRS

SEQ ID NO: 179130 - protein, 78 aa, Glycine max
  Coding DNA Sequence Number=SeqID_87445
  Homolog annotation: Hit_ID=Q1RU49; Match level="QueryCoverage=100%, HitCoverage=64%, E-value=6e-18, Identity=56%"; Hit description =Putative polyprotein, related
MTNDSSKMTNKFAKLDKFEGQDFRRWQKKMCFLLTTLKVVYVLSTPMSVFMEDETLDQTRKHSKWENDDYICHGHILN

SEQ ID NO: 179131 - protein, 373 aa, Glycine max
  Coding DNA Sequence Number=SeqID_87446
  Gene Ontology: Mol. function=helicase activity; Cellular component =chromatin; Biological process=viral genome replication
  Homolog annotation: Hit_ID=Q8RV60; Match level="QueryCoverage=99%, HitCoverage=27%, E-value=8e-95, Identity=46%"; Hit description =Putative uncharacterized protein At2g05640
  Pfam annotation: Domain name=DUF889; Domain location=310-373; Score= -133.8; E_value=0.021; Accession=PF05970.5; Description=Eukaryotic protein of unknown function (DUF889)
MRMMLSSTKGSQCYEDIRIVENVVYHTFREACFAKGFLGSDQEFVGALREANTWGTPHYLRKLFVKLLFMNTMDRPEYVWKQTWQWMADDIVFNHKRQGIQLTDKEKMHLCLTEIENLLQANRKRLRDFPSMPYPLGYAAKTHQNNLIYNELAYDREILAAEFDKCYQSLTDEQASIFNKIMHVVATQSGGVYFLYEYGGTCKTFVWKTLSSAIRSTGGIVLIVASSGIASILLPGGRTTHSKFAIPVPATKNSTCNIHQGSDLAELLHITKLIIWDEAPMCHRYSIEALDKSLQDIMHNINPFGGKVIVFGGNFRQILPVVPRGNRSDIVYATLNSSYIWNHCQILKLTKNMRLQSNPTDHSNLDELKQFSE

SEQ ID NO: 179132 - protein, 115 aa, Glycine max
  Coding DNA Sequence Number=SeqID_87447
MIMRGQDIYNSQDEATTSPSSSESEEVKGEESSEEIYPQEGQPLMVKEECKEVSVSSKSYQGAPTDPKRIKVIPDWPTPPSVEGRSPEYEEPRDLRSNPFQGGGDNAILPPKGIG

SEQ ID NO: 179133 - protein, 70 aa, Glycine max
  Coding DNA Sequence Number=SeqID_87448
MIPFTSSELELTIAAYKAPQNFAAADDPITASPKLSVLSSRRIPCLANSLEYPRVVVTETPCDERRDAFV

SEQ ID NO: 179134 - protein, 177 aa, Glycine max
  Coding DNA Sequence Number=SeqID_87449
HPLDPDKSNRALGFPALITRLCQSFGVPVTPSKVIRPPITRAFIEKYCTQRQVQGDAPQAADAPLPHQAGPAESFDTEQYLRHLVRQQVANHRAHVQTHDCLYQMSLSLQSQGFTSFPCPTPDQFRAEVAWPGDWPEAQAGEAPVGAPAEAPDEADEACEDEEMTDLLDFLGGSGAT

SEQ ID NO: 179135 - protein, 197 aa, Glycine max
  Coding DNA Sequence Number=SeqID_87450
  Homolog annotation: Hit_ID=Q5QJQ3; Match level="QueryCoverage=15%, HitCoverage=24%, E-value=4e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPKKCKLRSYDATHTRSLSSGRETCRASCINESANARGEAVCVLGALPLPRSLTRCARSFGCGERYQLTQRRSFAPSWAVCTNPPFSPTAAPYPVTIVLSPT

SEQ ID NO: 179136 - protein, 534 aa, Glycine max
  Coding DNA Sequence Number=SeqID_87451
  Gene Ontology: Mol. function=transporter activity; Cellular component= membrane; Biological process=transport
  Homolog annotation: Hit_ID=Q48BH2; Match level="QueryCoverage=39%, HitCoverage=86%, E-value=3e-79, Identity=58%"; Hit description =Permease of the drug/metabolite transporter
  Pfam annotation: Domain name=7TMR-DISM_7TM; Domain location=260-447; Score=-41.2; E_value=0.075; Accession=PF07695.2; Description=7TM diverse intracellular signalling
  Pfam annotation: Domain name=DUF6; Domain location=299-417; Score =36.4; E_value=1e-07; Accession=PF00892.11; Description=Integral membrane protein DUF6
  Pfam annotation: Domain name=MFS_1; Domain location=142-501; Score =4.8; E_value=0.013; Accession=PF07690.7; Description=Major Facilitator Superfamily
  Pfam annotation: Domain name=Multi_Drug_Res; Domain location=425-510; Score=-25.5; E_value=0.041; Accession=PF00893.10; Description=Small Multidrug Resistance protein
  Pfam module annotation: Pfam domain module=7TMR-DISM_7TM::DUF6::MFS _1::Multi_Drug_Res; Domain location=260-447::299-417::142-501::425-510
MSCWCRSAIALIAKSWWSRTAAVGAGPDRGGVSREFAGAAGGDAAGGADGGGDANRGGVGRYPVGTGSAWQGGWQRHQWHRHGNTIGAAGLWHHCRYRRLAGGVYDLSRADAADYRAAATSVAGLLGSVPRLFVTEPLLRQRGALALLIFAAFSMLWSSMVLPLTAMSLSHTQTGLFGLAGIAGALAASRSGAWADRGTGQRASGCALVLLTLSWLPIAFAQASLLLLVIGVIMLDFAVQTVHVINQSMLIAGKPAITSRLIGAYMCFYAAGSALGAIAATQLYAHWGWYAVCGGGALVSACALILWYGTRLHAIDPFILAGLRFTLCAIPALFFIKKPDVPWLYLIGYGLVFGIGLWGLVNLGIKTGLSAGIASLVLQFSAFFTLLLGSYVFKEQLSRYQIAGFVLACSGLMSIVFITDGSVTFPGLLLVLAGAIAWSIANIIMKKAGTKQVYPNTLLGYWIWNSLLKQYPVSTVAPLSLMVPVFGILGSMMIFGEVISPMKIVALVLIITGLAVGLYGQRIKRYFIPQSDSL

SEQ ID NO: 179137 - protein, 19 aa, Glycine max
  Coding DNA Sequence Number=SeqID_87452
MVQGKFVLNLGEVLSRYES

SEQ ID NO: 179138 - protein, 241 aa, Glycine max
  Coding DNA Sequence Number=SeqID_87453
  Gene Ontology: Mol. function=motor activity; Cellular component=cell projection
  Homolog annotation: Hit_ID=UPI00006A2D9E; Match level="QueryCoverage =75%, HitCoverage=92%, E-value=4e-15, Identity=16%"; Hit description =UPI00006A2D9E related cluster
  Subcellular localization annotation: CTP_CleavageSite=37; ConfidenceScore=5.07e-01
MDPRVLVPWLQRTTRPRPRHQRTACPHLRRATRPHQRADTPSPSKDCMSSPLRATRPHLEDSHVLTFRGLHALAIIGLRVLTFVGLHAVAFRGLHVLAFVGLHALTFKGLHVLTFVGLHTLTFRGPHVLTFRGLHALAIRGLHVLTFVGLHTFAFRGLHVLAFVGLHALTFRGLHVLANVGLHALTFRGLHILANRGLHTLTFSGLHVLANRGLHALTFRGLHFLANRGLHALTLRGLHVL

SEQ ID NO: 179139 - protein, 84 aa, Glycine max
  Coding DNA Sequence Number=SeqID_87454
MGAKYLEVVKRGSHPNNEWSPDEIRNDHNLSLRFVGQYQSWAARHRMTIICLCVPSDTIAFGWRKGARNDHNLSPPTSQLTVPE

SEQ ID NO: 179140 - protein, 153 aa, Glycine max
  Coding DNA Sequence Number=SeqID_87455
  Subcellular localization annotation: CTP_CleavageSite=44; ConfidenceScore=5.55e-01
MAESSKKRKGFSASASASRAHRSGAISASTAPIPPSLSSSPLFSSEEQQKRYSNIFSSRSIIDPKFIDMEFFSDETFDCIQAFRNLGLIPFMSLQLPIYPELVKAFYCNLEIQDNTLISERFGTKMVIDQSIFHDLTKLTSDGVPFEGTLNDD

SEQ ID NO: 179141 - protein, 116 aa, Glycine max
  Coding DNA Sequence Number=SeqID_87456
  Homolog annotation: Hit_ID=A2Q4S5; Match level="QueryCoverage=81%, HitCoverage=14%, E-value=1e-12, Identity=41%"; Hit description=IMP dehydrogenase/GMP reductase, putative
  Pfam annotation: Domain name=DUF1723; Domain location=11-60; Score =49.7; E_value=1e-11; Accession=PF08330.1; Description=Protein of unknown function (DUF1723)
MELTSACSVDTSDRGLIFVFVERWHKETSNFHLPVGEVTITLDDVASLLHLHIIGTFNSFETSHVDKAVLMLVELLEVPKEEARAKIAQCHGAYVCLSRLRDIYQNKWEAEHWTIA

SEQ ID NO: 179142 - protein, 68 aa, Glycine max
  Coding DNA Sequence Number=SeqID_87457
MVMSFFLTQLLLEVASPIIFLPSPFRFHDLQEAKDSIDEEDPRPTSSTWSYIMWYQEHLHLGSIIFQS

SEQ ID NO: 179143 - protein, 323 aa, Glycine max
  Coding DNA Sequence Number=SeqID_87458
  Gene Ontology: Mol. function=transferase activity, transferring phosphorus-containing groups; Cellular component=integral to membrane; Biological process=two-component signal transduction system (phosphorelay)
  Homolog annotation: Hit_ID=A8GKS3; Match level="QueryCoverage=98%, HitCoverage=72%, E-value=1e-124, Identity=70%"; Hit description =Integral membrane sensor signal transduction histidine kinase precursor
  Pfam annotation: Domain name=HATPase_c; Domain location=203-310; Score=129.8; E_value=7.9e-36; Accession=PF02518.17; Description =Histidine kinase-, DNA gyrase B-, and HSP90-like ATPase
  Pfam annotation: Domain name=HisKA; Domain location=104-164; Score =56.2; E_value=1.1e-13; Accession=PF00512.16; Description=His Kinase A (phosphoacceptor) domain
  Pfam module annotation: Pfam domain module=HATPase_c::HisKA; Domain location=203-310::104-164
MAQQLGGPTDVRVEVNKNSPVVWLKTWAVAGYLGARTADRNPSGRLLAAVPLYPGDYAAGDWRRLAVGKGIIPPPLREYGASEVRSVTRAFNQMAAGVKQLADDRTLLMAGVSHDLRTPLTRIRLATEMMGEEDGYLAESINKDIEECNAIIEQFIDYLRTGQEMQTERADLNSVLGEVVAAESGYEREIENAVMDAELMLDINPLSIKRAVANLVVNAARYGNGWIKVSSGQELNRAWFQVEDDGPGIKPDQLQHLFQPFVRGDSARSTSGTGLGLAIVQRIIDAHDGSLEIGDSERGGLRIRAWLPIPENSATTAVSSNVS

SEQ ID NO: 179144 - protein, 188 aa, Glycine max
  Coding DNA Sequence Number=SeqID_87459
  Gene Ontology: Mol. function=magnesium ion binding
  Homolog annotation: Hit_ID=A7MGB8; Match level="QueryCoverage=98%, HitCoverage=93%, E-value=3e-75, Identity=75%"; Hit description =Putative uncharacterized protein
  Pfam annotation: Domain name=NUDIX; Domain location=46-177; Score =54.3; E_value=4.1e-13; Accession=PF00293.19; Description=NUDIX domain
MTTPLKKPDILNVEAVARSRLFTIEAVDLAFSNGARRVYERMKPSDREAVMIVPIIGDDVILIQEYAVGLETYELGFPKGLIDPGESVFEAANRELKEEVGFGAHQLEALGKLTMAPSYFSSKMNIVVAEGLYEEKLEGDEPEPLIVRRWPLSNLLALLEEPDFREARNVSALFMVREWLVKQGRLSY

SEQ ID NO: 179145 - protein, 96 aa, Glycine max
  Coding DNA Sequence Number=SeqID_87460
MCVRIILRCLRMLPDLIISGKVRATICCLRASSDFSSLDDEGADNHEVSPDAIGPSSHDSRIEAFSWSRPEDADFSRKGADDHIGHCVSTGSLASS

SEQ ID NO: 179146 - protein, 222 aa, Glycine max
  Coding DNA Sequence Number=SeqID_87461
  Homolog annotation: Hit_ID=A5C7Z4; Match level="QueryCoverage=52%, HitCoverage=41%, E-value=4e-08, Identity=30%"; Hit description =Putative uncharacterized protein
VSVDEVKDADAPVPVPTAEVVVSPPKPPPKPDPEVDDPLYLMTLTIPELFLRPYQVRWDATVFGVVNPDFPLHLTETCMRAGNSDIYGFLEPQSIQRFHCSGHLQMVVILPKEHLVVWFCSLHNRPDNYLKEIINSAIKGLDDAPQPKSKAPARWIVVKCNRQKGTTECGYYVMHWMSTIILGTFRNNWEAYFNDPRPLEPERLKALWIQWAQFYLRVRDQG

SEQ ID NO: 179147 - protein, 242 aa, Glycine max
  Coding DNA Sequence Number=SeqID_87462
  Homolog annotation: Hit_ID=A5BZH4; Match level="QueryCoverage=42%, HitCoverage=16%, E-value=5e-08, Identity=35%"; Hit description =Putative uncharacterized protein
  Pfam annotation: Domain name=zf-CCHC; Domain location=201-218; Score =27.4; E_value=5.1e-05; Accession=PF00098.14; Description=Zinc knuckle
MRLHSSSSVNGEGSTPKDPLYKILDELRSLKLWKENQERKEKGKKRVEEISQDEKEKIREEERRKILKELRKEKHASYNSHNSCKSLSEELRDYYEGRHRSHLRPHSHRREKERKPQEANINLPYFHGKDNVEANLDWETRVEQQLKRKSTSKSYGSHSYPKKDQGQGILGVTPSKPKDNKGKTIENQPLKASMQENTSSIKCFKCLGRGHISSQCPTKKTMIMRGQDIYSSQDEATSSPFL

SEQ ID NO: 179148 - protein, 181 aa, Glycine max
  Coding DNA Sequence Number=SeqID_87463
MEVSFVPSSLLQLWRNLGEVVAPPPVPFLAPPLVPLSPPTPVPPVAHAPFLSLVLPRAPNPVSPPPPLPPEAPAASAVPRKGATVRGFWSAARTIVFCGSRRGCGRRGVAQEGFDGGERGEKERDGGFAAALIDDPMWVMNTVLVEAKLKFKGGDTFTCALFLKAHFRGFFFLNCQGVPPK

SEQ ID NO: 179149 - protein, 243 aa, Glycine max
  Coding DNA Sequence Number=SeqID_87464
  Gene Ontology: Mol. function=nucleotide binding; Cellular component =intrinsic to membrane; Biological process=defense response
  Homolog annotation: Hit_ID=A2Q4E5; Match level="QueryCoverage=94%, HitCoverage=26%, E-value=6e-74, Identity=62%"; Hit description =Disease resistance protein
MAQSFIFSIAESLITKLASHAFQEASRVVGLYDHLRDLKKTLSLVKAVLLDADQKQEHNHELQEWLRQLKSVFYDAQDVLDEFECQTLRKQVLKAHGTIKDEVSHFFSSSNPLVFRSKMAQQIKDVSKRLDKVAADRHKFGLRIIDVDTRVVHRRDTSLMTHSRVSDSDVIGREHDKEKIIELLMQQNPNDDDKSLSVIAIVGIGGLGKTTLAKFNDKRIDECFSLKMWMSSEANEWGICERQ

SEQ ID NO: 179150 - protein, 682 aa, Glycine max
  Coding DNA Sequence Number=SeqID_87465
  Gene Ontology: Mol. function=nucleotide binding; Cellular component =intrinsic to membrane; Biological process=defense response
  Homolog annotation: Hit_ID=A2Q4E5; Match level="QueryCoverage=97%, HitCoverage=95%, E-value=2e-97, Identity=43%"; Hit description =Disease resistance protein
  Pfam annotation: Domain name=LRR_1; Domain location=415-437; Score =10.6; E_value=3.3; Accession=PF00560.24; Description=Leucine Rich Repeat
  Pfam annotation: Domain name=LRR_1; Domain location=439-461; Score =4.5; E_value=46; Accession=PF00560.24; Description=Leucine Rich Repeat
  Pfam annotation: Domain name=LRR_1; Domain location=509-531; Score =10.5; E_value=3.5; Accession=PF00560.24; Description=Leucine Rich Repeat
  Pfam annotation: Domain name=LRR_1; Domain location=587-609; Score =10.6; E_value=3.3; Accession=PF00560.24; Description=Leucine Rich Repeat
  Pfam annotation: Domain name=LRR_1; Domain location=611-633; Score =15.4; E_value=0.22; Accession=PF00560.24; Description=Leucine Rich Repeat
  Pfam annotation: Domain name=LRR_1; Domain location=635-658; Score =0.7; E_value=2.3e+02; Accession=PF00560.24; Description=Leucine Rich Repeat
  Pfam annotation: Domain name=NB-ARC; Domain location=112-343; Score= -91.5; E_value=0.00019; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=415-437::439-461::509 -531::587-609::611-633::635-658::112-343
MVNILEIYNNFNKKTLSLVKAVLLDAEQKQEHNHELQEWLRQLKSVFYDAQDVLDEFECQTLRKQVLKAHGTIKDKIARKIQDVNKRLDKVAADRHKFGLRIIDVDTRVVHRRDTSRMTHSRVSDSDVIGREHDKEKIIELLMQQNPNDDDKSISVIAIVGIGGLGKTTLAKFNDKRIDECFSLKMWMSVSHKLQSLSPENSLSLFVKWAFKEGKEEKHPHLVNIGKEIVKKMQRGSIGCENIGEFTIFKVWQMSGNMQCFALFSLYPKDYEFLSLEVIRLWGALGVLASPRKNETPEDVVKQDGGTFYRFKIHDLVHDLAVFVAKEECLLVNSHIQNIPENIRHLSFAEYSCLGNSFISKSAAVRTIMFPNGAEGGSVQSLLNTCVSKFKLLRVLDLSDSTSKTLPRSTGKLKHLRYFSIQNNRNIKRLPNSICKLQNLQFLNVSGWEELEALPKGLRKLISLRCLEITTKQPVLPYSEITNLISLAHLSILSSHNMESIFVGVKLPALKTLSVDDCHSLKSLPLDVKNFPELETLVVDNCVNLDLDQWKDHHEEQSPMLKLKVVGFWNLPQLPALPQWLQETANSLQTLNILDCDNLEMLPEWLSTLTNLKSLVISDCPKLISLPDNIHHLTALERLRIADCPELCRKCQPHVGEFWSKISHIKYVFIEEPEKLEEEEDE

SEQ ID NO: 179151 - protein, 97 aa, Glycine max
  Coding DNA Sequence Number=SeqID_87466
MVVQTHHPRSFLESMRIYVKVININRESVSAALKASPTLSTVEKLPLSMRSDGRNTYEKYPAKNSHQHRYRLVKLAMKFPLPLKLAANLIYTIHCCN

SEQ ID NO: 179152 - protein, 73 aa, Glycine max
  Coding DNA Sequence Number=SeqID_87467
MVFDFKCMLQLKINAWENLQKVKAEAWSCCPLLHKNRISDKRLTAMLKVRMLCPCKGCNNRIHSYSNNNGVED

SEQ ID NO: 179153 - protein, 160 aa, Glycine max
  Coding DNA Sequence Number=SeqID_87468
DKILSVEGTKRSNMLRQNLGGKGGSRKPLSDGRDCSGSESLSLMAGIAPAPVLAPEGADDFGHKRSAPLRFRSENPPLPNDTKINDVFVAKAENPEEELSSLGKIEFFGVDGGHVVAELIREAEGMDAVLEELDGAVEVGELGSFGGDGAMTVGELEVED

SEQ ID NO: 179154 - protein, 41 aa, Glycine max
  Coding DNA Sequence Number=SeqID_87469
MVQVDDRLRRVCKYRRWPEWLAVQRAPQVYPSNLPNRGYWI

SEQ ID NO: 179155 - protein, 37 aa, Glycine max
  Coding DNA Sequence Number=SeqID_87470
MKNKGEDLNNTRREVESEKREGHHINVVVAEWVGTLE

SEQ ID NO: 179156 - protein, 211 aa, Glycine max
  Coding DNA Sequence Number=SeqID_87471
  Gene Ontology: Mol. function=protein serine/threonine kinase activity; Cellular component=integral to membrane; Biological process=protein amino acid phosphorylation
  Homolog annotation: Hit_ID=A7PR98; Match level="QueryCoverage=55%, HitCoverage=22%, E-value=3e-49, Identity=79%"; Hit description =Chromosome chr14 scaffold_26, whole genome shotgun sequence
  Pfam annotation: Domain name=Pkinase_Tyr; Domain location=15-205; Score=-114.2; E_value=2e-05; Accession=PF07714.8; Description =Protein tyrosine kinase
MAFSSIMSSGIDVLLWTERVLGRGALSCVFRGRVGIWRTAIAIKRLDKEDKECAKAFCRELMIASSLNDTNVIPLVGFCIDSEEGLFFVYKYVSGGSLEHHLHGRKKGVKGSSPLPWSVRYEVAIGIAEAVAYVRNVDEGWRGAIQVRSKCFSTTDIIDEHFRFANLDELRYSLRFVDLDKLRSRCGSSSCLHSDLEGVEVVAHLNLNLKW

SEQ ID NO: 179157 - protein, 185 aa, Glycine max
  Coding DNA Sequence Number=SeqID_87472
  Gene Ontology: Mol. function=transmembrane receptor activity; Cellular component=intrinsic to membrane; Biological process=innate immune response
  Homolog annotation: Hit_ID=Q2HVE1; Match level="QueryCoverage=82%, HitCoverage=87%, E-value=3e-47, Identity=61%"; Hit description=TIR
  Pfam annotation: Domain name=TIR; Domain location=42-172; Score =157.3; E_value=4.1e-44; Accession=PF01582.11; Description=TIR domain
MAYSSSGASQIKYVVLLLCDLMLISGLTGEISDNSPQIKYDVFVSFRGEDIRHGFLGYLTEAFHQKQIHAFIDDKLEKGDEIWPSLVGAIQGSLISLTIFSGNYSSSRWCLEELVKIIECRETYGQTVIPVFYHVNPTDVRHQKGSYEKALAEHEKKYNLTTVQNWRHALKKAADLSGIKSFDYK

SEQ ID NO: 179158 - protein, 125 aa, Glycine max
  Coding DNA Sequence Number=SeqID_87473
MGSIARESLSKSSRSQWKELGSVAHFEKIAGAATSQEAWKILEKCNEGAEQLKKILRTLNPKFGHIVVAIEESKKLEELKVEERQGSLEAHEQRLFERGSEKPDDHQELQAHTSRRGGHNPKGNF

SEQ ID NO: 179159 - protein, 264 aa, Glycine max
  Coding DNA Sequence Number=SeqID_87474
MNYYPILVLHWGVGDSEQDPSSLVVGQSVYKGDGSAFCLQVLGSTRWLVLFFVVVVPYVFVGGVVPILSSTRPTEEQTRRLKIHHGGMFIYKLFIVYINGPIVEEEWGWHVDIMSYIDFTKVINFLGYKSFKCLWYRDPRKALSRGLKPLNYESDILQLVEDISSFDVVEVYVDQGVFDKYAKKLNDDKGDEVVVIDGVGAEAVVEGEDEAEGQVEAEVQVDEQGEIEVVVEGVVEDDVEAEEDDDDSNNCSEVSYSDFEERWD

SEQ ID NO: 179160 - protein, 88 aa, Glycine max
  Coding DNA Sequence Number=SeqID_87475
MESLRYTNTSRDFGALRRRRGKKLTGLRFPQPRMLTICLEEMNQIAKNKKRTHKGAAGVAIAREIMRQLTGHLEESISFVVAIGRKTF

SEQ ID NO: 179161 - protein, 75 aa, Glycine max
  Coding DNA Sequence Number=SeqID_87476
MTTHTTSGFASPCFGGGSLACFRDFVRDNGGCRETKVSDGSGDAWELKKRKDENEGFCVETVEVDRREKVLYKTF

SEQ ID NO: 179162 - protein, 151 aa, Glycine max
  Coding DNA Sequence Number=SeqID_87477
  Homolog annotation: Hit_ID=A2Q1F1; Match level="QueryCoverage=47%, HitCoverage=20%, E-value=5e-21, Identity=70%"; Hit description=SAM (And some other nucleotide) binding motif
MISKVVSCYSWSAIFFFPLLSVGVNNYNILASSAYAFWGIYKNRPKDGEYTLPLIHVYGFSKARDPEFDFHERIRTALLEVAVNVDMRRLVCTLFGGLVVMLAIISMALVILVCSYRKRDSQSSSSEVNEDVKSQAMAKNLETNSEPLVNR

SEQ ID NO: 179163 - protein, 32 aa, Glycine max
  Coding DNA Sequence Number=SeqID_87478
MAGRNDRAIVDALQALAQAIGNLNRGEAGGAV

SEQ ID NO: 179164 - protein, 52 aa, Glycine max
  Coding DNA Sequence Number=SeqID_87479
MCFREENPSRGASVTLPRRFHKRFCGNSSSFFIVLRSFFIILRSSTVFLLLL

SEQ ID NO: 179165 - protein, 165 aa, Glycine max
  Coding DNA Sequence Number=SeqID_87480
  Subcellular localization annotation: CTP_CleavageSite=69; ConfidenceScore=5.09e-01
MKRVRMKEKPMMRLSFLHGNFPPGKQCHYSANISPSHYPPPSHPQRSSLNQPQSLSTTLPLTNTTFSTNQNTNEGRNFAAKKPIEFTLIMVSYDDLLPYPLDNSMIAITPTKVPQPPFFRGYDLNATCACRGEAPGHSIEHCMTSKREVQSLIDAGWLKFEENRL

SEQ ID NO: 179166 - protein, 120 aa, Glycine max
  Coding DNA Sequence Number=SeqID_87481
MSSPSEGTRPHLVLALRGLHALTSRGLHVLALRGLHALTLVTLTVERTTRPRLERTTRPHHQRAARPHLRGLHVLALRGLHALTLGTSYPHRQRTTRPRLERTTRPHHQRAARPHLQRTT

SEQ ID NO: 179167 - protein, 196 aa, Glycine max
  Coding DNA Sequence Number=SeqID_87482
MGTIMFEAQWHTKYSKASAQILMCAPLSTGIGTSTSKWTEAEPVVAHEFEGGPGDAVEEGTTAGVGGGLGRLVPLEADDIDFEDGDDEVGEGADVVARAGGPLGVDVVGLEKDEVRARVGEEPGGTIVDVGGALHHLVRRETHGGRNSVSCSSISAVKEKREYESVRVRGRLSGGQLQELGFAKGRTTYRPKRLFE

SEQ ID NO: 179168 - protein, 254 aa, Glycine max
  Coding DNA Sequence Number=SeqID_87483
  Homolog annotation: Hit_ID=A5BZH4; Match level="QueryCoverage=32%, HitCoverage=13%, E-value=3e-08, Identity=40%"; Hit description =Putative uncharacterized protein
  Pfam annotation: Domain name=zf-CCHC; Domain location=108-125; Score =21.9; E_value=0.00073; Accession=PF00098.14; Description=Zinc knuckle
MNHHSSSVNGEGTSHKDPLSRILDELSLLKLWKEKLERKEKGKEREIRVEQQLKRKSTSKSYGSHSYPKKDQGQGILGVTPSKPKYDKGKTIEKQPLKASMQEKTSSMKCFKCLGIGHITSQCPTKKTMTMRGQDIYSSQDEATTPPSSSESEEAKAEESSEEICPQEERQPLMVKEECKETPASIATPIRLEFNPQVKELLDEGLVHKSLNPCALLVPKIGIIRHQIPKIGDMMNVLSGATLFVKSLVHPTSS

SEQ ID NO: 179169 - protein, 112 aa, Glycine max
  Coding DNA Sequence Number=SeqID_87484
MAIQAEESRADQKVEGFKQQLVDEGALEPVDDLVELEEIVEEAEGDEEGEAPIRNCQERIKKKEEREKEKEEETKEKEEKEKKLKNEKQKEKVVETEKKKGKSCWNTWPRNN

SEQ ID NO: 179170 - protein, 63 aa, Glycine max
  Coding DNA Sequence Number=SeqID_87485
  Subcellular localization annotation: CTP_CleavageSite=9; ConfidenceScore=5.10e-01
QQQFLKNLSLAPKSSSSFPGTRESDTTLLEANTMADEQPRRVTLEDYSSTSVPQFFTSIARSE

SEQ ID NO: 179171 - protein, 39 aa, Glycine max
  Coding DNA Sequence Number=SeqID_87486
MASYLTRDVNSMNGSGMKKEEREETPLQGEDESRRSSPP

SEQ ID NO: 179172 - protein, 134 aa, Glycine max
  Coding DNA Sequence Number=SeqID_87487
  Gene Ontology: Mol. function=rRNA methyltransferase activity; Biological process=regulation of transcription, DNA-dependent
  Homolog annotation: Hit_ID=A9E7N2; Match level="QueryCoverage=37%, HitCoverage=12%, E-value=1e-11, Identity=64%"; Hit description =Putative sun protein
  Pfam annotation: Domain name=Porph_ging; Domain location=106-133; Score=-0.6; E_value=0.015; Accession=PF09697.1; Description=Protein of unknown function (Porph_ging
MVYATCSILPSENTGQVKEFLKNNPDFKLIKDEKVMPSEGYDGFYMALIESENFILNNSIREQKSEYPFEITKIEKPSNTIVSYAFLKPDEIISTADKESVAKQTFELTNETKKILGYTCRKAVTKINSNTIEI

SEQ ID NO: 179173 - protein, 178 aa, Glycine max
  Coding DNA Sequence Number=SeqID_87488
MKANIEAMKDQMTTMMEAMMSMRKMMEVNAAAVVATGTATKVDPTHPSGINQVNRLVLDMVGQEGKTLGSTGSPHFMQVQSKRPFPPYGLPPNYAPPNVAHVSDENVDNSAPIPIESQQLQSGHAHVSQPMGETPKVPRDHVLADFEPHLRYATEGGPPAMMEREKFDHIEVRLRAIE

SEQ ID NO: 179174 - protein, 38 aa, Glycine max
  Coding DNA Sequence Number=SeqID_87489
VSVDKLMNITEMGYVIASRYNVYLKDRWSFTAFSIVVV

SEQ ID NO: 179175 - protein, 201 aa, Glycine max
  Coding DNA Sequence Number=SeqID_87490
MTRGNPGDLQPFDPEIDRTIHRLVRHSVHPDIFVHFDHSEYSVVGDSEYSDFEHSTTNFHTENMAQPPPRETNLREMVAPNFTYESLCIQYPDKGVPYVLKTGLIHLQPKFHGLAGEDPHKHLKEFHIVCSTMKPPNVQEDHIFLLQPTLLRASEARLTGAYSMEGKCTESPPTFIERKTLEKPKEIGHKEYSRFESYLYA

SEQ ID NO: 179176 - protein, 304 aa, Glycine max
  Coding DNA Sequence Number=SeqID_87491
  Gene Ontology: Mol. function=oxidoreductase activity; Cellular component=nucleus; Biological process=electron transport
  Homolog annotation: Hit_ID=A6T9C0; Match level="QueryCoverage=90%, HitCoverage=84%, E-value=1e-122, Identity=81%"; Hit description =Putative dehydrogenase
  Pfam annotation: Domain name=DeoC; Domain location=30-214; Score= -62.9; E_value=0.014; Accession=PF01791.10; Description=Deoxyribose -phosphate aldolase
  Pfam annotation: Domain name=NPD; Domain location=1-300; Score=124.6; E_value=2.9e-34; Accession=PF03060.6; Description=2-nitropropane dioxygenase
  Pfam module annotation: Pfam domain module=DeoC::NPD; Domain location= 30-214::1-300
ILGIEKPVIQGPLSWLTDARLVAAVSNAGGLGVLGPNAGLTADTAVSTPEETAEKMREEIRKTKRLTEKPFGVNLIPTAVNDVWTGPILQVVKEEGVRAVVYTGYGEGSIIPALFSELKEAGIAIIYRDINPTPENTRLAEDAGADIIVATGFDEGGTLPATALGTFSIVPLIADAVKHIPVMAAGGITDNRTARAAHTLGAEGVFAGSVFISTEESRVPQGVKDKIVAANGLDLLLFRTVPHYYRSLPGRLAEKLAAMDKAGASNEALGKAMGGYGACAWACWKITPMRAISRSARELEIFTA

SEQ ID NO: 179177 - protein, 101 aa, Glycine max
  Coding DNA Sequence Number=SeqID_87492
  Gene Ontology: Mol. function=aspartic-type endopeptidase activity; Biological process=DNA integration
  Homolog annotation: Hit_ID=A5BPN8; Match level="QueryCoverage=49%, HitCoverage=4%, E-value=2e-15, Identity=78%"; Hit description =Putative uncharacterized protein
MKLLRVQDKRNKIRVTTVSFAISLDINTWWLDSGVTTNISVSMQGCLSYRKPIDFERWIYVGDGKSVEVEALPMVNPLMQNCVVLSVELIIQTQEHYGISA

SEQ ID NO: 179178 - protein, 156 aa, Glycine max
  Coding DNA Sequence Number=SeqID_87493
  Gene Ontology: Mol. function=helicase activity; Biological process =viral genome replication
  Homolog annotation: Hit_ID=Q2A9E0; Match level="QueryCoverage=100%, HitCoverage=14%, E-value=3e-27, Identity=34%"; Hit description =Putative uncharacterized protein
MVESERLSYIRNNQKKLRVDKYSSLQTSLDTRTAKGLTKGKRVILPSTFVGSPRYMDQLYFDDLTKGQLLGKVVAYMHTIEFQKRALPHVHLLLFLHPDNKYTSSTDIDKIISAEIPSHQDDPELYRLVENHMIHGPCGILQPNSPCMKEGKCSRF

SEQ ID NO: 179179 - protein, 337 aa, Glycine max
  Coding DNA Sequence Number=SeqID_87494
MVVAQARDRRAAGAIQVGAALLVIEPHALATDRDRGRAAQGTMKDSGAGHGEELRGGNVGKGREMDRSAVAAAPRRRLLPIGAFVPQSCFDLGQSLQHLVAATGREPRDQVFGQAQQARGAVEERGGAARRRCVRAGLGGAGKMQYMAGGPGHRAGEAVGQRQHGDTAGGDLGRQAHGGAGIGGLRHHYQHIARLQAVGIFGRRAAQAIDQDAVAAQQVVGIAHLEGDAESGARAQEADWRARSRASTAASKAASSLTCRIEARAAVCHCVSASCPRPPDCRAPHSCRGPRRAPAAAWWRATRPPPAPAGASTKAPLRPGWPAPIGRRAAARRAAWR

SEQ ID NO: 179180 - protein, 273 aa, Glycine max
  Coding DNA Sequence Number=SeqID_87495
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=100%, HitCoverage=20%, E-value=1e-142, Identity=92%"; Hit description=DNA -directed RNA polymerase subunit beta''
MDSVGIRSANPYLATPGATVHGHYGEILSEGDILVTFIYEKSRSGDITQGLPKVEQKESDTWNGRITKILASLGILIGAELTIAQSRISLVNKIQKVYRSQGVHIHNRHIEIIVRQITSKVLVSEDGMSNVFLPGELIGLLRAERAGRSLEEAICYRVLLLGITKTSLNTQSFISEASFQETARVLSKAALRGRIDWLKGLKENVVLGGMIPVGTGFKRIMNRSKQRQYNKMTSETKKKNLFEGEMRDILFHHREFFFFVSKNLCDTSQQSSI

SEQ ID NO: 179181 - protein, 67 aa, Glycine max
  Coding DNA Sequence Number=SeqID_87496
MAGASDNGGVYHQLDGFQRLLLDAMTTKMQCLLKRNNEELYRRIEGLEHQMNPNARRPYGGIRRVND

SEQ ID NO: 179182 - protein, 170 aa, Glycine max
  Coding DNA Sequence Number=SeqID_87497
  Subcellular localization annotation: CTP_CleavageSite=42; ConfidenceScore=5.67e-01
PIPLKIIIEATRSNTQKSRARRSEAPPSSTPAPTHASTSPPSASAPSTSTTPVPSVLIEPASGPAPDHVEFVGCGPPAEPQPAEEDVFADMSKPSTSKPFIVEAGPATPLEDTVAVTPQKQSAPVPNLPDVAPCGACRPWIFFINGFLCFLRSNCSGMEKEKDEWRCHFK

SEQ ID NO: 179183 - protein, 268 aa, Glycine max
  Coding DNA Sequence Number=SeqID_87498
  Homolog annotation: Hit_ID=Q2HW90; Match level="QueryCoverage=60%, HitCoverage=38%, E-value=7e-14, Identity=27%"; Hit description =Putative uncharacterized protein
YGKIWDLARVEVSMEPIASLSQYYDQPLRCFTFEDFQLVPTVKELEEILGCQLGGRKPYLFFGFYPSTIRVAKVVKISAQELERLKQNRNGVVGVPRKFVLFPNMEGLVDLAAIDAFLAFHHGKESPVVAILAMYDTFDRGCEKSDARIFCCALALYVWLVSHPFLQEGRPVYPLQGHRSCVEKGKANWDQLLASMEGRLLIGSLARRKEESGFYLHAKDDRELRGSSNGIIGGYHKWLRVQTQGLDWLPNLKTVRDDEVKASEESDE

SEQ ID NO: 179184 - protein, 80 aa, Glycine max
  Coding DNA Sequence Number=SeqID_87499
MGKGWLRWCLPEDPFRVLLEVPEEGVPEDFRKKETFQKSSSPGKFPEEGFFRMTFQWFRKHFPENHFFRKVSGRSNSSGS

SEQ ID NO: 179185 - protein, 127 aa, Glycine max
  Coding DNA Sequence Number=SeqID_87500
MSGIRGDILDVTTPLGAAVPPCLSIDTQLSRPITNATGVGAILTWVLSPRRVQHPILLGKPRNEKKSARNHVTYCLPRISSQEREKKHLFPTLSAKRTTQKSDSSFLKFNQIQAFTSSTPCFASCTL

SEQ ID NO: 179186 - protein, 279 aa, Glycine max
  Coding DNA Sequence Number=SeqID_87501
  Gene Ontology: Mol. function=aspartic-type endopeptidase activity; Biological process=DNA integration
  Homolog annotation: Hit_ID=A6YTD9; Match level="QueryCoverage=60%, HitCoverage=16%, E-value=5e-21, Identity=29%"; Hit description =Integrase
MGASSHVSKSALECGGVGWSVADYGGAGGDGGVGGDIGAGGESIGELEGEEAVGPKEEEEEGVGDGGEEARVVFETGAGAGGGACGGDDDEEEPVVGKWQGKRSEGGSRYNMAGSNSIIQGSLSVFDGKLFDDWKVKMLAIFGFQDVFEVATFRFEDPGRKATEEQQLAFKQKQKLDCKARFLIYQCVNSKIFNKISKASTSKEAWEILMKTYGDGEKNMKIPDELVVDKILRTLPPRFDHVAVAIEESRNLDDMEIEELQHSLKAHEMRINERRSNQE

SEQ ID NO: 179187 - protein, 27 aa, Glycine max
  Coding DNA Sequence Number=SeqID_87502
MRKVVYGFQVTDEEVESLNKRKTFYLK

SEQ ID NO: 179188 - protein, 285 aa, Glycine max
  Coding DNA Sequence Number=SeqID_87503
  Homolog annotation: Hit_ID=A5C6C9; Match level="QueryCoverage=73%, HitCoverage=17%, E-value=2e-19, Identity=34%"; Hit description =Serine/threonine protein phosphatase
  Pfam annotation: Domain name=DUF1723; Domain location=146-195; Score =49.1; E_value=1.6e-11; Accession=PF08330.1; Description=Protein of unknown function (DUF1723)
RLGRGGDGDDIDDAPQCQRPTALARRRRVPVILDDDVSVVPADSPAVPEAEAVVAGDEPMDTGAEIDAQDTDAETDGDEPVGFPGGPRDPSVLTEYADHVAGSERSELKLCSHGRKVHNLGRPVPAIEDMVVGTGLSPLIACSIDTSNQGLISSFVERWDRETSSFHLFVGEVLITLDDVAYLLHLPIVGAFHDFQPLCIDETVVLLVELLMVSTETQHWAVIAHAYLLHLLGCTLFANKSATHVHVSHLQALHDLNLVGRYAWGAVGLIHMYDQLNDASLSVTS

SEQ ID NO: 179189 - protein, 131 aa, Glycine max
  Coding DNA Sequence Number=SeqID_87504
MAAQLIHDRVVMEGLEGVWETLEGNEKCRFRGTIRLTVTSLPVEWILPTPTPYRLVEPVQVIEVSSSEEYLEEDPEELPPEPAVDALDFPEDDEDPLPNVDSPEDVMSASEADSKEESGPGGTANSDDSSS

SEQ ID NO: 179190 - protein, 394 aa, Glycine max
  Coding DNA Sequence Number=SeqID_87505
  Homolog annotation: Hit_ID=A7PNW8; Match level="QueryCoverage=100%, HitCoverage=100%, E-value=1e-57, Identity=38%"; Hit description =Chromosome chr8 scaffold_23, whole genome shotgun sequence
MAENLDDGEFWLPPQFLADDDVVVFPTPFEAKFPPLSDDAVLFPYGSPVDSTVGGSSETESDEEEQLVAELTRHLTRSSLQPDTESVGRFVSGSPQSTLCAFGSGCSCGKGSSQGSPDGVCKLSSAKTTWDLLHAAAGEVERMRLKQEGYALNHHNGNFVPQRKPSPVTTLPSKNTTANPNPDVGGFYTQQQSLSHQQLQIAQLLRQQQLAKQQNSVWNVQKQCDGVYSQRQQQSNQMVPNRGRNIDVNGRNIRPLGLSASAWPTLQHAKQQNQQYGSGMRAVFLGNPSGRRECAGTGVFLPRRVDIPESRKKPACSTVLVPTRVAQALNLNLDDMIVGQPQHLQRFNACPNIENGAAVSRLRGNYVLSQQKRNLNKPQPAGYHEIRLPQEWTY

SEQ ID NO: 179191 - protein, 98 aa, Glycine max
  Coding DNA Sequence Number=SeqID_87506
MGGTKRLLVITPKVVISLLMVSRGIIPFEKHIAAVGTTSNNMLSKRKTLDEGSLLSSKLETQHDHKFTSTPYVPMDPGIGPFFNSLCAQIVLVFLFIK

SEQ ID NO: 179192 - protein, 200 aa, Glycine max
  Coding DNA Sequence Number=SeqID_87507
  Subcellular localization annotation: CTP_CleavageSite=21; ConfidenceScore=5.59e-01
NCWNLDDPSVTFWGTRKSRARGSEAPSTSAPPTLAPSTSAPSTSPLPPAPTTPVLPDPSSQSSEPFFSMLQSLHQGQLLIMQSLQNVVHQRPVVSVEEFIQQVAWLGVQPSPLGGGEASAAQESQQDQQEDIPEVAEPTPPKPFTLESDLVVVQADPAISPHPEPSAPMPDLPLSQDPSSAPALDLNEHAQDQDFYFPAF

SEQ ID NO: 179193 - protein, 145 aa, Glycine max
  Coding DNA Sequence Number=SeqID_87508
MPISPYERIAPTRHLVDRRSPTGPWGFQLWLRASVSPIGCPSPPARSCHRDIGIAPARHPVDPEKSNKASAGRDTTSAWGWPIAGNRRTAATSKAPQLICKSWSVAYNPWSTSRRPSPKPKLSKSTRSVTDKSSRVQLKTLKKRY

SEQ ID NO: 179194 - protein, 92 aa, Glycine max
  Coding DNA Sequence Number=SeqID_87509
EADIEEEELIDLRSNLLQGGGDDAILPRKGPVTRAMSKRLQKDWARATEEGPRVLMSFRRASAKHNTPGLTVRKNPEEDEPYRFAKRTTSSL

SEQ ID NO: 179195 - protein, 106 aa, Glycine max
  Coding DNA Sequence Number=SeqID_87510
MPNRLLDEHGLNQVKRTRSSKSKIRTVATYPTEGGRRETRGMSVPRKEYARSRHQRLFEENVGKTGKDAIYELLSERFGSCIYARGRVFPFAPTYSSIWDEKIRPT

SEQ ID NO: 179196 - protein, 202 aa, Glycine max
  Coding DNA Sequence Number=SeqID_87511
MCFLAHCLLLFSLRSVLPAWSFLAIGLVRCREGEVEGEGEGVAVVIGGIVYEMDEDQWMYKGIMSGEVDMNYENEEECGVNEPHVDCSDAFNTSQPRECSAMVKLICGIHDHVDWFVRSDTNTSSRGRTLFVLIGCERSGEYRCRKKEFVRRDTGTRKCECPFQASWQASGCRTYWIVKLICGIHNHELAKSLVDIHMSDDE

SEQ ID NO: 179197 - protein, 123 aa, Glycine max
  Coding DNA Sequence Number=SeqID_87512
  Gene Ontology: Mol. function=exonuclease activity; Cellular component= chromosome; Biological process=DNA metabolic process
  Homolog annotation: Hit_ID=A4W769; Match level="QueryCoverage=100%, HitCoverage=11%, E-value=4e-38, Identity=69%"; Hit description =Exonuclease SbcC
RKASDALELEVVDTWQADAVRDTRTLSGGESFLVSLALALALSDLVSHKTRIDSLFLDEGFGTLDSETLDTALDALDALNATGKTIGVISHVEAMKERIPVQIKVKKINGLGYSRLDKVFAVQ

SEQ ID NO: 179198 - protein, 259 aa, Glycine max
  Coding DNA Sequence Number=SeqID_87513
MFVSLLKHVCIFSGENNETFSSLTSYPELCRSEFLIGGYVGARASLLSTIPPFVAMTQELVARVDTLRLSAPRHSVTPSVIDEQRPIWSSAPFPEMSSFSDGDFSSLTSYPELRRGGGPDDTRRYLTVIRTLLSSRGGGPDDKQRPSLVILHPMIRGDTLRLSAPLCHPEAAGPMTSRDQVWSFCTHDTRRYLMGLTQSSAPFVPPGTTKSFTCGNFMVARDSRQPRGAKLVSYTDFRGPLLDDMRPFFGPCEVLGTHH

SEQ ID NO: 179199 - protein, 93 aa, Glycine max
  Coding DNA Sequence Number=SeqID_87514
GVVLAEVLLADSRFTRPDMGFHPTKLNFVPSDADEAPLDVSICLHAFGIVGVLTIGSCVAYLPHGIRVASQTHSIQASLLGTLEDFKVPHVNH

SEQ ID NO: 179200 - protein, 69 aa, Glycine max
  Coding DNA Sequence Number=SeqID_87515
MGAYAKDEKLMIHSFQESLTGDTLPVFYYENGGLHTFQLYGYGLCRKKDRSGSEKRQIWSSCFDKNWGK

SEQ ID NO: 179201 - protein, 80 aa, Glycine max
  Coding DNA Sequence Number=SeqID_87516
MPFSVEITNKAKGKGKEVAGKGSAGKRKGAFDDDKTGGGHKRNKRGVLHFYLCRLFHARFDEISSSVNWISRYTIVTVVT

SEQ ID NO: 179202 - protein, 201 aa, Glycine max
  Coding DNA Sequence Number=SeqID_87517
MAPRKLASKRSRKDKAAEGTSSAPEYDSHRFRSAVHQQRFKAIKGWSFLRERRIQLRDDEYTDFQEEIGRRRWASLVTPMAKFDPEIVLEFYANAWPTEKGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNIPAQRS

SEQ ID NO: 179203 - protein, 59 aa, Glycine max
  Coding DNA Sequence Number=SeqID_87518
  Subcellular localization annotation: CTP_CleavageSite=19; ConfidenceScore=5.11e-01
MAHSPPLGLCPLYTMGIALPMTKSKVRPFTTRKYTFNIGYLEHSTSVLKPMLKVTMLNV

SEQ ID NO: 179204 - protein, 223 aa, Glycine max
  Coding DNA Sequence Number=SeqID_87519
  Gene Ontology: Mol. function=oxidoreductase activity; Cellular component=microsome; Biological process=electron transport
  Homolog annotation: Hit_ID=A7P5M1; Match level="QueryCoverage=91%, HitCoverage=51%, E-value=2e-81, Identity=68%"; Hit description =Chromosome chr4 scaffold_6, whole genome shotgun sequence
  Pfam annotation: Domain name=Pyr_redox_2; Domain location=17-215; Score=-44.5; E_value=0.045; Accession=PF07992.5; Description =Pyridine nucleotide-disulphide oxidore
MGRSCNKSQQQHVEGPIIIGAGPSGLAVAACLSEDKVPFVILERHNCIASLWQNKTYDRLKLHLPKQFCELPLKGFPHTFPKYPTKYQFISYMESYASHFNIHPIFNQTVKSAEFDKGSNVWVVRTEEFEYSSRWLVVATGENAEPVVPRIHGMELFGGAVAHTSVYKSGSEYRNKKVLVIGCGNSGMEVCLDLCRHNAKPYMVARNTGDVRLLNVWDSYGAL

SEQ ID NO: 179205 - protein, 113 aa, Glycine max
  Coding DNA Sequence Number=SeqID_87520
MRAKARVMSEIEEVQEQMKTDMEAMKEQMAIMMSMRRMMEVKEAKSWEVQAAPILCKFRTSIPSHHMACLPTIHHPTFYTLSMGMSTTPHLYPLRAKNPNLIMHNLSTHGEDT

SEQ ID NO: 179206 - protein, 105 aa, Glycine max
  Coding DNA Sequence Number=SeqID_87521
MNLRGRQVEIADPLCPFYNNLDEDAAHLFFNCSKVLPLWWETVSWVKSVGAFLKEPKDHFMHHSRSNATRTRLFVSLEDDSNTLTAVPDITQITASDNNSNQEKS

SEQ ID NO: 179207 - protein, 102 aa, Glycine max
  Coding DNA Sequence Number=SeqID_87522
  Subcellular localization annotation: CTP_CleavageSite=34; ConfidenceScore=5.45e-01
MYKMCRPSKEGMQASTSKTWLATTFTRSIPKVIVCSSSSLIFYVNSSLIFCLSRSSFFGMIDIYVREPAKAGPKYCLIVTLAPTTWTWPRCSGHPKATVSTS

SEQ ID NO: 179208 - protein, 64 aa, Glycine max
  Coding DNA Sequence Number=SeqID_87523
MKRTLPWSNNDESSSSHLDSECDSETGGGNSKGFRIWIDAHPNYRTLALVVALAFGCYNYFLHD

SEQ ID NO: 179209 - protein, 28 aa, Glycine max
  Coding DNA Sequence Number=SeqID_87524
MSKRLQEDWARADEKGPRILMNLRGYIM

SEQ ID NO: 179210 - protein, 480 aa, Glycine max
  Coding DNA Sequence Number=SeqID_87525
  Gene Ontology: Mol. function=phosphoinositide phospholipase C activity; Biological process=intracellular signaling cascade
  Homolog annotation: Hit_ID=Q2HTA0; Match level="QueryCoverage=63%, HitCoverage=57%, E-value=5e-32, Identity=31%"; Hit description=IMP dehydrogenase/GMP reductase, related
  Pfam annotation: Domain name=DUF1723; Domain location=93-142; Score =57.5; E_value=4.5e-14; Accession=PF08330.1; Description=Protein of unknown function (DUF1723)
KVLGRALGRQVSGDAEEVLQHRRPTISTHRQLEATIVAKDVDHVNHAAEEKCTELKLASHGRKVEKFGRPTPEIEGIVAATGLSSLITSSLDTGEKGILSAFAERWHKETSSFHLSVGEVTITLDDVALLLHLPITGAFHTFNALDVDQVVEFLFELLEVSTEEAKDETFQCRGAYSATHISVVFLDVFHDLSQSGSYSWGAAALHFPIIASIVVDEDYHERKPCDCQWKFRKTLPMLTYHKRLDRLTLDVVCWIPYGDHHSFRQFELISLISGHIRWGSCIVRYQQERVVRQFDYLQTIPPHPATPSLSVEEIDDRWLQFLEYLAPIAQICSAPRQCAANYMEWFYRISHPFMSLKQPREPPRHPPVVHDDTFIVPNPPQQPVHTAVMLELPAPATADVDMPRHTVDAWQRIAKILEHMINMRMVTAGTESYTLTEHCLILVRSVTEQQHVYVRSRRRRDVRDRGSNMRNMVNNQKAKA

SEQ ID NO: 179211 - protein, 94 aa, Glycine max
  Coding DNA Sequence Number=SeqID_87526
MKPENKLPSTIDISLSAPLCAAWRSLTFMSVSPITKFYIPNRRQFSIDFKNKGYLEETIKERLRSSAPIKAFLSMRWSGGKQRRLMVATGGRGR

SEQ ID NO: 179212 - protein, 53 aa, Glycine max
  Coding DNA Sequence Number=SeqID_87527
MKQPREEMMTKVMNKKLKRSKNNSSESKSISSKSRTSQDLKNQDQDSRLKIQE

SEQ ID NO: 179213 - protein, 57 aa, Glycine max
  Coding DNA Sequence Number=SeqID_87528
RAIDALPPPPEPLGSYTKAGALPTTRGRPAGDQVQSQRKAKVACLWGFYGGWIFELQ

SEQ ID NO: 179214 - protein, 233 aa, Glycine max
  Coding DNA Sequence Number=SeqID_87529
VDPWVLVPITFRGLYVLACRGLHALAFRGLRILIFIPGPPPDIRGRPTVRAHPEREAITHLLCIPGQFHPCRCKKTSADHAHQHDHSYMDMDDGSRPQDDPVDPKKSNRGLGFPALVTGLCQSYRVPIPPARESHPQRHPVDPGEVQQGPGVSSSGYGPLYQSYRVPVPPGKVTDRLARHPVDPKKSNRVLELSSSNYGQAQGETPQQPGDGRQRATDAPPSPLEFTSAHPQK

SEQ ID NO: 179215 - protein, 217 aa, Glycine max
  Coding DNA Sequence Number=SeqID_87530
  Pfam annotation: Domain name=RRM_1; Domain location=39-109; Score =14.7; E_value=0.0065; Accession=PF00076.13; Description=RNA recognition motif. (a.k.a. RRM, RB
MKVMQKSSLAGRQSQNLEIGDNNKHYRLNWRNNADITSFYFTHFPDEANEELLWRHFKNWGDVREVYIAKRLNKHGRRYRFMRFKGVSDAKGLEVRLDNIFINDCKLFVNLPRFDRPVRNTEDRRRLDRARVLVRTPLLPLIRSEVIVRVGELEYRVWIVEETGFEGGSNRKGSSSSDGWSEMITSDDGGEVGDVLDDTNTNFSFSSELPNQKLSPS

SEQ ID NO: 179216 - protein, 53 aa, Glycine max
  Coding DNA Sequence Number=SeqID_87531
FRELTLMSEVIPNSVRLGALSIASELLGEIREGQKSNPFLRTQLEAIASRRDD

SEQ ID NO: 179217 - protein, 312 aa, Glycine max
  Coding DNA Sequence Number=SeqID_87532
  Subcellular localization annotation: CTP_CleavageSite=5; ConfidenceScore=5.09e-01
GLHVLANVGLHALTFTRLHVLAFRGLHVLTFRGLNVLAFRGLTCPHHQRAARSHLQRTTRLHALTSRGLHVLALRGLLALALGLHALTFRGPHVLTFRGLHVLTIRGLHVLTFVRLHALTFRGLHVLANRGLHAFTFRGLHVLTIRGLHALTSRGLHVLASRGLYILALRGLHALTFRGLRVLIFRTSSFLLTVPGPPPDIGGGPTVRAQPEREAITRLLCIPGQDFTRAAAKRRQHSAQRPQYRSPPAEVSVGLCRPDIGIAPTKTPSGPEEVQQGPGVSSSGYGPLDPARKTPSGPEEGQQGLGVASSKY

SEQ ID NO: 179218 - protein, 119 aa, Glycine max
  Coding DNA Sequence Number=SeqID_87533
MSNVQIRPAWEIKENEPFLPYASVELAGIPTHQSTVSVQYHAVDFHEMLFSFVSCVFFTDGACMMTLNIITTEIPICWKVINDTKKHCTTIRKYTFNIGYLEQSTSVLKSMLKVPMLNL

SEQ ID NO: 179219 - protein, 56 aa, Glycine max
  Coding DNA Sequence Number=SeqID_87534
TKFRALLSLSPHSSPSSSKLLSMASYGAKESIDEEDPKAYKLQWSLHHVVSRASSS

SEQ ID NO: 179220 - protein, 70 aa, Glycine max
  Coding DNA Sequence Number=SeqID_87535
MFVIAGNGSEKASCKEIQEGQSGEGPSAAPEYDSHRFQSAEHQQRFEAIKGWSFHRERRIQLRDNEYTDF

SEQ ID NO: 179221 - protein, 259 aa, Glycine max
  Coding DNA Sequence Number=SeqID_87536
  Homolog annotation: Hit_ID=Q84VH5; Match level="QueryCoverage=100%, HitCoverage=37%, E-value=3e-84, Identity=67%"; Hit description =Envelope-like protein
  Subcellular localization annotation: CTP_CleavageSite=21; ConfidenceScore=5.05e-01
MATAPKETSAPGSPSVPSSPSSTETPSHQERPEFTIQPIQMIPGQAPVPEKLVPKRQQGVKTSENPSLATSPREVDLEMDKKIRSIVSSILKDASVPDADKDVPTSSTPNVSVPDANKDVPTSSTPNAEVLPSPSEEESTEEEDQATEETPAPRAPEPAPGDLIDLEEVESDEEPIANKLAPGIAERLQSRKGKTPITRSGRIKTRAQKKSTPITPTTSRWSKVAIPSKKRKEISSSDSDDDVELDVLDIKRAKKSGKK

SEQ ID NO: 179222 - protein, 42 aa, Glycine max
  Coding DNA Sequence Number=SeqID_87537
MAQLNSEFYGVPVTSSKGIRPPTNRAFIKKYCVPRQAQGETP

SEQ ID NO: 179223 - protein, 119 aa, Glycine max
  Coding DNA Sequence Number=SeqID_87538
FPVIDYIVIVATYPSAGGRRVTRGMRVPRKEYARSRQQRLFKENVGKTGKDAIYELLSERFGSCIYARGRVFPFAPTYSSIAMRKSDLRSSFLCVNQVILFYLKGDHFKALDLKNDPFT

SEQ ID NO: 179224 - protein, 214 aa, Glycine max
  Coding DNA Sequence Number=SeqID_87539
  Gene Ontology: Mol. function=2-phosphosulfolactate phosphatase activity; Biological process=coenzyme M biosynthetic process
  Homolog annotation: Hit_ID=UPI000038C79B; Match level="QueryCoverage =96%, HitCoverage=84%, E-value=2e-39, Identity=43%"; Hit description =COG2045: Phosphosulfolactate phosphohydrolase and related enzymes
  Pfam annotation: Domain name=2-ph_phosp; Domain location=8-205; Score= -47.3; E_value=1.3e-05; Accession=PF04029.5; Description=2 -phosphosulpholactate phosphatase
MSFSTCVSMAVNNGACVYPYPWKDASAIEYGLKMGASTASPDRRFSGEGYSLSPASLRNISEGEKLVLPSPNGSAVSFKARDAGIAVLSGCFRNISATANACRSFGRVLVIPCGERWPDGSLRPSIEDYVAAGGIIAAMGRQNCSPEAEAAVAVWQHYQKQNLVLLRECSSAIELMQRGFAGDVDLCLEVDKSSLECRLWGDAYMSALPGQNSF

SEQ ID NO: 179225 - protein, 71 aa, Glycine max
  Coding DNA Sequence Number=SeqID_87540
  Subcellular localization annotation: CTP_CleavageSite=42; ConfidenceScore=5.13e-01
MGASFKEGKRAESPPTFIRGKRRKNRKRRGLRTLSVKGSGVVLTHGKGRFPCSYVFLNCDKEIRPMQFFEN

SEQ ID NO: 179226 - protein, 168 aa, Glycine max
  Coding DNA Sequence Number=SeqID_87541
  Subcellular localization annotation: CTP_CleavageSite=41; ConfidenceScore=5.26e-01
MAESSKKRKGSSSTTAVAADRRHGPSEAPTAPIHPSLSSPRSSTLFSSDDQRLRYLSQFSSRIILDPKYLDIDFFNDETFDCYQVFQNSGLIDFMSLKLPYYPELVKVFYNNLKIQDGIISSEVHGISMMIDQSLFFSLTKLPSQGAPSEAPLLMTGNSIILVMMLVV

SEQ ID NO: 179227 - protein, 111 aa, Glycine max
  Coding DNA Sequence Number=SeqID_87542
MASKKRKTPSTPTQARYDRSKFTSQEAWERNVVVYYTKFDEFKEELERRHWDEKLTDFADSSINIATVKEFYANLYDPEDKSPKLVRVKGHLEKFDDDTLNTFLKTSVILE

SEQ ID NO: 179228 - protein, 21 aa, Glycine max
  Coding DNA Sequence Number=SeqID_87543
MLAGYRRVSPHATGLLGHGNK

SEQ ID NO: 179229 - protein, 197 aa, Glycine max
  Coding DNA Sequence Number=SeqID_87544
  Gene Ontology: Mol. function=allantoicase activity
  Homolog annotation: Hit_ID=A6T925; Match level="QueryCoverage=72%, HitCoverage=86%, E-value=2e-22, Identity=44%"; Hit description =Putative uncharacterized protein
  Pfam annotation: Domain name=OHCU_decarbox; Domain location=39-194; Score=156.2; E_value=8.7e-44; Accession=PF09349.1; Description=OHCU decarboxylase
MAERWPVGMLFVRNHRGISHHPAESVQVADVALGVQAYLQAASTAQAQTAIAHCVAIPAWQQALVAARPFASLTALYTTAQQLALAWQGDALQQALSAHPRIGEKAQGAGKEAALSQQEQAAMQQANGALQLAMLAGNERYEQRFGRVFLIRAKGRSGEQMLAELQRRLNNDEETEQQEALAQLREITLLRLKESIT

SEQ ID NO: 179230 - protein, 241 aa, Glycine max
  Coding DNA Sequence Number=SeqID_87545
  Gene Ontology: Mol. function=acid phosphatase activity; Cellular component=cytoplasm; Biological process=keratinization
  Homolog annotation: Hit_ID=UPI00006A17C9; Match level="QueryCoverage =98%, HitCoverage=99%, E-value=5e-16, Identity=32%"; Hit description =UPI00006A17C9 related cluster
  Pfam annotation: Domain name=Cornifin; Domain location=1-239; Score= -41.8; E_value=0.027; Accession=PF02389.6; Description=Cornifin (SPRR) family
MSSPSEDYTSLPSEEYTFSPSEDYTSLPLEDYTSSPSEDYTSLPSEAHMPSPSEDHTSSPSEDYTSSPSEGCTPSPAEGYTSSTSEGCTPSPSEDYTSLPSEDYTSSPSEGCTPSPSKDYTFSPSEDYTSSSLEGYMSSPSEGCTPSPSEGYTSSPSKGDTSSTSEDCTGMHALAFKGLLVLIFIGLHALAFRGLHALAFRGLHALAFKGRHVLNFRGLHVTSLPSKGCTPSPSKGCTPSP

SEQ ID NO: 179231 - protein, 141 aa, Glycine max
  Coding DNA Sequence Number=SeqID_87546
MSWTLYPTSWIQHNLLTDLCVQYFRAGCPGHSNLLNSVKLSTNKEVMIFHEIRRPNSLKTVPSGFANCQNLPFGGRATRDSWVRLPRKENARSRHQRLFEENVGKTKMCGLRTLIVKGLGLFLCTGKILAPHASVTRDDSL

SEQ ID NO: 179232 - protein, 166 aa, Glycine max
  Coding DNA Sequence Number=SeqID_87547
MARRSAPARSAAATACAWRLSGLVAHQLVDGVNHVLYGAHRAEGFWLDLTPGAFLQMHHHVNRINTVEFEIFIQASVRADLVRINFEQRSLLLFNKSGQRGHGKKVRPQRFALGGELHAEAVFHRQSQLQRIDRVEPQPFAKQRCIAIDIIRTDIFQIQRVDHHGF

SEQ ID NO: 179233 - protein, 297 aa, Glycine max
  Coding DNA Sequence Number=SeqID_87548
  Homolog annotation: Hit_ID=Q5GVN5; Match level="QueryCoverage=95%, HitCoverage=51%, E-value=9e-32, Identity=34%"; Hit description =Putative uncharacterized protein
MGSPFGLLAQPAAVAQSDYVAPGASIVISQHVGLQRGHGLQLTAALRAEQAAVRLLAAKQRAVLAEAIHHIGIEQRQLIAQQAGVIFFAPRLEGAENGGANQPAKILAHAKQHDKTHQIFRLSHHAADAKQHRWPKEKSTAETEQKLAEVEIAGARYRAGLRIHQRGDNHYGQRDHDWPAQMVGFDGQRAGNHAADHARNDRQRQPAHLIVEQAQLLQKAHRTGILLGQHDAHHDHHDAEPHDHAIAQPAGVNQRVSAVMLQHHRRDNQHQRQRQTDTKPGCAEPPLNAPERQHAAQ

SEQ ID NO: 179234 - protein, 254 aa, Glycine max
  Coding DNA Sequence Number=SeqID_87549
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=100%, HitCoverage=54%, E-value=1e-124, Identity=87%"; Hit description=ATP synthase subunit alpha
  Pfam annotation: Domain name=ATP-synt_ab; Domain location=149-254; Score=-3.0; E_value=8.4e-08; Accession=PF00006.16; Description=ATP synthase alphabeta family, nucleotide-binding domain
  Pfam annotation: Domain name=ATP-synt_ab_N; Domain location=25-93; Score=77.3; E_value=5.2e-20; Accession=PF02874.14; Description=ATP synthase alphabeta family, beta-barrel domain
  Pfam annotation: Domain name=HAS-barrel; Domain location=25-91; Score= 35.9; E_value=1.4e-07; Accession=PF09378.1; Description=HAS barrel domain
  Pfam module annotation: Pfam domain module=ATP-synt_ab::ATP-synt_ab _N::HAS-barrel; Domain location=149-254::25-93::25-91
MVTIRADEISKIIRERIEQYNTEVKIVNTGTVLQVGDGIARIYGLDEVMAGELVEFEEGTIGIALNLESKNVGVVLMGDGLMIQEGSSVKATGRIAQIPVSEAYLGRVINALAKPIDGRGEISASESRLIESPAPGIISRRSVYEPLQTGLIAIDSMIPIGRGQRELIIGDRQTAIGQKASSVAQVVNTLQERGAMEYTIVVAETADSPATLQYLAPYTGAALAEYSMYRERHTLIIYDDLSKQAQAYRQMSLL

SEQ ID NO: 179235 - protein, 116 aa, Glycine max
  Coding DNA Sequence Number=SeqID_87550
MTETVCTDNRLGISARHLTSRVRMIETVCTDNRLGISVRYLTSRVRMTETVCTDNRLGISVRHLTSRVRMTENAEDDVTIAEGGVVDKSEAFAPTYPSFVVRNSDLHSSFFCDVRD

SEQ ID NO: 179236 - protein, 145 aa, Glycine max
  Coding DNA Sequence Number=SeqID_87551
MALTKLSAKRSRRDAATEGTSAAPEFDSHRFRNAKHQQRFDAIKGWSFHRERRVQLRDDEYTDFQEQIARRHWTSLVTPMAKFDPNIVLEIYANAWPTEGGVRDMRSWLRGFRSDHCREAGADHAHQHDHLDPDVDDIAAQQCLA

SEQ ID NO: 179237 - protein, 267 aa, Glycine max
  Coding DNA Sequence Number=SeqID_87552
  Homolog annotation: Hit_ID=A8XZZ5; Match level="QueryCoverage=39%, HitCoverage=57%, E-value=1e-12, Identity=28%"; Hit description =Putative uncharacterized protein
  Subcellular localization annotation: CTP_CleavageSite=62; ConfidenceScore=5.70e-01
TLAFRGLLPSPSKDYTSSPSKRAARPCLQRTTRPRLRGLHALAYQRTIRPLLQRATRTLAFRTDTSSPSERQHALAFRGLHVLTIRRLHALAFKGLHVLNFRGLPALAFRGATCPRLQRTTPSIRGLLVPTLRGLHALAFRRLRPHLQRTTRPRLQRTTHPNLHRVTRPDLWRTTSPRLQRAARPNLQKATGPHLQRATCPHLQRTTRPRLQRATRPCLQRTTSPRLQRATCPSLQRIKHPHLQRAAHSRLQWPTRPHLERAKCPRL

SEQ ID NO: 179238 - protein, 115 aa, Glycine max
  Coding DNA Sequence Number=SeqID_87553
  Homolog annotation: Hit_ID=P03851; Match level="QueryCoverage=73%, HitCoverage=100%, E-value=4e-44, Identity=98%"; Hit description =Uncharacterized 9.4 kDa protein
MAALLAFSIGSAPLTSITKIDAQVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 179239 - protein, 127 aa, Glycine max
  Coding DNA Sequence Number=SeqID_87554
IQRTNRLRILCLNTLEGTSIVVQVKGTSTWVVVTENKRGYISCGSVQVEDTSTWLFNENKGGYIPCGSLLVKVFTRLKEISRTSGCMGTGCRHGLLPNQYKILVFVFFFPTLFNFLCALLIIAFTFG

SEQ ID NO: 179240 - protein, 613 aa, Glycine max
  Coding DNA Sequence Number=SeqID_87555
  Gene Ontology: Mol. function=nucleic acid binding
  Homolog annotation: Hit_ID=A7Q2V2; Match level="QueryCoverage=65%, HitCoverage=49%, E-value=1e-119, Identity=54%"; Hit description =Chromosome chr12 scaffold_47, whole genome shotgun sequence
  Pfam annotation: Domain name=RRM_1; Domain location=272-338; Score =31.1; E_value=3.9e-06; Accession=PF00076.13; Description=RNA recognition motif. (a.k.a. RRM, RB
MVEWRGKFFANRRRQSVKGGLLWQRRRPQWLVYMAEFWPSTMAPVTVGQLHLSLLDSQSQKFLQFLSNKDHDLGLENPAYRAWELLDQPNSSTSEKNIERFLLLRINAIAAGLKSIAYETGLALAMLVLAKRSLMYLPDLDYFSVLSKPLFGREEFAPKLELGLGLLTKGEITQTPLEVEATLFSGCKGVPVFPASVKTAVKELKSSGFSKHQDKPSAMQRDEDCSWDERNSALRGSPFSQREFRGHHGSPELHYSDKSKLSDKNPEPSEVLWIGFPAQLKVDESILRKAFSPFGEIVKITTFPGRSYAFVRFRSLTSACRARDDLKGKLFGNPRVHICFAKSETGSSNSERRSFNGPRSPIYKSSGRDGSSENLRQDRSFNADRNIGSPNHFGIWDSDPYDQRGSSWTGGTNTFEQRKVGEKGRTLGVSQEIYEHMNSPSRERHHVGNVPQRFSQKGEFFEDPRALPDFSYLHEAKRMKAGSPPLEREIPEYPFTEYERQRRVFPRLSDLPPHEPFDKGFDAGNFTYDQTLDHPPNSPLPRLDRHEGWKPYDSFQMGPSALQSTYVEKKGFTPEQDSSSLTEWKWEGTIAKGGTPVCRARCFPVGKVLDMML

SEQ ID NO: 179241 - protein, 67 aa, Glycine max
  Coding DNA Sequence Number=SeqID_87556
MDVHIITRGTPKVVARPSELKLNPKAMSLPRRVGFITMKLFGGPSEPEASLDLVESLVIEPSSSMNH

SEQ ID NO: 179242 - protein, 498 aa, Glycine max
  Coding DNA Sequence Number=SeqID_87557
  Gene Ontology: Mol. function=protein kinase activity; Biological process=protein amino acid phosphorylation
  Homolog annotation: Hit_ID=Q9C8V4; Match level="QueryCoverage=78%, HitCoverage=63%, E-value=4e-45, Identity=30%"; Hit description =Putative uncharacterized protein T22A15.15
  Pfam annotation: Domain name=DUF889; Domain location=285-466; Score =42.2; E_value=2.4e-14; Accession=PF05970.5; Description=Eukaryotic protein of unknown function (DUF889)
MVPYNPYLLLKYQAYLNIEWCNQSMSINLLENIFIPDSQRSPAVERFYFHFPGENSVIFEDRDDINALLSKPTVKESIFTSWLQANSIFQQAKGLTYLQFITKFTYVAKKDVGSHVNEAIQLEGLTPSTGELYYLRMMLVVVKGPTTYEQIRTVKGRLYSTFREACFEKDKKHTRYIYAEQNYDKAQLQNDFETYFASLTGTGKTFIWKTLAFAFYSKGDIVLIVSSSGIASLLLPNGRTTYSKFAIHMPTLENSTYNIHQDKTLNDIMCMSNSDNVPFGGKVVVFGGYFRKILHVIPKGSRSYIVHATINASYLPTYLTLTNAQEIKSFSQWLINVGDEKLGKGDDERYEIEFSPNILITNFIDPIEAIVRRIYPNIQKKYKDEEFLKSRAATNEVVYQINDYILNIIPGEEKEYFSCDSIDMTDVATTECYEAVVATCPSAGGRRETRGRRVPRKEYARSRHQRLFEENVGKTGKDAIYELLSERFGSCIYARGRY

SEQ ID NO: 179243 - protein, 144 aa, Glycine max
  Coding DNA Sequence Number=SeqID_87558
  Gene Ontology: Mol. function=peptidase activity; Cellular component =anchored to membrane; Biological process=lipid transport
  Homolog annotation: Hit_ID=Q6AVM8; Match level="QueryCoverage=80%, HitCoverage=57%, E-value=2e-29, Identity=51%"; Hit description =Putative uncharacterized protein OJ1119_H02.15
  Pfam annotation: Domain name=Tryp_alpha_amyl; Domain location=37-115; Score=43.1; E_value=9.6e-10; Accession=PF00234.13; Description =Protease inhibitorseed storageLTP f
MATIVTLVLALACCGMSAPTSVPKTTAAAPAPESNGCLMALANMSDCLTYVEDGSKLSKPDKGCCPELAGLVDSNPICLCEMLGKPDSIGIKIDLNKALKLPSVCGVTTPPVSTCSGIAPGAFSPSNADAANPASSPNSASSPA

SEQ ID NO: 179244 - protein, 140 aa, Glycine max
  Coding DNA Sequence Number=SeqID_87559
MKQQRLPPFLQPPSQPPTTIVQPHHEVLAPMVLASKATITIGLMHAPLPLPPKPLSCFIVKVVSRIFPLNLMMKYVQFQWAKRASTAKRNFSMLSATEEFGRALISRSRAKCEINALSAAVVFCQAQRMTSAMLKSTYAH

SEQ ID NO: 179245 - protein, 125 aa, Glycine max
  Coding DNA Sequence Number=SeqID_87560
MTRGNPGDLQPFDHEIDRTFHRLVRQSVHLDYPEHFVPFEHPEHSVTGESEHSVIGNFEHPDFEHSDFEHSENMAQPPPCERTLREMAAPDFTYESLCIQYPDEDVPYVLKTGLIPLLPKFHGLA

SEQ ID NO: 179246 - protein, 73 aa, Glycine max
  Coding DNA Sequence Number=SeqID_87561
MESTSVQDVAVVVTITDLALLLKGMMDNIQKSMILNQMLKCLLQPTLRREGDVRLTSVSSKKGKCTESPPTFI

SEQ ID NO: 179247 - protein, 308 aa, Glycine max
  Coding DNA Sequence Number=SeqID_87562
  Gene Ontology: Mol. function=ribonucleoside-diphosphate reductase activity; Cellular component=ribonucleoside-diphosphate reductase complex; Biological process=DNA replication
  Homolog annotation: Hit_ID=P39452; Match level="QueryCoverage=100%, HitCoverage=43%, E-value=1e-147, Identity=84%"; Hit description =Ribonucleoside-diphosphate reductase 2 subunit alpha
  Pfam annotation: Domain name=RNR_N; Domain location=1-76; Score =103.3; E_value=7.2e-28; Accession=PF08343.1; Description =Ribonucleotide reductase N-terminal
  Pfam annotation: Domain name=Ribonuc_red_lgC; Domain location=154 -308; Score=-271.0; E_value=0.0003; Accession=PF02867.6; Description =Ribonucleotide reductase, barrel doma
  Pfam annotation: Domain name=Ribonuc_red_lgN; Domain location=77-151; Score=95.2; E_value=2.1e-25; Accession=PF00317.12; Description =Ribonucleotide reductase, all-alpha d
  Pfam module annotation: Pfam domain module=RNR_N::Ribonuc_red _lgC::Ribonuc_red_lgN; Domain location=1-76::154-308::77-151
MLNLYDSNGRIPLEKDQQAVEAFIHNHVRPNSVPFAGLEEKLQWLSDEGYYDPAVLARYERRFVLALFAHAHQHGFRFRTFLGAWKFYTSYALRTFDGKRYLEHFADRACMVALTLAQGDETLARQLADEILAGRFQPATPTFLNAGKQQRGELVSCFLLRIEDNMESIGRAVNSALQLSKRGGGVAFLLSNLREAGAPIKRIENQSSGVVPVMKMLEDAFSYANQLGARQGAGAVYLHAHHPDILRFLDTKRENADEKIRIKTLSLGVVIPDITFQLAKEDAQMALFSPYDVERLYGKAFGDIAVSE

SEQ ID NO: 179248 - protein, 264 aa, Glycine max
  Coding DNA Sequence Number=SeqID_87563
DGEEYTAYTRYLSTHPDPDTIAATLCTPGGRFVLNADGLPWKLLRKDMTTLAQTWSVLSYYDLAPTSHTSDVNLDRARLIYGLVSRMDMDVDSFISQQISQIAQSSTSRLGFPALITALCDIQGVVSDTLIFESLSPAINLAYVKKNCWNPADPSITFPGPRRTRTRASASASEAPLPTQSPSQPSQRPRHPPASTSASMDMHGQMLRSLHVGQQLIMENMHRLGEAPSGAAEDPAVDEDLIADLATADWGPWADLGGGSIKKK

SEQ ID NO: 179249 - protein, 163 aa, Glycine max
  Coding DNA Sequence Number=SeqID_87564
  Gene Ontology: Mol. function=helicase activity; Cellular component =chromatin; Biological process=protein amino acid phosphorylation
  Homolog annotation: Hit_ID=Q2A9E0; Match level="QueryCoverage=87%, HitCoverage=9%, E-value=1e-31, Identity=47%"; Hit description =Putative uncharacterized protein
IRLTVKETIHLCLTEIENMLQANRRSLRDFPSMPYPIGYARNQQHNNLIHNEMAYDKEMLAEQYNTSYQLLTDEQKTIVDTIMRVVNTQLAAVYFLYGYGGTGKKFVWTTLSSAIRSNGGIVYTVASSGIVSLLLPGGRTAHSKICYTSPCNTKYNMQYSSRQ

SEQ ID NO: 179250 - protein, 243 aa, Glycine max
  Coding DNA Sequence Number=SeqID_87565
MDFFSDESFECIQAFQNSNLIPFMSLKLPVYSELVKAFYSNLEIQESTLISEVYGIKMVIDQSLFYDLTQLSSKGVPFEGTLDDDWIFDFSVHDACRLVCTNKADMTGRLLAGSLALESQILHYLIVHILLPRSSNLAQIFLDRCCYGCLLCLRKKRDGSWVKKGAQPNDNKGHLPVEGDYSLLQSILDRFDGLQTYVGERFDSLERQVDTRFKEINSRTAKVEEDVTIIRDYFDLPPPPPSV

SEQ ID NO: 179251 - protein, 60 aa, Glycine max
  Coding DNA Sequence Number=SeqID_87566
MAKGSGMTKFCLRMSSGPPPLDDKRATSSWDMATESGVVDKSEAFAPTYPPMRNSDLRSS

SEQ ID NO: 179252 - protein, 51 aa, Glycine max
  Coding DNA Sequence Number=SeqID_87567
MDPKRIKVILEWPTPPSVEEKIHEFQEPLDLRSNPFQGGGNDAMLPPKGIG

SEQ ID NO: 179253 - protein, 153 aa, Glycine max
  Coding DNA Sequence Number=SeqID_87568
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPQTKKDGMMRT

SEQ ID NO: 179254 - protein, 165 aa, Glycine max
  Coding DNA Sequence Number=SeqID_87569
MPISICGSASWDRAHKTPNGPGEVQQGPGVSSSGYESLSVLPGARPPSKVMPSCIGIAPARHPVDPKKSNRVLGFPALITGLCQFYGVPIAPSKVIRPPTNRASIKKYCASRQPQGKTPQQPGDGRQQAIDAPPPPLEPLSSSTKAGALPTTHGRPAGDQVQSQR

SEQ ID NO: 179255 - protein, 65 aa, Glycine max
  Coding DNA Sequence Number=SeqID_87570
MDKSLKVGEDEWRERERRSTKFCTSNEPTNPRSNQRFTLSVLRCPKIQVLKNPTLQGYPPYTMEP

SEQ ID NO: 179256 - protein, 302 aa, Glycine max
  Coding DNA Sequence Number=SeqID_87571
  Gene Ontology: Mol. function=hydrolase activity; Biological process =metabolic process
  Homolog annotation: Hit_ID=Q48H40; Match level="QueryCoverage=89%, HitCoverage=87%, E-value=3e-85, Identity=58%"; Hit description =Hydrolase, alpha/beta fold family
  Pfam annotation: Domain name=Abhydrolase_1; Domain location=81-294; Score=60.5; E_value=5.9e-15; Accession=PF00561.11; Description =alphabeta hydrolase fold
MPGQPLFRQFLRLLAMIALLSASAAALADDRQYTAVAPDGVTLAIQESGDPAGPAIVFIHGLLGSRLSWEAQLSSPLLQRYRLIAYDLRGHGQSGKPTAPQAYTDGRRWADDLAAVIAASGARQPVLVGWSLGAAVTTNYLAAYGDGDVAGAVYVGGVIELDASQIAPHPEVYRGMASTDLKTHLDAERAFLALCFETQPDTATFERLLANAALASPGMQAAVPRMTIAARQGLGAMRKPLWLIYGARDALVRAEPSLERARQLNPRVRGSVYAASGHAPFVEEAERFNRDLAAFVDAAAGR

SEQ ID NO: 179257 - protein, 69 aa, Glycine max
  Coding DNA Sequence Number=SeqID_87572
MKMLLIPHDVSSIGACRPKMILEDEWQWCVMQSYPARALDRRLQVDWARDPREGPRVLMSLRVDFELMG

SEQ ID NO: 179258 - protein, 119 aa, Glycine max
  Coding DNA Sequence Number=SeqID_87573
MERKTRRKEKGRERVEISEDERELIRKEERRKILQELRKEKHVSYSSHDSCKSLSEEFSDYYGGRHRSSHPRPHFHRREKERKPKEANINLLYFHGKDNVEAYLGWEMKVEQLFAKPQR

SEQ ID NO: 179259 - protein, 104 aa, Glycine max
  Coding DNA Sequence Number=SeqID_87574
MTEKEMITILVDTLPVFYYEKNGKFDHPAWTNEKTGANEEDEDEEGTHVEAVIPTWPNFPPAQQCHYSANISSSHYPPPNHPQKSSLKSTTKPICRTSNNEHHL

SEQ ID NO: 179260 - protein, 145 aa, Glycine max
  Coding DNA Sequence Number=SeqID_87575
IDGDPVLRETRIWATWAYVSSVGGGQQGMVGLCAICGCGKLLCTIARPPPSTTCDGVVPGDMSRGSGDLGDVSCESCVIYGIWPLVIDYQGLENEVVEASGNRLPVCVIDYTEEWVTGNRLPGMKSLELPLLLACSGYETNCVAA

SEQ ID NO: 179261 - protein, 328 aa, Glycine max
  Coding DNA Sequence Number=SeqID_87576
ASRKRKSTTSRPQPDYDTKRFTSEEAWNRYADNVLGWNILPKRNVKVYIMEFDEFKRELERRNLHNRLTNLADSSIDVAVVKEFYENLYDPEDNSPKQVRVRGHLIKFDVDTLNTFLETPVVLERRETIPTYSRFCRLRMDPQEIATRLCIPGTRKARARAAEILSSSTPQDPPVPTSAPPPAPTHQGPSTDLIMAMLKSLYQGRYLLMQNFQNLAQHHSFISLEEFTRQVACPGAQPSPIGGSETVPPEPFIYEADPGTTLEETQEVATPEITPQQAVEPSTPVLDLSSPQPSQKPSTPVLGLSSPTTSPAGTLVLHLTDEEEDIMD

SEQ ID NO: 179262 - protein, 235 aa, Glycine max
  Coding DNA Sequence Number=SeqID_87577
  Gene Ontology: Mol. function=oxidoreductase activity; Cellular component=integral to membrane; Biological process=potassium ion transport
  Homolog annotation: Hit_ID=A7MP50; Match level="QueryCoverage=39%, HitCoverage=28%, E-value=2e-19, Identity=58%"; Hit description =Putative uncharacterized protein
GIPQDSRIASGSKFLNENQLTPEKMAKVQQLQALAQQRGQKLAQMALRWVLRDTRVTSVLIGASKTAQIDDAVDMLSQPELTADEIAAIEQILTKSQGVSGPIWHTSATLKPVALPSIWPLASRCISAIAIVAATTGTAVAGVNRAGGTIAISTTIIAGGVTKSGNAIEPGSVNVSAAGTSANVANTGVTITDTIGMTATTIITIKKIPAQTQPGFFYSVICLPAERFAHQQIDI

SEQ ID NO: 179263 - protein, 89 aa, Glycine max
  Coding DNA Sequence Number=SeqID_87578
MWGQVQVLGGQLDGRGGSTDYKVEEAIIHNEIDMAAAFLREIKDHRIQPQHHDQWVWKADPSGQYTAKSSYDVLRGEAIHEQQDGAFEE

SEQ ID NO: 179264 - protein, 34 aa, Glycine max
  Coding DNA Sequence Number=SeqID_87579
MERRLPPSLPRLRNNACFDFQNVAMLYGLHNNGC

SEQ ID NO: 179265 - protein, 25 aa, Glycine max
  Coding DNA Sequence Number=SeqID_87580
MAMNALSVSCCAKFPDELAKPALSC

SEQ ID NO: 179266 - protein, 171 aa, Glycine max
  Coding DNA Sequence Number=SeqID_87581
MVIKQQQQSITSLNIHMQCAGGACGVRRQQGASLTRILQGNLNDRDSSAGSKGSARSKNYKAQTGRQQPQPNIVGCDPCIHASQSFLSPFSSGGTGTLETSLSSPSSSLFLEVLTLEVQQQAQHIDFFFPRQKRKNTINQKRDNHTKKDNNKRPKLQVEKLRIVNYTMFHE

SEQ ID NO: 179267 - protein, 77 aa, Glycine max
  Coding DNA Sequence Number=SeqID_87582
MGDGVRASRWKCWWVTVTWTIWQQRNKMIFSNESFHSNKLIDEAAFLLWTWLRHLEKDFSIHFNQWSSNLRARILYQ

SEQ ID NO: 179268 - protein, 159 aa, Glycine max
  Coding DNA Sequence Number=SeqID_87583
MADMDSGEPDETVGSKRARFRQGEGGAWWSRAGVWRARRWRVGKLLAQRLVGLGCAPRGAQNPVVTKSSSDSEAISAQVFLANFGTLVRPISSKARRVYIDQAYSATVDDPVWVGDPEDDVVTFLVIGSGRASRTSFPFVLDLPPLPEELDTLGGIGNF

SEQ ID NO: 179269 - protein, 91 aa, Glycine max
  Coding DNA Sequence Number=SeqID_87584
  Gene Ontology: Mol. function=DNA topoisomerase (ATP-hydrolyzing) activity; Cellular component=mitochondrion; Biological process=DNA unwinding during replication
  Homolog annotation: Hit_ID=A7QAF2; Match level="QueryCoverage=45%, HitCoverage=7%, E-value=2e-13, Identity=92%"; Hit description =Chromosome undetermined scaffold_71, whole genome shotgun sequence
MGLKELLQAFLDFRCSVVERRARFKLSQAQERRHIVEVLIVQFGAGSQTGTVITKPERDPKKIIVQECSLDSYTSSSASTKSPTPETICLM

SEQ ID NO: 179270 - protein, 236 aa, Glycine max
  Coding DNA Sequence Number=SeqID_87585
MGYAGVRELSWRWATVDGGFMRALWMWKTCCAPSPDRHLVPHVMVVPGDMSRGSGDLGDVRRAPGSQQIKGTKTTKQGGLWWLASYEFCVIYGLWPLVIDYQGLENEVVEASGNRLPVCVINYTEEWGTGNRLPIVMAAQLIHDRVEMECLEGAWGTLEGNTRCRFRGTIRFTATSLVHPDEPARTLQRTVEWILPTPTPYRLVARGRWRSASASEADSTEDSGPGEMVYPFVLYG

SEQ ID NO: 179271 - protein, 373 aa, Glycine max
  Coding DNA Sequence Number=SeqID_87586
  Homolog annotation: Hit_ID=A2Q4W6; Match level="QueryCoverage=79%, HitCoverage=44%, E-value=4e-10, Identity=21%"; Hit description=RNA -binding region RNP-1
  Pfam annotation: Domain name=RRM_1; Domain location=66-136; Score =37.2; E_value=5.8e-08; Accession=PF00076.13; Description=RNA recognition motif. (a.k.a. RRM, RB
MREGETERDSERDSGWERVRSRRERRENERTRGMKGPCLSIVRERKGGQQRRMRVNWRDHRNISSFYFTRFPEDATEDELWKIFRRAGDVREVFISNKRNRNGRRYGFVRFIGVDNVQQLERRLDNIVLGGLKLYVNIPKYERGRGRVQPQSTGGRDHTRHVEQGRRETYQAQKHTAMPGQIRGSFADVVARREPRIQQRRTSIVQNAKTNTSRSKVHLDSPMTAPKWLQDAWVGMLKNLALLDRVEENMLWDWGLDVVPKYIGDNMVLLPSLTEDKAKQMVEDGTAGREVMFYLVERWNRKMRAGSRLTWVQCWGVPLVAWDSTHIREIVTAIGEVVEVDEEMEDLRKMDRARLLRKVEAVPIGAMPAERDA

SEQ ID NO: 179272 - protein, 206 aa, Glycine max
  Coding DNA Sequence Number=SeqID_87587
MTSRDQVWSFCTHDTRRYLTVIRTPLPFRHSRVRWHAEPSLVILHPGMIRGDTLRLFAPFCHPEAAGPMTSRDQVWSFCTLVSSRGGGPDDTRRYLTVIRTLLSSRGGGPDDKQRPKAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 179273 - protein, 144 aa, Glycine max
  Coding DNA Sequence Number=SeqID_87588
MAPRKLSAKRSRKDAATEGTSAAPEFDSHRFRSAEHQQRFEAIKGWSFHRERRVQLRDDEYTDFQEEIARRRWTSLVTPMAKFDPDVVLEFYANAWPTEEGVRDIRSWERGQWIPFDADALGQFLGDPLVLEEGQECEYSQRRN

SEQ ID NO: 179274 - protein, 170 aa, Glycine max
  Coding DNA Sequence Number=SeqID_87589
MAEIGVVAQQAQRHHATDDHRSQQGAREAMLETTAELLDGEDDAGQRRVERRRDTRRTTGQQEVRELAGILETEPAAEQIHQACAYVHGGPLAPDRCAPQQRQRGQQQLAGRNRWGKVGFPERLIGLVQRSDDLRNAAAPRGLQHAGSEPRPAARRCPASAAGPTTASAT

SEQ ID NO: 179275 - protein, 531 aa, Glycine max
  Coding DNA Sequence Number=SeqID_87590
MQDRAAAGRDRVDAHHRCAHAHAGHQGLEFAFEFAGVVRHVGGGAAHVEADDLVKTRLFAGAHHADDAAGRAGQDGILAAEAVRVGQAAARLHEHQADARQLAGHLVDVALEDGRQVGIDHRGIAARDVLDQRADLVRSRYLGETDLARDAGGALLVAGGVPGVHEDDGDGADAAVVRRLHVAAQRRFVQVADHFAIGGDALVGLDHGLVEHFRQQHVAVEQARAVLVGDAQAVAEPAGGDQQRAFALAFEQRVGGDRGAHLDAFDLLGRHRLAGRDAQQLADARHRRVAVLLGVLRQHLRGGGGAVGAARHDVGEGAPTINPELPLHIHPRVQEAATALPAAACGWWYGKDPAYRLQGGRGARGLVVQAGQGAQRVRQLAAEFQAAPARRVEAGGEALLADFAVALDDRRALGRDAVEHFLAGALALDHAQAVELFQRVVDDVRVLDIQREADVGQLLGALAVEHVVEHHDVGGRQVGQARRRHAAHGPAIEGVAGDHQAEFDFGQVRRAAAGQVGRRSDQRGGHKGRAT

SEQ ID NO: 179276 - protein, 109 aa, Glycine max
  Coding DNA Sequence Number=SeqID_87591
MITHLKLQVFPPLVLIAFLPTLSSPHPLLDQLDLRSDDDKKLKSQDHFMITKMMTFKNKFKIESRTLQRSRGNLISRIKNQDSRFKNNQDQESRLKDSRIKRRLNQDKY

SEQ ID NO: 179277 - protein, 306 aa, Glycine max
  Coding DNA Sequence Number=SeqID_87592
  Gene Ontology: Mol. function=motor activity; Cellular component=cell projection
  Homolog annotation: Hit_ID=UPI00016621D1; Match level="QueryCoverage =98%, HitCoverage=42%, E-value=2e-17, Identity=31%"; Hit description =UPI00016621D1 related cluster
FPTSNVQSCEFGITGNLDESISCFPKRVDPWVLVPISFRGLHALTFRGLHVLIIRGWHALTFRGLHVLAIRGLHALTFRRLHVLTIKGLHTLTFRGLHILTFKGLHALTFKGLHALTFRGLHVLILRGLHTLALRGMLALAFRGLHVIAFKVLDVLTFRGLHILTFRGLHILAIRGLHTLTFRGLHVLAIRGLHVLIVRGLHALTSRGLLALAFRGLHVLAFRGLHLLTFRGLHLLAIRELHGLTFRGLHALTFRGLHVLTFRGLHILTFRGLHVLTFRGLLVLTFKGLHLLAIKGLHALTFKGLH

SEQ ID NO: 179278 - protein, 88 aa, Glycine max
  Coding DNA Sequence Number=SeqID_87593
MEIEIPPKAAVFTWRLLKDRLPTRANLIRGNVIIQDTVCPLCGLEQEEDSRPVVGVDDIGTSSGNSPSFSSGSFSCGGFLEGSTRGAL

SEQ ID NO: 179279 - protein, 145 aa, Glycine max
  Coding DNA Sequence Number=SeqID_87594
  Homolog annotation: Hit_ID=Q2HTA0; Match level="QueryCoverage=79%, HitCoverage=18%, E-value=3e-13, Identity=39%"; Hit description=IMP dehydrogenase/GMP reductase, related
  Pfam annotation: Domain name=DUF1723; Domain location=61-110; Score =58.2; E_value=2.8e-14; Accession=PF08330.1; Description=Protein of unknown function (DUF1723)
MVLRGHLLIMLRDSLVGHERPELKLVSHGRKVDKFGRSAPEIEGLVAATELSPLIGCSVVTGDPGLISAFVEKWHKETSTFHLVVGELTITLDDMAALLHLPITGALHSFEPLLVDEAIFLLMELLEVSGEKARAETVRAHVAYV

SEQ ID NO: 179280 - protein, 136 aa, Glycine max
  Coding DNA Sequence Number=SeqID_87595
  Subcellular localization annotation: CTP_CleavageSite=25; ConfidenceScore=5.22e-01
MPSTICKGRVHKTPSGPGVVQQGPRVASSGYGSLSVLQGACPSQQGIAPARHPVDPEKSSRVLGFPALITGFCQFYRVPVTPNKVIRPPLTGLSSRSIAPPGRHRARHHSSLRMAGSGQQTHCRHLKSTSAHSQKG

SEQ ID NO: 179281 - protein, 50 aa, Glycine max
  Coding DNA Sequence Number=SeqID_87596
MSSVFYALQDYNVFSHLHSKTTMSSVIYINKTTMSLTVMLPGPLDRPQFQ

SEQ ID NO: 179282 - protein, 76 aa, Glycine max
  Coding DNA Sequence Number=SeqID_87597
MAVQLIHDHVVMECLEVEPVQVIEVSSSEEDLEEDPEELPPKPAADVPDFPKDDEDPLPDVDSPKDIMLASEADST

SEQ ID NO: 179283 - protein, 77 aa, Glycine max
  Coding DNA Sequence Number=SeqID_87598
MARACSPINAKTCSPLKVRACSPTKARLCIPLKVKTCSPLKIDCPFERGDNSCKLILSFANLSGNSLRVYVLFDLAT

SEQ ID NO: 179284 - protein, 113 aa, Glycine max
  Coding DNA Sequence Number=SeqID_87599
MMEIRKITTVNFLKKEEEHLLIVVKGAKSNGVIMLQAPIANYARKIIMIQMIVGTNAKSAKGTYTMKKIVFTDKKKKQIFWKIKNPLIILCTPLYLLKNQGMYGMLIVVVQTT

SEQ ID NO: 179285 - protein, 71 aa, Glycine max
  Coding DNA Sequence Number=SeqID_87600
MSMRSWGLDLNQEGEALTDSSECRPWGSPGLSATLSLCRSHMVGAFSQNIVTLTGLPMILLSESDLTNPLC

SEQ ID NO: 179286 - protein, 89 aa, Glycine max
  Coding DNA Sequence Number=SeqID_87601
MTRLVSRGHLRVGPLRFLEARLMSQVYESEKDHVEGRGLDSRRSLVIGVTEKEFQLDTQLDIENHMRDIFFSIFQQVSGTKLILRGVEL

SEQ ID NO: 179287 - protein, 222 aa, Glycine max
  Coding DNA Sequence Number=SeqID_87602
LKVVSEESFEAPEEDEEVQALKNELGKARLAKEKFKLAATDIRKECSGLREENATTARALEQETKRARKEEYGRNKFRGALWGSNSELKLRREERDQSRAHGMVLKEELVACSRSKRNLSQRLCETETNMLAIIAKYQEELSLAMAHEHRVADEYARVYAEKEARGRVIDSLHQEATMWMDRFALTLNGSQELPRLLAKAKAMADTYSAPEEIHGLLGYCQI

SEQ ID NO: 179288 - protein, 145 aa, Glycine max
  Coding DNA Sequence Number=SeqID_87603
EAEQSTGFLDGRKERREFSSHGTPSTEESLPPFLVRDFGSQSFKVIQRVRKAWESPLRKNKERRGIRNGIIGGYHEWLKDRTRGLDWLSKLKVINEENFEAPKEDEDLRKLSLACIHFSLPTPHEQMKVDISALKEQMTSMMDAM

SEQ ID NO: 179289 - protein, 104 aa, Glycine max
  Coding DNA Sequence Number=SeqID_87604
MTWVATSVVMVMVTTLRVVRCVKHCGGDGLLVSHTTSAKGCDADHGYRKYLIFINCMMSDKWVCGAVQNLATKQWIFIGEFALAATRGENATAIGRMQWCRQCH

SEQ ID NO: 179290 - protein, 209 aa, Glycine max
  Coding DNA Sequence Number=SeqID_87605
MAASDHAILRDRAHIPTKRSLLELSSQDALLAQNKLLSKQLEAMTETLSCAICGGAHESGCCISTKDTTHEVNYMGNQPRSNFNADGPQQQGPSLYDRTTKLEETLAQFMQVSMSNQKSTESTIKNLEVQVGQLAKQLADLPSRSFGANTEKNPKEECKAVMTRSKMRASTAKHSFNALSVTKESGRAQESRPHAKRKISSLKETLVSC

SEQ ID NO: 179291 - protein, 216 aa, Glycine max
  Coding DNA Sequence Number=SeqID_87606
  Homolog annotation: Hit_ID=A5B5G7; Match level="QueryCoverage=89%, HitCoverage=13%, E-value=9e-07, Identity=23%"; Hit description =Putative uncharacterized protein
MASKKRKAPSTPSQVRYDWSRKLLPERNVVVYYTEFDEFKKELERRHWDEELTDFADGSIDVAIVKEFYANLYDLEDKSPKQVRVRGHLVKFDEDTLNTFLKTPVILEEGENLCAYSRFALLRPDPQELVAKLCIPGRGFELNTDGQPLKILRKNMTTLAQTWSVISFSNLIPTSHTSDVTLDRDKLIYGIIMKMDMNVGYLISHQIFITAQHGSS

SEQ ID NO: 179292 - protein, 398 aa, Glycine max
  Coding DNA Sequence Number=SeqID_87607
  Gene Ontology: Mol. function=enzyme inhibitor activity; Cellular component=cell wall; Biological process=cell wall modification
  Homolog annotation: Hit_ID=A2YPW0; Match level="QueryCoverage=99%, HitCoverage=69%, E-value=1e-147, Identity=61%"; Hit description =Putative uncharacterized protein
  Pfam annotation: Domain name=Pectinesterase; Domain location=89-386; Score=765.7; E_value=2.9e-227; Accession=PF01095.10; Description =Pectinesterase
MTNLYTCLDGFAYSKGRVRDRIEKKLLEISHHVSNSLAMLNKVPGVKKLTTSESVVFPEYGNMKKGFPSWVSSKDRKLLQAKVKETKFDLLVAKDGTGNFTTIGEALAVAPNSSTTRFVIHIKEGAYFENVEVIRKKTNLMFVGDGIGKTVVKGSRNVVDGWTTFQSATVAVVGAGFIAKGITFENSAGPDKHQAVALRSGADFSAFYQCSFVGYQDTLYVHSLRQFYRECDIYGTVDFIFGNAAVVFQNCNLYARKPNENQKNLFTAQGREDPNQNTGISILNCKIAAAADLIPVKSSFKSYLGRPWKMYSRTVVLKSFVEDLIDPAGWLEWNETFALDTLYYGEYMNRGPGANTNGRVTWPGYRVINSSTEATQFTVGQFIQGNDWLNSTGIPFFS

SEQ ID NO: 179293 - protein, 530 aa, Glycine max
  Coding DNA Sequence Number=SeqID_87608
  Gene Ontology: Mol. function=hydrolase activity, hydrolyzing O -glycosyl compounds; Cellular component=extracellular region; Biological process=carbohydrate metabolic process
  Homolog annotation: Hit_ID=Q9SSU7; Match level="QueryCoverage=86%, HitCoverage=90%, E-value=0.0, Identity=83%"; Hit description=Endo-1 ,4-beta-glucanase
  Pfam annotation: Domain name=Glyco_hydro_9; Domain location=43-477; Score=914.1; E_value=6.3e-272; Accession=PF00759.10; Description =Glycosyl hydrolase family 9
MTFSLSFTTLLSLLSVILLHVNAFPVHFNHPIHHRHPRFAAHNYRDALTKSILFFEGQRSGKLPPNQRMSWRRDSGLSDGSAMHVDLVGGYYDAGDNVKFGFPMAFTTTMLSWSVIEFGGLMKGELQNAREAIRWGTDYLLKATAHPNTIYVQVGDAKKDHACWERPEDMDTPRSVFKIDANTPGSEVAAETAAALAAASLVFRRSDPTYSKILVRRAIRVFQFADKYRGSYSNALKPYVCPFYCSYSGYQDELLWGAAWLHKATKNPMYLNYIKVNGQILGAAEFDNTFGWDNKHAGARILLSKEFLVQRVQSLHDYKGHADNFVCSLISGTSLSSTQYTPGGLLFKMSDSNMQYVTSTSFLLLTYAKYLTQSHMLVNCGGITVTPRRLRTIAKKQVDYLLGDNPLKMSYMVGYGPRYPRRIHHRGSSLPSIAVHPGKIQCSAGFSVMNSQSPNPNILVGAIVGGPDRHDRFPDQRLKERNKKSMLKFFRSVKVRAMGKDDFICERHVKQGRKSWFKLRVYDKCQGCQK

SEQ ID NO: 179294 - protein, 533 aa, Glycine max
  Coding DNA Sequence Number=SeqID_87609
  Gene Ontology: Mol. function=hydrolase activity, acting on glycosyl bonds; Cellular component=cellulose and pectin-containing cell wall; Biological process=cell wall organization and biogenesis
  Homolog annotation: Hit_ID=A7Q8H9; Match level="QueryCoverage=76%, HitCoverage=78%, E-value=1e-145, Identity=58%"; Hit description =Chromosome chr5 scaffold_64, whole genome shotgun sequence
  Pfam annotation: Domain name=Glyco_hydro_28; Domain location=150-506; Score=-7.9; E_value=9.4e-09; Accession=PF00295.8; Description =Glycosyl hydrolases family 28
MKCGAGIFLYSRRFLLPPPVCFYCFQYLLGIIYEIALALFLLCCPYVLLLVLLPSSSLLFHHCFQSFLFLFEEEGHRPMKRLVTVLLLIILSTALEGNGEDDHEPCKEKVLDPRPHSVSILEFGAVGDGKTLNTVAFQNAVFYAKSFADKGGAKLYVPSGKWLTGSFNLTSHLTLFLERGATIIASQDYAHWTAMDPLPSYGRGDNGIIDGQGSVWWDLISTHSLNYSRPHIIELVGSDNIIISNLTFLNSPAWSIHPVYCSNIQIQKITVQAPTKFPYTSGIVPVRVLNMIEERVLFPVLIFGVFPFTDSSEHVCIDNCNISTGHDAIVLKSGWDEYGVAYGKPTSNVHIRGVYLQSSSGAGLAFGSEMSGGISDIIAEQLHITNSTFGIELKTTRGRGGYMKNIFISDAKLENIYLGISMTGSSGSHPDDKYDPNAVPDVGNVTFENVIGANIAIAGNFSGIVDSPFTPICLSNVTFSTSSESSPSWFCSNVMGISKEVFPEPCPDLQNTYSNFSSCFSSLHPSSSFVSSA

SEQ ID NO: 179295 - protein, 41 aa, Glycine max
  Coding DNA Sequence Number=SeqID_87610
MGSQPNVLIQKVTAMMNRVGNNLLIFWGHVMDHGQKVQCKD

SEQ ID NO: 179296 - protein, 45 aa, Glycine max
  Coding DNA Sequence Number=SeqID_87611
  Gene Ontology: Mol. function=RNA-directed DNA polymerase activity; Biological process=regulation of transcription, DNA-dependent
  Homolog annotation: Hit_ID=A7QK04; Match level="QueryCoverage=97%, HitCoverage=9%, E-value=1e-13, Identity=79%"; Hit description =Chromosome undetermined scaffold_109, whole genome shotgun sequence
LIQMNEELLQYCQKEIKDLLDKGLIRKSKSPWSCAAFYVNKQPEL

SEQ ID NO: 179297 - protein, 176 aa, Glycine max
  Coding DNA Sequence Number=SeqID_87612
  Subcellular localization annotation: CTP_CleavageSite=31; ConfidenceScore=5.43e-01
MNVGALISGQITSMAQSNSSRIGFLALITTLCRSRGVAFDSLVFERLSPLVAPPDSISTVEQFNEWLAWPGTQPPLHREDEDPATQVPHQPKDESSESSTPEPLIKKRRVVVTQEAATTSEKSLEATLELPAPVTDSTSPQQAVDPSTPEDQTTPVLSPNTFPVATPVLHLSEEEE

SEQ ID NO: 179298 - protein, 383 aa, Glycine max
  Coding DNA Sequence Number=SeqID_87613
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=96%, HitCoverage=58%, E-value=0.0, Identity=76%"; Hit description =Photosystem I P700 chlorophyll a apoprotein A1
  Pfam annotation: Domain name=PsaA_PsaB; Domain location=44-383; Score= 347.4; E_value=2.4e-101; Accession=PF00223.10; Description =Photosystem I psaApsaB protein
LFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVIWRASGITSELQLYCTAIGALVFAALMLFAGWFHYHKAAPKLAWFQDVESMLNHHLTGLLGLGSLSWAGHQIHGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNW

SEQ ID NO: 179299 - protein, 105 aa, Glycine max
  Coding DNA Sequence Number=SeqID_87614
MTSAIFRYAIRHIFMADFWLFAMNRHPPLTILQQNVIGHTRFSRLESEWKLHKGSCRPSSYCWMYEHFPSVAESLSDLDYDEMSPHAYRWIATKVSLKSLPASTY

SEQ ID NO: 179300 - protein, 72 aa, Glycine max
  Coding DNA Sequence Number=SeqID_87615
VVIIKKGDIVEAKLHDESRLIQRCFDDNKGDDKKLKESRINIQGSSLQESRSRFKTQDLRIKRRLNQDKYEK

SEQ ID NO: 179301 - protein, 138 aa, Glycine max
  Coding DNA Sequence Number=SeqID_87616
  Homolog annotation: Hit_ID=A5B939; Match level="QueryCoverage=68%, HitCoverage=54%, E-value=9e-17, Identity=53%"; Hit description =Putative uncharacterized protein
MSRRARRSLQNPGREPGRSGRRCRSWCLPTLETAQPEVGSSGWKSTARRVVSGAPPAALEIRRTECLPRPVVLITASVSKVTASGRWNNVGKGSRQNGSVTSGKGLALRAGHGGPSPEPVGCRGLLELLPRRERSSRA

SEQ ID NO: 179302 - protein, 188 aa, Glycine max
  Coding DNA Sequence Number=SeqID_87617
EALERFRSLLWKTPTRGFSEPIQLNIFIDGLRPQSKQLLDASVGGKIKLKTPEEAMELIENMAASDHAILRDRTHIPTKRSLLELSSQDALLAQNKLLLHVVLFVVVLMSQAAVFPLRIMHMKAHPGNQFNKDQGGPSNRLQQQGHNLYERTTKLEETLAYWPSKLLTLLPTNLEQTQRTIPRKSVKL

SEQ ID NO: 179303 - protein, 172 aa, Glycine max
  Coding DNA Sequence Number=SeqID_87618
KEHALWCPYRTRDRVRVMGEVEEVQEQMKADTEVLKEQMATMMEAIMSIKEIMKVNAAAIAATNTIAEVDLIPLYGLNQINHPTSDIVGLEGKELGGETHEIPHHNLADFKPCLGYATEGQAVGGLVFTEERIKVGLEKGKSDHPTLMNAKTGANEEDENDGETLAMTTIPT

SEQ ID NO: 179304 - protein, 492 aa, Glycine max
  Coding DNA Sequence Number=SeqID_87619
  Gene Ontology: Mol. function=quinoprotein glucose dehydrogenase activity; Cellular component=outer membrane-bounded periplasmic space; Biological process=electron transport
  Homolog annotation: Hit_ID=A8GGG0; Match level="QueryCoverage=96%, HitCoverage=60%, E-value=0.0, Identity=92%"; Hit description =Quinoprotein glucose dehydrogenase precursor
  Pfam annotation: Domain name=PQQ; Domain location=128-166; Score =26.0; E_value=0.00014; Accession=PF01011.12; Description=PQQ enzyme repeat
  Pfam annotation: Domain name=PQQ; Domain location=206-244; Score =18.7; E_value=0.022; Accession=PF01011.12; Description=PQQ enzyme repeat
  Pfam annotation: Domain name=PQQ; Domain location=262-299; Score =24.6; E_value=0.00037; Accession=PF01011.12; Description=PQQ enzyme repeat
  Pfam annotation: Domain name=PQQ; Domain location=437-475; Score =29.7; E_value=1.1e-05; Accession=PF01011.12; Description=PQQ enzyme repeat
  Pfam annotation: Domain name=PQQ; Domain location=63-100; Score=23.0; E_value=0.0011; Accession=PF01011.12; Description=PQQ enzyme repeat
  Pfam module annotation: Pfam domain module=PQQ::PQQ::PQQ::PQQ::PQQ; Domain location=128-166::206-244::262-299::437-475::63-100
HVYAAPEAVRAGCRHRDKEKWKFDPQLKYNPTFQHITCRGVSYHETAAAAGAAGDAAPAMCARRIILPVNDGRLFALDADTGKPCPDFANNGELNLQSNMPYATPGHYEPTSPPVITDKVIVIAGAVTDNYSNREPSGVIRGFDVNSGKLLWAFDPGAKDPNAIPADEHHFVPNSPNSWAPAAYDAKLDIVYLPMGVSTPDIWGGDRTPEMERYASGLLALNASTGKLAWFYQTVHHDLWDMDVPAQPTLADITDKSGKKVPVIYVPTKTGNIFVLNRTNGELVVPAPEKPVPQGPAKGDRLSPTQPFSELTFRPEKKLTGADMWGATIYDQLVCRVMFHSLRYEGTFTPPSEQGTLVFPGNLGMFEWGGLAVDTDREIAIANPIALPFVSKLIPRGPGNPIEPPEGDKGGSGTESGVQPQYGVPFGVNLNPFLSPFGLPCKQPAWGYISAVDLKTNDIVWKKRIGTVRDSSPLPLPFKMGMPMLGGPVTTA

SEQ ID NO: 179305 - protein, 44 aa, Glycine max
  Coding DNA Sequence Number=SeqID_87620
MAMVNPGKIYQSPFPRWYNPNATCAYHGGVLGHSIEQCVAFKHK

SEQ ID NO: 179306 - protein, 196 aa, Glycine max
  Coding DNA Sequence Number=SeqID_87621
  Gene Ontology: Mol. function=aspartic-type endopeptidase activity; Biological process=DNA integration
  Homolog annotation: Hit_ID=A5C120; Match level="QueryCoverage=32%, HitCoverage=9%, E-value=2e-09, Identity=41%"; Hit description =Putative uncharacterized protein
MIMKGQDIYSSQDEATTSPSSSESEEAKGEESSEEIYLQEDGQPLVVKEKSKEVSVSSKRLAKKETHFTIKTNIKETFPLRQPPHFLFCKKTLASIATPLGLEFISQVKKLLDEGLVRKSLNPCAFLMPKIGVPMNPKRIKVIPEWPTPPSIRKIWGFHDLTNFYKRFVPYFSILVAPLIELVLREGAQSMKNLGI

SEQ ID NO: 179307 - protein, 89 aa, Glycine max
  Coding DNA Sequence Number=SeqID_87622
MVGYTPSSFTDLVFASERIEVDLKIGKFNHPAWTNQKTEANEEGENEGETHAATAVPTWKIPHQLNNIITHPISALLITHHPVIHKGHP

SEQ ID NO: 179308 - protein, 94 aa, Glycine max
  Coding DNA Sequence Number=SeqID_87623
NEDLGYMGVRELSWRWATGDVVPGDMSRGSGDLGDVRQAPGSQQIRNKDHKARRLVWWLASCESCVIYGLENEVRKLWGLLVIDYQGGVIDYQA

SEQ ID NO: 179309 - protein, 146 aa, Glycine max
  Coding DNA Sequence Number=SeqID_87624
  Homolog annotation: Hit_ID=Q6UUU1; Match level="QueryCoverage=41%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPVTIVLSPTGKTCKAPLAAAT

SEQ ID NO: 179310 - protein, 219 aa, Glycine max
  Coding DNA Sequence Number=SeqID_87625
  Homolog annotation: Hit_ID=A7UQU7; Match level="QueryCoverage=68%, HitCoverage=25%, E-value=1e-20, Identity=34%"; Hit description=IMP dehydrogenase/GMP reductase, putative
MGYVISMSPDAKQVIGQLWLARIFFIFLVCTLFANKSAINVHVVYLEALRDLSQTERYAWGVAALVHMYDHLNDASISSNRQLDSYITLLQCWIYEHFPSVAESIADSDYDEDSPRSCRWIATKKTVKNIRTPTYRERLDRLRISDVCWIPYGEHRPVRDFHMISCYSGLLRWVPVVMYYDQRGSCGSLDTLRSFLLRLWIHGCRMMIYTTGGCTIRII

SEQ ID NO: 179311 - protein, 59 aa, Glycine max
  Coding DNA Sequence Number=SeqID_87626
MFSPSGIEDSLEISEKNCFREENPSRGASVMLLRRFHGRFRGDSSPFFVRSSSFFGLQP

SEQ ID NO: 179312 - protein, 22 aa, Glycine max
  Coding DNA Sequence Number=SeqID_87627
MYFAWWRGGGPRLCRCDMKRIG

SEQ ID NO: 179313 - protein, 86 aa, Glycine max
  Coding DNA Sequence Number=SeqID_87628
MTIEESIHVTFDETNITSPRKEFVDDIADTLEDTQNEERKLKRKRDDEDKDDQDDTSQENDNFSQRMGKLQEIILLTTSSVISQKG

SEQ ID NO: 179314 - protein, 113 aa, Glycine max
  Coding DNA Sequence Number=SeqID_87629
MGWQGYQGSTGGEGGSFGQQRRMGNIHQHISSANGLVDLAVIDVFLAYHHSKESPVITILADAYDTFDLRCKRSSARTAYCMPALYVYPFVPHKVIACAPKRVKKVGKNSWQA

SEQ ID NO: 179315 - protein, 274 aa, Glycine max
  Coding DNA Sequence Number=SeqID_87630
MAARLGKLRLTPEVTVSPRRAGSFTLKSFEGLGELEASLAELGSRKLNEKTLLPLYFGIFRILDQNIERSFVLCDNRDLAIRPTTGENQGSETCNKEQTIIDMEVSDEHQKKHWVQPNSGKLHKGPGREAQSPQRKKSITFFISPSFSAPSSYPWAPATGMGWGPGAAGAMYTGRSCCSTAPGPYGLSPASQPNATCTCAYGAPSSTCELRWTLEMVADVEAVGVHMPSAAAALLNEGPVNRGLNELCGHDRYPVELTEAYDQCWKSQCPVELL

SEQ ID NO: 179316 - protein, 61 aa, Glycine max
  Coding DNA Sequence Number=SeqID_87631
  Homolog annotation: Hit_ID=A5BSR3; Match level="QueryCoverage=93%, HitCoverage=18%, E-value=6e-08, Identity=52%"; Hit description =Putative uncharacterized protein
MARTNKTGEMTTEAAKEIAEKIDSFKEQATHGSFIPHGHQDVLTAAIGRPEHLERVRATRA

SEQ ID NO: 179317 - protein, 295 aa, Glycine max
  Coding DNA Sequence Number=SeqID_87632
  Homolog annotation: Hit_ID=A5BSR3; Match level="QueryCoverage=30%, HitCoverage=27%, E-value=1e-10, Identity=44%"; Hit description =Putative uncharacterized protein
  Pfam annotation: Domain name=Transposase_23; Domain location=175-245; Score=-8.7; E_value=0.011; Accession=PF03017.5; Description=TNP1ENSPM transposase
KLLAEKTKKKLDETAQSGSVDGIIDPPSPVRRHVKWKMARTNKTGEMTTEAAKEIAEKIDSFKEQATHGSFIPHGHQDVLTAAIGRPEHLERVRATRAGVTIKQYFGSAPRTSRSSSLLPLEELQQLTQQIRDQLEESIIEKGLALPPEPLVGPSDPRVSTKGSCIDPSGNDPEMGDSDRCGLYIEENPAHLVALGRVYEGSIVVHNTPLLPGQVKVGVEEVKDPDALVPIPIDEVSLVGQKIHTFLAWPTHLVKSLSQQTVVSLAKPPQKSDLEVDDPLYLMALTIPEIFLSLT

SEQ ID NO: 179318 - protein, 117 aa, Glycine max
  Coding DNA Sequence Number=SeqID_87633
MTTGLEKAMKEAFTTENGRGSLTQGHSKTGSDSVLRLIEYGAVFVLTNLRPTSTASKSPKQASKLVGKNFGDEGQEIVTDTLEEVPQCGGINEYCNRSTPIHPQHHINREHDERMRN

SEQ ID NO: 179319 - protein, 167 aa, Glycine max
  Coding DNA Sequence Number=SeqID_87634
  Subcellular localization annotation: CTP_CleavageSite=44; ConfidenceScore=5.54e-01
GSSGKVFRKFESSSGRSRLPEFFRMNHFFRKVPGRGFPGVFRKKCSSGRRFGYFQKNTSSGNFPENVLPELPEEPLTGLPEGSAVNLLSPFFSASSPLVFYPKVTILRFHCYNNVVSYKQRGVRETNLVRGEEEDEVRACLAEKKKQFAEKGEEAVRGEGEEASRKE

SEQ ID NO: 179320 - protein, 105 aa, Glycine max
  Coding DNA Sequence Number=SeqID_87635
  Homolog annotation: Hit_ID=A5BA89; Match level="QueryCoverage=100%, HitCoverage=9%, E-value=2e-30, Identity=63%"; Hit description =Putative uncharacterized protein
MALEEGKVKIEKFDGRDFSFLKMQIEDYLYQKKLYQPLSGVKPEDMKQEEWNLLDRQALGVIRLTLAKNVAFILMKALSDMYEKSSAANKVYLMRRLFNLKMGED

SEQ ID NO: 179321 - protein, 81 aa, Glycine max
  Coding DNA Sequence Number=SeqID_87636
MKHPQDLHYVDPVLGGRTRGKGHHNREEGGGEVVADGKGGVTTEGEDGSGEEGAAPRREKKKKSGKKKKSEEREKLNVGSG

SEQ ID NO: 179322 - protein, 221 aa, Glycine max
  Coding DNA Sequence Number=SeqID_87637
MASKNNTGIPRQLVELVCGHGNPIKRNNVDELVEGNGGANETEIGQMKSRHRKRARQWWKEWLHECRTWRRSRHGKQRVWCVAARVQEVEMESTWAAEVAVVTAQRKKGSGGWFSEVVLEEGHPMWIRGGVELQQCGKEAMRKGGSAGGVGCGSRSCIPYIEALAKVAATKTKGARMPKENNRKVENGNNAVLHDGKQHANNIFPMNQYPPDSSTPSNKFC

SEQ ID NO: 179323 - protein, 181 aa, Glycine max
  Coding DNA Sequence Number=SeqID_87638
  Gene Ontology: Cellular component=integral to membrane
  Homolog annotation: Hit_ID=A7NUT8; Match level="QueryCoverage=44%, HitCoverage=7%, E-value=2e-24, Identity=67%"; Hit description =Chromosome chr18 scaffold_1, whole genome shotgun sequence
MPNFASLKSHAVTLYEAGKLGYGSIADLCKDLSTLECATYEGELQEFANHLFSLHCVLECLQSGEIVTNIKEEGSSDKLSMITSSNDGQSSEIAESSLASIYTDHVSSGMDDETSHSPFPLVSHSPSPLPFLTLHYSFSAVVASEDYGSKMLTTTTTMMFTRDVHGEGDEEAPRSHQGGVR

SEQ ID NO: 179324 - protein, 93 aa, Glycine max
  Coding DNA Sequence Number=SeqID_87639
MYQPCLTQNQALQHSNTEYRCPTPLNSMGFLGLKSEIENEPRTSRLQKRPPFTIWGRNDGQRLELCWGFNGEWRRRKKQREEERELSEKCGAE

SEQ ID NO: 179325 - protein, 53 aa, Glycine max
  Coding DNA Sequence Number=SeqID_87640
MEFLELKQGNMIVAEYAAKFEELVRVFVNFHSWLTCAGFGMKTLEIGQAIIRI

SEQ ID NO: 179326 - protein, 71 aa, Glycine max
  Coding DNA Sequence Number=SeqID_87641
MRRCLTVIYTSSFGDPSLIDKRRPMWSPAPFSEMSASFGHDSFGLTTCVDPDRVRWKADIPSDYPYKDNIY

SEQ ID NO: 179327 - protein, 66 aa, Glycine max
  Coding DNA Sequence Number=SeqID_87642
MAVSKLRNDAKNHGYLKGKRKVRLGFRSLPKSRAMLEDSASNEGFLSVWGFNGEQWRFLVATGGCG

SEQ ID NO: 179328 - protein, 151 aa, Glycine max
  Coding DNA Sequence Number=SeqID_87643
  Homolog annotation: Hit_ID=A6H595; Match level="QueryCoverage=49%, HitCoverage=85%, E-value=1e-27, Identity=81%"; Hit description =Putative 23S ribosomal RNA
DEMLRGVKISVDPGIPDIGQPFELLLNPRAGKRQPELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 179329 - protein, 421 aa, Glycine max
  Coding DNA Sequence Number=SeqID_87644
  Gene Ontology: Mol. function=transporter activity; Cellular component= integral to membrane; Biological process=transport
  Homolog annotation: Hit_ID=UPI00005F7630; Match level="QueryCoverage =99%, HitCoverage=83%, E-value=1e-168, Identity=72%"; Hit description= COG0659: Sulfate permease and related transporters (MFS superfamily)
  Pfam annotation: Domain name=STAS; Domain location=331-419; Score= -1.4; E_value=0.056; Accession=PF01740.12; Description=STAS domain
  Pfam annotation: Domain name=Sulfate_transp; Domain location=39-322; Score=254.3; E_value=2.6e-73; Accession=PF00916.11; Description =Sulfate transporter family
  Pfam annotation: Domain name=Xan_ur_permease; Domain location=1-302; Score=-108.3; E_value=0.00046; Accession=PF00860.11; Description =Permease family
  Pfam module annotation: Pfam domain module=STAS::Sulfate_transp::Xan _ur_permease; Domain location=331-419::39-322::1-302
MVTAAAGSVALVIGPMVHAHGVEYILPAVILGGVIQIIFGLAGLSRMMRYIPRSVMIGFVNALGILIFFAQVPHVWGQSGLVWLLFAATLAIVLLLPKVLKSVPSPLVAIVAVTAVALLLGYRVPNVGDEGPMRAGLPDFNTLLVPLNLHTLQIVWPTALSVAFVGLMESLLTAKLVDDMTDTPSGKRRESWALGVGNILAGFYGGIAGCAMIGQTIVNVELGKARTRVSTVAAALVLLLLVTGLSQIMAQIPMVVLAGIMMVVAVKTVNWHSLQPATLKRMPWSETLVMVLTVAVTVWTGNLALGVLVGVMLAMMLFARRIAHVIHAERQLSDDGQQVHYTVRGPLFFASSNDLFEHFDYGHDPQRVTIDLTHAQIWDASSVAALDAIEYRYQRHGASVTFTGLDNRSSDFRDRLSGNLG

SEQ ID NO: 179330 - protein, 72 aa, Glycine max
  Coding DNA Sequence Number=SeqID_87645
  Gene Ontology: Mol. function=oxidoreductase activity, acting on the CH-OH group of donors, NAD or NADP as acceptor; Biological process =metabolic process
  Homolog annotation: Hit_ID=A1FG32; Match level="QueryCoverage=100%, HitCoverage=17%, E-value=7e-35, Identity=100%"; Hit description =Malate dehydrogenase
MTSNFKQAALDYHEHPTPGKIRIELSKPANTANDLALAYSPGVAEPVRAIAACPDDAYRYTSKGNLVAVISN

SEQ ID NO: 179331 - protein, 116 aa, Glycine max
  Coding DNA Sequence Number=SeqID_87646
  Gene Ontology: Mol. function=unspecific monooxygenase activity
  Homolog annotation: Hit_ID=Q6I666; Match level="QueryCoverage=54%, HitCoverage=97%, E-value=6e-13, Identity=55%"; Hit description =Cytochrome P450 like_TBP
MIGRANTEGSKSNVTMNTWMPQAIYPCEVPPQLNSLHDNVFRPDQSSEEDPGSKKRGSASLPIHGITPTYPKLLKSFHKVELESSSTGSSFPTDSAKPVPLAMVSLDSRQGQWKSC

SEQ ID NO: 179332 - protein, 241 aa, Glycine max
  Coding DNA Sequence Number=SeqID_87647
  Homolog annotation: Hit_ID=Q2HW90; Match level="QueryCoverage=97%, HitCoverage=52%, E-value=1e-25, Identity=31%"; Hit description =Putative uncharacterized protein
MVEVSTEAIASLTQYYDQPLRCFTFGDFQLSPMVEEFEKILGCPLGGRRPYLFSGFYPSLARIYKIVQISAQELDQRKQVENGVVGIPRKYLEAKARILATIDAFLAYHNHKESPVVAMLADLYDTFDRRCEKSGTRIVCCTPALYVWLVSHLFRQEVRHACPLESHRSCTEKGGENWDQLLANKEGASVNWFPRWKEGRTGVLIPCGGFLNVPLMGTRGCISYNPVLAIRQLGFYMRGHH

SEQ ID NO: 179333 - protein, 92 aa, Glycine max
  Coding DNA Sequence Number=SeqID_87648
MNFAARKPIEFTPIPVSYADLLPYLLDNSMVAITPTKMSLMTHHNFQVQAIGLFAQATCAPEFGLPRPFNQRLLVLHVGGGAVKQRSLLQNG

SEQ ID NO: 179334 - protein, 109 aa, Glycine max
  Coding DNA Sequence Number=SeqID_87649
MSYFGVIQEIWEVDYTSFRVPVFKCQWVNGTTGRPSGMNYHNDESTLDIGQMSSFSKQLPSMNEADEVDDGHANRVDHDEGSWPQIRRLLHSPMVNQRRLPRGVEQRHG

SEQ ID NO: 179335 - protein, 86 aa, Glycine max
  Coding DNA Sequence Number=SeqID_87650
MNSLPSAVHVSSIIKRGASEKKREGVETRVVIKERAGRTKSVSYLCFPLISDERYLAPFVARYVKSRDMPKIKRKQAYAIRENSVR

SEQ ID NO: 179336 - protein, 204 aa, Glycine max
  Coding DNA Sequence Number=SeqID_87651
MDNEEGVQEQMKADLSTLKDQMASISEVMLKLQKTIEDKATATASSTVREAEPVLQPALNPSLDRNTAVFGRRYSPQAYPYGLPPDFTPRATPEDLSQAPTFEGQLPPYEDYPGQDDGEGDTHLGPLLHLKDPSPHELPQPNIVRHIPASPAPVKESVPFAEDKGKIEALEERLRAVEDLGNYLFSDLADLCLVPNIVISPKFK

SEQ ID NO: 179337 - protein, 118 aa, Glycine max
  Coding DNA Sequence Number=SeqID_87652
  Subcellular localization annotation: CTP_CleavageSite=84; ConfidenceScore=5.08e-01
MGIAPTKTPSGPEEVQQGPRVSSSGYGPLSALQGARSPQQGLCPQDTQWTRRSPTGSTECLSPPARASGPPTNRAFIKKYCVPQAGAGRNTTAAWDGRQRAIDAPPLTSRVPLSSSIK

SEQ ID NO: 179338 - protein, 148 aa, Glycine max
  Coding DNA Sequence Number=SeqID_87653
MVGYAPSSFADLVFADKRIEAGLKRGKFDHPTLMSEKARANEEDDNEEGTHVVAAIPTWPNFPPAQQCHRSANIGPSHYPPPSHPQSLLATHPMPSANQNTNQEMNFAAKKPIEFTPIPVSYADLLPYLLDKSMVAITPAKVPQPPFF

SEQ ID NO: 179339 - protein, 128 aa, Glycine max
  Coding DNA Sequence Number=SeqID_87654
  Subcellular localization annotation: CTP_CleavageSite=49; ConfidenceScore=5.08e-01
MTWMPPLLPAGKLVPPLTTAGTRIPPLATAALSLTRQYERRDAERESCTADSNGGTRRERVVPLIATAGRGEREPMPPFLLAGHANVAVPPLPPAEHLDGTRASVHMHAESFLCRLGMLNHFYAVYAG

SEQ ID NO: 179340 - protein, 78 aa, Glycine max
  Coding DNA Sequence Number=SeqID_87655
  Gene Ontology: Mol. function=oxidoreductase activity; Cellular component=cytoplasm; Biological process=metabolic process
  Homolog annotation: Hit_ID=A7QF60; Match level="QueryCoverage=93%, HitCoverage=20%, E-value=3e-18, Identity=63%"; Hit description =Chromosome undetermined scaffold_87, whole genome shotgun sequence
MFHWLLLLLPEERKVASITGGASGIGECVARLFSKHGAKVVIANIEDELGHSICKDLDSSSATYVHCDVIKEEHMVYD

SEQ ID NO: 179341 - protein, 199 aa, Glycine max
  Coding DNA Sequence Number=SeqID_87656
  Homolog annotation: Hit_ID=A2Q6B3; Match level="QueryCoverage=63%, HitCoverage=58%, E-value=4e-07, Identity=24%"; Hit description =Putative uncharacterized protein
MNQEAGHSGSAPSSSRLSTLNKELEMVLTTLPKLTNEEHEQCCEMAKIMLNVTVASETILNTVNAKDQIYDEVNRSFVVRWKDVLDRFWHLLDKDGNFHTVLYNQNLDRPTIVAGWTTLRDFYHMTEDHQVSLTHYGKSVFFLTVFKSSSHPKSFSRWYSLYHQVPNSVTFNVFFTQHKITCSSLDVPSTMYYFLKHKG

SEQ ID NO: 179342 - protein, 128 aa, Glycine max
  Coding DNA Sequence Number=SeqID_87657
MRFDAETINDFLDTPVILAKGEDYPTYSQYLRRPPDHDAILSALCTPGGRFVLNVDGPPWKLLRKDLTTLAQTWSMDPPLTTPEAYHPQVAWPGDQPSTDRGKELSGAAATEDPAVDEDLIADLAGAD

SEQ ID NO: 179343 - protein, 77 aa, Glycine max
  Coding DNA Sequence Number=SeqID_87658
METMRNIYAFQEDGVRWTYHVPKKAFRRVENLHHACMMTKKEKLSSSGIWKREGCVSPQFWMRKLKNEWVVEEERGV

SEQ ID NO: 179344 - protein, 44 aa, Glycine max
  Coding DNA Sequence Number=SeqID_87659
  Homolog annotation: Hit_ID=A7QH43; Match level="QueryCoverage=90%, HitCoverage=18%, E-value=4e-12, Identity=80%"; Hit description =Chromosome chr3 scaffold_95, whole genome shotgun sequence
MYLKYFGPTFVHDASKMAISPPQYLDPYALLEDERISKIAPRLN

SEQ ID NO: 179345 - protein, 103 aa, Glycine max
  Coding DNA Sequence Number=SeqID_87660
MVFTSKLPLQFPFEYLTGNQFRFQCMTLKDDADVNTMLMCNHEFSFVGPIELLCSIARTPNGILNLLETTMTPTHDALLYYNGRWKMSRQNEFVGYSFTGKNP

SEQ ID NO: 179346 - protein, 105 aa, Glycine max
  Coding DNA Sequence Number=SeqID_87661
  Subcellular localization annotation: CTP_CleavageSite=57; ConfidenceScore=5.09e-01
MADTANKSHIILLSNSLPIDTQSMTFLGETSSQTIVNSRLAFIFPNGSIIHNDTSVYFQTSTPVPIRVPNSCDFASLKTRIHNTLQLSGKQFLDEMHYWKPFTDT

SEQ ID NO: 179347 - protein, 51 aa, Glycine max
  Coding DNA Sequence Number=SeqID_87662
MVSKGWSFDGASMVRKKKGIATSCATCLLLSGVKRVHTQSQEEKNLTFLKC

SEQ ID NO: 179348 - protein, 242 aa, Glycine max
  Coding DNA Sequence Number=SeqID_87663
  Homolog annotation: Hit_ID=A2Q4S5; Match level="QueryCoverage=52%, HitCoverage=19%, E-value=4e-11, Identity=33%"; Hit description=IMP dehydrogenase/GMP reductase, putative
MYMSCTWRLSGTWPQAGGFAWGAALLVHMYEHLNDASQTSTRQRWACWIYEHFPTMHTSVIHDAYDEGSPRACRWLTGKAHMTGIKGAPYRRRRDALTVTDVCWMLYAEHRGVRGFDLISPYIGQLRWGQIVVYVRPERVAPDYKEWFFRISHSFVTRTEETAEPRHPLPPHDEELVEPPIPEFSVATNLPTHSVVHCEGCQGMAEDLGAIAEDLERVINLKMVTEGTDLHDIMTRCLRRAR

SEQ ID NO: 179349 - protein, 256 aa, Glycine max
  Coding DNA Sequence Number=SeqID_87664
  Subcellular localization annotation: CTP_CleavageSite=28; ConfidenceScore=5.52e-01
MTFFQKEFLSTSGITNSSSGRRFFRKVSGKRLFQNDFEKRFFRKWFSHKGIFATSLFAGCPNNNAGEATRKDAKEEKYLNKCMPSLHQRRGEDPREGKRKKRKGERNSRVGGEEKEKREIGRGVQKFKGHFNQAISLKKSSCLDNDVMLNTYVIWKEDEGSDFSLEHAYSSSSNLETPIENVEVDTPSPIVHPIGQKEEQEKRNRNIYNPWDLIGVEEAIREINILNTKLVALTEIELENEYYDILIKDTSTMSET

SEQ ID NO: 179350 - protein, 83 aa, Glycine max
  Coding DNA Sequence Number=SeqID_87665
  Subcellular localization annotation: CTP_CleavageSite=16; ConfidenceScore=5.00e-01
MASPPVLPPPPPPPPSDASASPPPGADKPVVHVNPTTGKADGPYKKKLRTHLGIVARDKVDVTYENWKKVPTAQKDLIWEDIQ

SEQ ID NO: 179351 - protein, 166 aa, Glycine max
  Coding DNA Sequence Number=SeqID_87666
  Gene Ontology: Mol. function=protein serine/threonine kinase activity; Cellular component=cytoplasm; Biological process=protein amino acid phosphorylation
  Homolog annotation: Hit_ID=P28583; Match level="QueryCoverage=39%, HitCoverage=20%, E-value=1e-16, Identity=46%"; Hit description =Calcium-dependent protein kinase SK5
MSNSTTGTTAALPPKPTWVLPYRIENLREHSNVVRIHDTYEDTAFMEACHWLGVMHRDLKPKNFLFDTVEEGAKVKTTDFGLSVFYKPGCRGEGLVVGFGGGGDSDDVFEFSLAEELADAVDDMLGSGAGVEDHAGLDILNNLVGGNFLEVVLGEDDEGGGGGGYY

SEQ ID NO: 179352 - protein, 117 aa, Glycine max
  Coding DNA Sequence Number=SeqID_87667
  Homolog annotation: Hit_ID=UPI0000ECBAF8; Match level="QueryCoverage =35%, HitCoverage=48%, E-value=1e-16, Identity=100%"; Hit description= UPI0000ECBAF8 related cluster
MKPDHGKIFYIGCPNNRCRMSEILHRSLMQFYPARVLGRRLQVDWARDPREGPRVLMSLRSRPAGMQAWHWPSFYNVVTGKTLALPNLIALQHIPLSPAGVIAKRPAPIALPNSCAA

SEQ ID NO: 179353 - protein, 103 aa, Glycine max
  Coding DNA Sequence Number=SeqID_87668
MILILKNDWDPLLHARDSTIPTATDSDDNQDNLECLKRVRSLYQPLSVILPLAAVSDNDDDSVDNLETVRAIMKRFSTYGEVNGFEWVILNRYGEEGLFPMKA

SEQ ID NO: 179354 - protein, 285 aa, Glycine max
  Coding DNA Sequence Number=SeqID_87669
  Gene Ontology: Mol. function=chromatin binding; Cellular component =chromatin; Biological process=regulation of transcription, DNA -dependent
  Homolog annotation: Hit_ID=A7M6G1; Match level="QueryCoverage=57%, HitCoverage=42%, E-value=5e-23, Identity=38%"; Hit description =Terminal flower 2 protein
  Pfam annotation: Domain name=Chromo; Domain location=104-154; Score =67.9; E_value=3.3e-17; Accession=PF00385.15; Description='chromo' (CHRromatin Organisation MOdi
MKGGDGMKKANFEALNIVVGGGGVDLGGGDGGGVKVQNFEGIKGTRLRKSEEEEKSHVKSNEGEEEDDGPEGEKEDEENVACSGTAAGAQRGQQGVVVLGENFFEVEAIRRKRVRKGQVQYLIKWNGWPETTNTWEPPENLEYIPDIVEAFEESLMSRKHRKRKRKHMVHDTQHKKCKHTHSSPPLNDHSLPDIPDFPQTALFCGGAEGSNLGKATPASNANKSANGSKQNIERNEENDYESKAMTINGNDTDKLAIQIPEAKNKLKDIYGYIKTFLIKVSQFVK

SEQ ID NO: 179355 - protein, 381 aa, Glycine max
  Coding DNA Sequence Number=SeqID_87670
MTATWLKVLPASLVVVHLVEPGPLTMVVVVAASKQTKGAPWGGPWVSVSGVDLGVDLAYLEFLWKWNLAKVRLTKDYPRVDLGTAKFGVHSAHALTLELFTGIGHPQTQTDPNNLGWVIYVLGVLATRLPTEKVLASHCHERLYTLEANVDRRIGMDRGEKGIRDIEKGFPLFEILKLRMYSLESFESRASLGFFVGLLHAKYELAAKRGDAYHQLREQVCSSVVLPRYVVHFKAFKIVNESLCDVIVLEQHYFLGLALKLRLRACSRVTWSGPLRMIPAPLPFTLDALSIEFCQKVNLELCLRVAARFIMMVELTTSSATKRYKSRGTPGLGQLKTGGATMVFLKARNAYSQELASADPKSTFFRVEAHVVFVEFSEDLF

SEQ ID NO: 179356 - protein, 324 aa, Glycine max
  Coding DNA Sequence Number=SeqID_87671
  Homolog annotation: Hit_ID=A7UQU7; Match level="QueryCoverage=75%, HitCoverage=54%, E-value=4e-14, Identity=24%"; Hit description=IMP dehydrogenase/GMP reductase, putative
MVRTRGLGRALGRVIGRGRGREDRDDSDDAPQRRRPIASTHRQRVSVTIVDDELVVPTDSPVVPVVPVAEPVVATDEPMVDGDTSADTGAEAAANEPEGFPSGSTNLSLLTKYAEHVAASVWTGNERPELNLSSHGRKVQKLGSRHGRSGTYIIICGEVAPGDSSFHLPVGEVTITLDDVASLIHVPIVGDFHTFQPLHVDEAVLMLVDLLMVRDTYQRRCQAGHWTTAAHAYLLHLLGCTLFANKSATHVHVVFLDALRDLSQTRRYAWGAAALCWIYEHFLSIAECNADPNYDEVSPRACRWIATKKTVKSISIETYRQRLN

SEQ ID NO: 179357 - protein, 355 aa, Glycine max
  Coding DNA Sequence Number=SeqID_87672
  Pfam annotation: Domain name=Chromo; Domain location=150-230; Score =10.4; E_value=0.03; Accession=PF00385.15; Description='chromo' (CHRromatin Organisation MOdi
MVMIGVPEKKKTGLKRAQGLTTKLTGPNGSAFDGSAVARGLHMKKIARDKGGMWELLWRCDFQGTRSDANLKTEGGGGKRKASLEASSGGVGDGGASIPSDGVDLCGGDGGEEDDGIEEEQDEEENVAGDGVVVGAQGGQQGVVLGENFFEVEAIPYKRVRKDVTNDVVKNNERFKENGCKWVERGCGCMDIITQTEKGLMNGWPGTTNTWEPPENLESIPDIVEAFEESVIVAEREPPHARLVAIHGTRIADHSPPRNECEGVGGGGGVPEVDVGETAGPGGGGGGDREEEVAARGGGEAGDEGRVDEAENYEREAYKGGVFSRRELRGTKLISREHEFNSYGMVYVQIKPNYD

SEQ ID NO: 179358 - protein, 58 aa, Glycine max
  Coding DNA Sequence Number=SeqID_87673
MSEEVDMDYQNEEECGVSEPHVDCLNAFNTSQVFDSREDVLWWARSVAHENGFVTVII

SEQ ID NO: 179359 - protein, 174 aa, Glycine max
  Coding DNA Sequence Number=SeqID_87674
EQALNEGEEAAAHVQQDPMEINLSQPHLSQDSDMELMVPATIVPPIARNKLTITRAKQRKVTDKDDAVAEFEVRIAARHPWWHCRMKLPENAQQLPLADMEKSSEQEAATEPQRRRRRSDSAWETSSFVNPNLFGEEEEATLREREFIDADLSATLDNLRGTELPPMHLTNVVT

SEQ ID NO: 179360 - protein, 67 aa, Glycine max
  Coding DNA Sequence Number=SeqID_87675
MWLDMFLKLPYTRGFLAWFQESFFLAWAAAIAGATRTSGICGSTYGTSCVTGGCLARSAGYADVMNG

SEQ ID NO: 179361 - protein, 247 aa, Glycine max
  Coding DNA Sequence Number=SeqID_87676
  Gene Ontology: Mol. function=aminoacyl-tRNA ligase activity; Cellular component=mitochondrion; Biological process=glycyl-tRNA aminoacylation
  Homolog annotation: Hit_ID=A7PK96; Match level="QueryCoverage=97%, HitCoverage=31%, E-value=1e-52, Identity=50%"; Hit description =Chromosome chr15 scaffold_19, whole genome shotgun sequence
MHYILHVQLLVEKNKNLDFKKALELAADAQSIKVDPHVTDDNMCPKHLAVFVHILLYSDPILIMLCNVFYDMILYFDPKSGQVDKGVNAEFVRSILVERANFPCLAAKSAYKETSFTEFLSLSLCIWKNYLKEPFPKVVEAYSWPTRIVRGKEDELHMEVDETAFVTNEESVLCGTFLSVKKSINPGFGIDDFAEISCQLIQPLEDFFNNVFIMVDDDKIRVNRLALLKGIAELPKGIADLTVLPGF

SEQ ID NO: 179362 - protein, 165 aa, Glycine max
  Coding DNA Sequence Number=SeqID_87677
MAKHIFHQEEQQNRCIFRQEELRNSCRSGGAECNLCAMDFTILIGETGGASAAFAIFTGKIGTTHPSPPSLYTTLFTGKYVALQICDDEDVETMVESFQQQEQMSVIEMYIEKDVAGGSTFHSANSVTSCGNKSLDEDDNVDGISDTDDEVIHMIEPVTIVHPRE

SEQ ID NO: 179363 - protein, 119 aa, Glycine max
  Coding DNA Sequence Number=SeqID_87678
  Gene Ontology: Mol. function=aminoacyl-tRNA ligase activity; Cellular component=mitochondrion; Biological process=glycyl-tRNA aminoacylation
  Homolog annotation: Hit_ID=Q8L785; Match level="QueryCoverage=69%, HitCoverage=5%, E-value=8e-10, Identity=45%"; Hit description=Glycyl- tRNA synthetase 2, chloroplast/mitochondrial precursor
MWDVAGDDFGSLDDYGILEIASLSLDEPELEEKEVEVRGPLVPKAIDHEGNPTKAIEGFSRRYSVPLDLVYRLVNGEYPEAEHLLSGPLVGTSMQFPDVAGKMEYVYAHIKESSRHALE

SEQ ID NO: 179364 - protein, 154 aa, Glycine max
  Coding DNA Sequence Number=SeqID_87679
  Homolog annotation: Hit_ID=A5C0F5; Match level="QueryCoverage=45%, HitCoverage=11%, E-value=2e-10, Identity=38%"; Hit description =Putative uncharacterized protein
MGKKIKNYTLDELFPRIKRLDKKLEARNTYFSHEMQSTITPQEVSVLLGLLVDGPTQLRHLDPFIRGVLFVDKGSSKVSLRWLRRVNQHIDNDDLIVFCHKLDIMKRHEFVWEPYTTNVMSVLSSICLVGRVVWCAVVPLICFQVIEWHHLIEC

SEQ ID NO: 179365 - protein, 305 aa, Glycine max
  Coding DNA Sequence Number=SeqID_87680
  Pfam annotation: Domain name=SWIM; Domain location=271-303; Score =33.1; E_value=1e-06; Accession=PF04434.8; Description=SWIM zinc finger
MHAGDIHGTRTRGNFATNTGGTGVVQQVLQALLAKQSHVYEENDSVIFEGSKKAVQIKRKYVALQICDDEDVETMIESFQQQEQMSAIELYIEKDVGGGSTFHSVNYVNNLSNNESELPRNVSALDDDDDYLVSNSYVEDSLDEDDSVDGISDTDDEVTHMIQPITIVHPREGVEGIQNPFWNDVLHYNNVNWSHPDEEDICGLEMSSSFNVGQELYVGMDFDSKDAVVKEHRKNQEQACSHIVRVYDIHSTRFEVEETFNPITQRDGQKWTVNLNDHYCQCGKYSALHYPCSHIIAACGYVSMN

SEQ ID NO: 179366 - protein, 747 aa, Glycine max
  Coding DNA Sequence Number=SeqID_87681
  Gene Ontology: Mol. function=triacylglycerol lipase activity; Cellular component=chloroplast stroma; Biological process=lipid metabolic process
  Homolog annotation: Hit_ID=A7PKA7; Match level="QueryCoverage=43%, HitCoverage=83%, E-value=1e-112, Identity=63%"; Hit description =Chromosome chr15 scaffold_19, whole genome shotgun sequence
  Pfam annotation: Domain name=DUF1723; Domain location=504-551; Score =6.4; E_value=0.092; Accession=PF08330.1; Description=Protein of unknown function (DUF1723)
  Pfam annotation: Domain name=Lipase_3; Domain location=183-334; Score= 188.2; E_value=2.1e-53; Accession=PF01764.16; Description=Lipase (class 3)
  Pfam module annotation: Pfam domain module=DUF1723::Lipase_3; Domain location=504-551::183-334
  Subcellular localization annotation: CTP_CleavageSite=57; ConfidenceScore=5.56e-01
MRLVIRIASIQPRASSSISQPNPTFSSSESNANSQFNKSLLSWNRLKPPSTKCNFPKLRHKWKQYQGINHWEGLLDPLDDDLRWEILRYGHFVDATYSSFDFDPSSLTYATCLYSKKSLLNKCGLGNYGYRLTKYLHVTCGIHMPTWINKFFKQACIRSNWIGYVAICDNKKEITRLGRRDIVIAFRGTVTCLEWLENLRATLTHLPDHVVGENDGVGPMVQKGFLSLYTSKSTTRASLQEMVREEIGRVIQRYTNEPLSLTLTGHSLGAALAILSAYDITTTFKNAPMVTVISFGGPRVGNESFRKQLEQNGIKILRIVNSDDVVTKVPGLVVNLDDVASNEDVHMGIWSRWLHKYIEDMQLVYADIGQELRLSSKEFPNLNKGDVAMPIASARRQREAIPVAEDAPDMTEDVPTPGAEAADGGEGFAVDDAQGFPGGSHDPSVLTEYGDHVALSIWNGEELPELKLSSHGRKIEKFGRLAPEIERLVAATGLTPLITCSVDTDDRGVISAFVERWHKETSSFHLPPLHVDEAVLMLVKLLEVSGEEARAEAAQCHGAYAYSKGFPALTYQTRINALTIPDVCWMPYGEHRGVRTIPSLPMGASLSFEDIDNKWMHYLDHLAAGGQICLVPGQCAPDYMDWFFRISHLFITPIQAVDPPKHPLVPQHDTYVESDIPEVPMAPEAGPSHAPSDAEQPRHAVDACQAIAKRLERLLNLRIVTTGTEIHEVMEDYIRIARGITVDGNAY

SEQ ID NO: 179367 - protein, 443 aa, Glycine max
  Coding DNA Sequence Number=SeqID_87682
  Gene Ontology: Mol. function=aminoacyl-tRNA ligase activity; Cellular component=mitochondrion; Biological process=glycyl-tRNA aminoacylation
  Homolog annotation: Hit_ID=Q8L785; Match level="QueryCoverage=88%, HitCoverage=35%, E-value=1e-131, Identity=62%"; Hit description =Glycyl-tRNA synthetase 2, chloroplast/mitochondrial precursor
  Pfam annotation: Domain name=tRNA-synt_2e; Domain location=1-174; Score=141.9; E_value=1.8e-39; Accession=PF02091.6; Description =Glycyl-tRNA synthetase alpha subunit
  Pfam annotation: Domain name=tRNA_synt_2f; Domain location=204-443; Score=-224.2; E_value=6.5e-09; Accession=PF02092.8; Description =Glycyl-tRNA synthetase beta subunit
  Pfam module annotation: Pfam domain module=tRNA-synt_2e::tRNA_synt _2f; Domain location=1-174::204-443
MEITQFTYFQQAGSLQLSPVSVEITYGLERILMLLQGVDHFKKIKYSDGITYGELFLENEKNAYGLMAIILALIERGLQGKKEMSAYYLEHASVDHVQKHFDFFEEEARSLLSSGLAIPAYDQLLKTSHAFNILDSRGFVGVTERARYFGRMRSLARQCAQLWLKTREMLDFPLGFISEPDHFVLPKEVLEAACEKVHDHSRAFVLEIGTEEMPPQDVVDASKQLKDLLLQLLERQRLNHGEVQAFGTPRRLVVAVENLCTKQAEKEVEVRGPPVSKAFDHEGNPTKAIEGFSRRYSVPLDLVYRKVDGKTEYVYARIKESSRHALEVLSEDLPATIAKISFPKTMRWNSQTWITLVSNSHTCKSPLCLKHGHCACPLPIIPGGGVLLMNALRVFSLKALNTLNYYNEVMFSRPIRWILALHGDVVVPFMFAGVTRHRFIRTS

SEQ ID NO: 179368 - protein, 486 aa, Glycine max
  Coding DNA Sequence Number=SeqID_87683
  Pfam annotation: Domain name=RRM_1; Domain location=21-91; Score =34.6; E_value=3.6e-07; Accession=PF00076.13; Description=RNA recognition motif. (a.k.a. RRM, RB
MSEIESESDREREERDDITTFYFTRFPEDTTEKDLWAQFKKWGDVREIFISKHRNKGGRRYGFVRFKGVSDKRRLERQLDNIIVGGLKLYVNVPKYGRGKERYEESRVKPRTQLEIPAGEKKWYTNVWVGCVKKSGISERVEDEPPWEVGTNVVPKYLGDDMILLLGLSDTKAEKLIIEETRHGSSPFHSLEKWNPTMRSGHRLLWAQCWGIPSEAWDIGQIHKIVAAIGDLVEVDDNVEELRMLDRARVLIRIPWRPIFQHMVEVHISGERSRKKAHLPLSERHRSSEEIDSDDNDNGTPKSKMSREPRFHYSPRSFAGERIGEIESQQRATLSNGPRDTEDPTGNDCVSWAHCPKYETCAPDMETGKVTDPVSRPVLDPEALFGEDEILKAQKQKKQGSRGTTPMVRGCFEREGADPAHGQNGADHECLNGSQMPINKEARDMAMVVNGPTINLGLTNHTTAIFSQNNCNSPQYHKLDNGSTWK

SEQ ID NO: 179369 - protein, 230 aa, Glycine max
  Coding DNA Sequence Number=SeqID_87684
  Gene Ontology: Mol. function=nucleotide binding; Cellular component =plasma membrane; Biological process=small GTPase mediated signal transduction
  Homolog annotation: Hit_ID=P28188; Match level="QueryCoverage=94%, HitCoverage=83%, E-value=1e-101, Identity=83%"; Hit description=Ras -related protein ARA-5
  Pfam annotation: Domain name=Arf; Domain location=23-196; Score= -48.6; E_value=8.1e-06; Accession=PF00025.12; Description=ADP -ribosylation factor family
  Pfam annotation: Domain name=GTP_EFTU; Domain location=37-202; Score=- 79.5; E_value=0.03; Accession=PF00009.18; Description=Elongation factor Tu GTP binding domain
  Pfam annotation: Domain name=MMR_HSR1; Domain location=36-151; Score =2.9; E_value=0.00058; Accession=PF01926.14; Description=GTPase of unknown function
  Pfam annotation: Domain name=Miro; Domain location=37-151; Score =94.9; E_value=2.6e-25; Accession=PF08477.4; Description=Miro-like protein
  Pfam annotation: Domain name=Ras; Domain location=37-198; Score =362.0; E_value=9.8e-106; Accession=PF00071.13; Description=Ras family
  Pfam module annotation: Pfam domain module=Arf::GTP_EFTU::MMR _HSR1::Miro::Ras; Domain location=23-196::37-202::36-151::37-151::37 -198
MSLKHVIRDTIFISKCIEDHHLLGKGASGKSCDYLFKLLLIGDSGVGKSCLLLRFADDSYIESYISTIGVDFKIRTVEQDGKTIKLQIWDTAGQERFRTITSSYYRGAHGIIIVYDVTDEDSFNNVKQWLSEIDRYASDNVNKLLVGNKSDLTANRVVSYDTAKEFADQIGIPFMETSAKDATNVEDAFMAMSAAIKNRMASQPSANNARPPTVQIRGQPVGQKSGCCSS

SEQ ID NO: 179370 - protein, 92 aa, Glycine max
  Coding DNA Sequence Number=SeqID_87685
MNGIVNAIEKGEIERTTRDSYRGSGEFAGKGRVIAGEMRGSGAARMAPTEGKRKRRRQYGDVLKWLLILLRFSIHTWQPLTLPAMCVGQTSY

SEQ ID NO: 179371 - protein, 107 aa, Glycine max
  Coding DNA Sequence Number=SeqID_87686
MTQRLKTKKLKKLQKSESSKGRFKSCITFTKNQQVAPSVGKMIKIKKDGNNKRIKMEAILIQHGCAEALKGEEKMSESLSSKEKSEMIAKAKSAIILCLGDKALREV

SEQ ID NO: 179372 - protein, 437 aa, Glycine max
  Coding DNA Sequence Number=SeqID_87687
TPDGLKGYRVILREAPLASTEGCNLLWLPRRSGRDVRVSPRVHRNHSVWSLLPLPVIVDFEWVMDNVIKYKSSFTSTMSIFALQRQLKLANPKDSCKIIVEACRSDDFSFLRAALGNTPTFFMYKCLFEVLGLVLPMTTFQRAMLEHLNMASSNSTQTIGPCVSKKFFEFDSNVFHRFKDYFFKVLSTDVVADEGTSTWVVVSENKRGYISCGSVQVEGFYKVERNLKDRRLLVDWMPLDPTGGIVPSSIVIPAAGEGGQPAIEVGSVACAAEVAPRMIPLPPTKVLALEATAVVVTPVHAPPSVVPVQEVTPAAEVNAPVTLPGSVVYPLLSVSVATMSSPEMLPPPSLVPWVLPYVVLVAASPFSSFCPYVSLDHLHTFSNADLSWGATYKLKQKTPIGYASAFDKNLCPVSWGAEHYGFCKGLPPEKFGDSRGE

SEQ ID NO: 179373 - protein, 42 aa, Glycine max
  Coding DNA Sequence Number=SeqID_87688
MWQEYEGDQWGLDLRRKMTANGHPVSTRIPTEMDEDDNEQPM

SEQ ID NO: 179374 - protein, 548 aa, Glycine max
  Coding DNA Sequence Number=SeqID_87689
  Subcellular localization annotation: CTP_CleavageSite=29; ConfidenceScore=5.41e-01
MASPLASPPHPPPPLDASASSSALKRTCKASHLRSLSTRPPGADRPVVHIDPTTGKADGPHRKKLRTYLGIVARDKVDVTYENWKEVPTAQKDLIWEDIQTIGERWRQFKSDLTRKWALETDQDGVDDTVCDKYDISKEKWAQFCQIHRDPSWEKLLAEKTKKKLEEAVDGVIDPRSLVRRRVKWKMARMKKTGIPLRSRRHRDPSSPMGVMMFSPLLLDVWSTLDVSVLLELVSPSSNNLDRDQLEESITEKVTRQFMASFSQMQSQGHALPPEPLVDPSGPQVSTKGSCVDPSGNDPETDDLNRLKVGVEEVKDADAPVPVPIDEVSLVEQAIHTFLAWLTHLVKSLLLQATVSPVKPPQKLDLEVDDSFYLMTLTIPELFLRPYQVTWDAIVFGVFNLDFLLYIKHEDLSEIAYGGQCLSILVLQLCILHLTETSKRAGNSDICEFLEPQSIQRSGQSQFETESYIKSWMQSSKCNVYLGAYLNGQKGSTECGYYVMHWMSTVILGSFRNNWEAYFNDPRPLEPERLKALRIQWAQYYLRVRDQT

SEQ ID NO: 179375 - protein, 236 aa, Glycine max
  Coding DNA Sequence Number=SeqID_87690
EFYSNLYDPEDRSPKFCRVRGQVVRFDVETINDFLNTPVILADGEEYPAYSQYLCTPPDHDAILSTLSTPGGHFVLNVDGAPWKLLRKDLTTFAQTWSVLSYFNLAPTSHTSDINVDRARLIYGLVMKMDLDLGSLISLQIAQSNTSRLGFPALITTLCDIQGVVSDTLIFGSLSLVINLAYIRKNRWNPADSSITFPRVRRPRTRAQGQHQRLLFLPSPLLSLLPRDRALHLHPP

SEQ ID NO: 179376 - protein, 151 aa, Glycine max
  Coding DNA Sequence Number=SeqID_87691
  Gene Ontology: Mol. function=nucleic acid binding; Biological process= RNA-dependent DNA replication
  Homolog annotation: Hit_ID=Q2AA51; Match level="QueryCoverage=42%, HitCoverage=19%, E-value=1e-09, Identity=46%"; Hit description =Retrotransposon gag protein
  Pfam annotation: Domain name=Retrotrans_gag; Domain location=14-102; Score=12.6; E_value=0.0032; Accession=PF03732.8; Description =Retrotransposon gag protein
MKIAGVPEDAIRLSLFSFSLVGEAKRWLHSFKGNNLKTWEEVVEIFLKKYFPESKTVEGKTSKQLLNASAKGKIKLKTPEEEMELIKNMATSDHAILRDRTHIPTKRSLLELSSHDALLAQNKLLAKLEATIFVEKLMNPAVVYPKMIQPK

SEQ ID NO: 179377 - protein, 50 aa, Glycine max
  Coding DNA Sequence Number=SeqID_87692
MSSVTIHVERNFLSGWNCAQCTSRPKQEAEERHCEILGHLLYTAKLDVKQ

SEQ ID NO: 179378 - protein, 110 aa, Glycine max
  Coding DNA Sequence Number=SeqID_87693
  Homolog annotation: Hit_ID=A5AII6; Match level="QueryCoverage=50%, HitCoverage=18%, E-value=1e-07, Identity=54%"; Hit description =Putative uncharacterized protein
  Pfam annotation: Domain name=Isy1; Domain location=1-110; Score= -109.7; E_value=0.0019; Accession=PF06246.3; Description=Isy1-like splicing family
MARNEEKAQSMLNRFITMKAEEKKKPKERRPFPTSECRDLSEADKFSKTKFSQIGPSFTSMTLSGPLLSRKVARAVESPIVFTKDKVSSSSSSASPPTSTPKPASVAESQ

SEQ ID NO: 179379 - protein, 334 aa, Glycine max
  Coding DNA Sequence Number=SeqID_87694
  Homolog annotation: Hit_ID=Q5XM22; Match level="QueryCoverage=25%, HitCoverage=76%, E-value=7e-23, Identity=46%"; Hit description =Resistance-like protein HAAS-2
MTEDVPPMTMNVPVVGVEGLVAGDVVAGSIADDVVAGPVADDAEGFSGGLRDTSVLTSFPDDVSHNIWTGDERPNLKLASHGRKVEKIGRRLAQLRTSSYRGGGRLVDGVAQGLGCEARQWIVAARAYLLHLVGCTLFANKSATYVHVVHLRDFQDLGESGRYAWGAAMLYWIYEHFPSVHDCVTDDAYDETSPRACQWLTTKAYIKGLRAPAYQTCLDALMITDMCWMPYGDHRGVRGFELISCFQGQVSTDYVEWFFQISHPFVTPTQAGDEPRHPLAPQHEEYVEPGIPEDGYEGCEAIAERLERVLNLRMVTKGTKLHEIVEDCLRIARG

SEQ ID NO: 179380 - protein, 1487 aa, Glycine max
  Coding DNA Sequence Number=SeqID_87695
  Gene Ontology: Mol. function=3'-5'-exoribonuclease activity; Cellular component=cytoplasm; Biological process=embryonic development ending in birth or egg hatching
  Homolog annotation: Hit_ID=A7PKH9; Match level="QueryCoverage=98%, HitCoverage=89%, E-value=0.0, Identity=58%"; Hit description =Chromosome chr15 scaffold_19, whole genome shotgun sequence
  Pfam annotation: Domain name=Not1; Domain location=1295-1487; Score =65.9; E_value=1.3e-16; Accession=PF04054.6; Description=CCR4-Not complex component, Not1
MEDTQHEPILGAVIKHLLGKLNFSTVFSESMRNIEINESFLESFCNRLQLSLLEKIVIGLALSDSENPDARLCARIEELCANPSSLSYHEQIHNIIMFLKQSEGLSKHVDSFMQILSLVQFKDTPPFFLTRLLPDEMNEADFLRNMELLHDSGENDFDAILADIQKEINIGDIVKELGYGCTVDVSGCKEILSLFLPLTDNALSKLLGAIAYSNTGLEDNQNTYLTFRAAHGYNVSELPLLNSWNIDVLIDTVKQLAPQTNWIRVIENLDHEGFFLPCEEAFFFLMSVYKHACKEPFPLHAICGSVWKNTEGQLSFLKYAVSALPEMFTFARSGRQLAYVDAVNYHKHQNEHANNAWLCLDLLDVLCLLAEKGHTSIVRSILDYPLKHCPEVLLLGMAHINTAYNLLQREVSLIVFPMIVKSPAGSGIILQLWHVNPNLVLRGLMDSQNNDADSIIRIVDICQELKILSSVVEIIPSYYSIRLAAFASRKEFLDLEKWLSRNLTTYKDVFFEECLGFLKDAHFGGSQNLSGKSFHQSGAVLSLCVETTATFLKVLKSHTDLVTSRQHSEELERLHISIIDCSQLHSAVSTSSMPSSRGFVCPSRGATSISIFLLTIHCVPLICASDVGFGSALNIETLAAAAEKRETPIEAPGSEVQDKISLMINNTFAANIDSKAKEFTEILKEQYYPWFAQYMGIYTVKIEDSDYTWGFMNSMIEADREQEVIKTQDLKELLGELEMDASIEPNFHDLYLKFLDKVNSKALNKEIIQATYENCKVLLGSELIKSSSEERSLLKNLGSWLGKLTIGRNQVLKAREIDPKSLIIEAYEKGLMIAVIPFISKILKSCQSSIAYEPSNPWTKGILRLLVEIYSMPNLKMNLMFDIEVLLKHLGVDMMDVTPTSLLLKDRKREMEGNPDFSNKDVGASSKMIIDLKCGPVPPVNEAELPLVVTNPSNTGAHPHVVSQYAGPLHISSGALMEDEKFTPLGLSDQLSSAQVLLQATPASAPISISRLPIQIPDIGTRAIINEKLGGFGLQMYFNRASPGAAVKLCLGDLLVMGSNPETASLHMQGQLRNSLQNLNITNEILEQAMQLVTNDNIDLGFAVIEQVAADKAKNTIDTEITQQLFLRRKHREGFSSTFFYANKEEFKGVDSVEPDPSGFCKQVAVLFKEWYRICEFPGANDTASAHFILQLHQNGLLKGDDVTDHFFRQLMELAIAHCLSTEVINLGSLQSQPPTMSFLAIDIYAKLVFSILKGSNELVLLSKIMAVTVRFIIKDAEEKNALFNPRPVFRLFINWLLDLGLLEPVTDGANLQILTVFANAFHALQPLKVPAFRSFMPKMLTGNGQKGWPYIQRLLVDLFQFMEPFLRHAELGEPVRVLYKGTLRVLLVLLHDFPEFLCDYHFTFCDVIPSSCIQMRNIILSACPRSMRLPDPSTPKLKIDLLQEINQSPSILSEVDAALKAKQIKTHVDEYLKACPHPSLNWFVIN

SEQ ID NO: 179381 - protein, 278 aa, Glycine max
  Coding DNA Sequence Number=SeqID_87696
MSPTRRMVSGATWPAKELRDIWVGVIRVKNGYIRKGRVILIRNEEKKPRGATMPSMEFLLTVEAKSPLSAGGNLLRGQALPSVRWWAIRWWKEGGKVGEGGGLGFLKGGERGGVDNGGSRVGGRARPRRLAHVGELLLLETCEARGLDQSGWLMGLDLPSNLRYQTGDEATKEKGRGQASSAVGEILEVRKILGHGARLGTGCGGGRGGGVGGVEEKAGETRWRSSSIFMATEGILKLVGGEGGSIGIRHGKEQREHQIDRSARALQLASRARTSEKG

SEQ ID NO: 179382 - protein, 127 aa, Glycine max
  Coding DNA Sequence Number=SeqID_87697
  Gene Ontology: Mol. function=zinc ion binding
  Homolog annotation: Hit_ID=A9PG29; Match level="QueryCoverage=100%, HitCoverage=100%, E-value=1e-44, Identity=69%"; Hit description =Putative uncharacterized protein
  Pfam annotation: Domain name=PHD; Domain location=7-54; Score=1.7; E _value=0.0084; Accession=PF00628.20; Description=PHD-finger
MVDLQTVCCMCGDVGFPDKLFRCNKCRHRFQHSYCSNYYGELSEIELCDWCQSEGRNYSRSHSSNSKKLAVAGNDAGTTTRSEYSGEKIKHHDRDQEMSGSSEKGKSPVPSPRTSTRRYKLLKDVMC

SEQ ID NO: 179383 - protein, 115 aa, Glycine max
  Coding DNA Sequence Number=SeqID_87698
  Homolog annotation: Hit_ID=A5BP71; Match level="QueryCoverage=65%, HitCoverage=19%, E-value=1e-11, Identity=45%"; Hit description =Putative uncharacterized protein
  Pfam annotation: Domain name=zf-CCHC; Domain location=88-105; Score =18.9; E_value=0.0021; Accession=PF00098.14; Description=Zinc knuckle
MAIIVNAEACGYVSMNYYQYIDIVYTNEHILKAYSAQWWPLGNEAAFPPSDDAWTLIPDPTTIRAKGRPKSTRIRNEMDWLEPSDHRQKCSRCGAEGHNRRRCPMQSDRGSNSFN

SEQ ID NO: 179384 - protein, 106 aa, Glycine max
  Coding DNA Sequence Number=SeqID_87699
NLWRIRAHTKLEGRKHNKHKKLTLKKKEKGELSNLKEKCTSIYADEHFFIELWHLQNCTVHDVKVSRRKQWRHCLRGRLLAIGSSDTTCFSPVGAARQRPHQLSRH

SEQ ID NO: 179385 - protein, 45 aa, Glycine max
  Coding DNA Sequence Number=SeqID_87700
MKLFQSETIEGSETRWWVWCGVEVVLSGCDGGVWVWQWCWVEVIS

SEQ ID NO: 179386 - protein, 342 aa, Glycine max
  Coding DNA Sequence Number=SeqID_87701
  Gene Ontology: Mol. function=metal ion binding; Cellular component =nucleus; Biological process=regulation of transcription, DNA -dependent
  Homolog annotation: Hit_ID=A7PKG5; Match level="QueryCoverage=63%, HitCoverage=70%, E-value=2e-51, Identity=52%"; Hit description =Chromosome chr15 scaffold_19, whole genome shotgun sequence
  Pfam annotation: Domain name=SBP; Domain location=159-237; Score =169.6; E_value=8.4e-48; Accession=PF03110.5; Description=SBP domain
MEFGENNMFSLNTHTKEENGNTGGNSNNNNIVNVWYSSWDATTTTNAPHTTTAAEGYAGGGHRLHHHQLYGGEGCHVQADPHLTCLHLGKRHYFEDATNGDDANNVTSLGNRHVCGGGGAGFVFAGNDKRARGYYGGGGGGAGGGGGGGKSAPFAMVPRCQVEGCHVALVNAKEYHRRHRVCDKHSKAPKAVVLGLEQRFCQQCSRFHVVSEFDDSKRSCRRRLAGHNERRRKSSHLSVTRNSRQGCALSLLSSGSSSENWLSHHADFSTRCSAALRELIAENRAALITRQQQLVYDRDWPHVVPHHDAAVEEEEEDFEDLQQQQQPPEPNYFPQQHMFPQT

SEQ ID NO: 179387 - protein, 78 aa, Glycine max
  Coding DNA Sequence Number=SeqID_87702
MEAPLSETSWKLRERSNVVTRKEKINSFGEPKRCQDLILTKGVLKAINTLRDDYSCVHDFIVIDVPLWFLKGIAPPNL

SEQ ID NO: 179388 - protein, 98 aa, Glycine max
  Coding DNA Sequence Number=SeqID_87703
LCAKDRATGLEAENALDADDIMSKEANEEEAIHSVSIDLEGSSSATRKNIRPSKSEEKEEMISSMKEVAMSLKEFVEVAKKMENKKKDGEKRSSRSGT

SEQ ID NO: 179389 - protein, 217 aa, Glycine max
  Coding DNA Sequence Number=SeqID_87704
  Gene Ontology: Mol. function=endonuclease activity
  Homolog annotation: Hit_ID=Q2HUP4; Match level="QueryCoverage=68%, HitCoverage=51%, E-value=6e-49, Identity=65%"; Hit description =Endonuclease/exonuclease/phosphatase
MANLVPAFTFVIAACIGMEIVDIRSFRSIAKIVGTVMPKQFDHQKPLWALEEITGCWIVSLSLDPQLSVSKEQGPLHRRPDVVKSKQGFPHFRERVWVKKLVHDRRIRFGTWNIDTLTGKSMEIVDVMVRRKINFMCLQETKWTGEKAKKLDNSGFKLWYTGKIRSRNGVGIIVDKEWKKDVVDVRRVGDRIIALKLVVGQDTFNVISGYAPQVGLA

SEQ ID NO: 179390 - protein, 343 aa, Glycine max
  Coding DNA Sequence Number=SeqID_87705
  Gene Ontology: Mol. function=molecular_function; Cellular component =membrane; Biological process=auxin mediated signaling pathway
  Homolog annotation: Hit_ID=A7PFH8; Match level="QueryCoverage=98%, HitCoverage=99%, E-value=2e-93, Identity=55%"; Hit description =Chromosome chr11 scaffold_14, whole genome shotgun sequence
  Pfam annotation: Domain name=DUF6; Domain location=156-285; Score =35.9; E_value=1.5e-07; Accession=PF00892.11; Description=Integral membrane protein DUF6
  Pfam annotation: Domain name=DUF6; Domain location=8-119; Score=0.3; E_value=0.066; Accession=PF00892.11; Description=Integral membrane protein DUF6
  Pfam annotation: Domain name=TPT; Domain location=147-285; Score= -38.1; E_value=0.099; Accession=PF03151.7; Description=Triose -phosphate Transporter family
  Pfam module annotation: Pfam domain module=DUF6::DUF6::TPT; Domain location=156-285::8-119::147-285
  Subcellular localization annotation: CTP_CleavageSite=14; ConfidenceScore=5.14e-01
MAMLFNQSIYAGISLSTRVAFLQGMSPRVFVVYRHAFATIVIAPIAYFSGITLNQNLFFEGLYLASSSVASAMANLVPAVTFIIAACAGMEKVNIRSTRSLAKIIGTVICVSGAVSMALLKGPKLLNAEILPSKSIMASGGDHWLLGCLFLTGCCCAWSVWLILMVPASTSHPDHLSFSAWMCFMATLQSTLVTLLLEPDPHAWKINSLLEFGCTLYSGVIGSAVLLFIQAWCISLRGPLFCAMFNPLFTVIVTILAALLLHEEIYSGSLIGSTGVIIGLYVVHWGKAEKVSEANVKLTDPKSMVNSTEDVKILINGSSSVKACCKTNNLEEPLLSADSPSHR

SEQ ID NO: 179391 - protein, 156 aa, Glycine max
  Coding DNA Sequence Number=SeqID_87706
  Gene Ontology: Mol. function=serine-type endopeptidase activity; Cellular component=chloroplast; Biological process=response to stress
  Homolog annotation: Hit_ID=A9PI52; Match level="QueryCoverage=48%, HitCoverage=17%, E-value=4e-24, Identity=78%"; Hit description =Putative uncharacterized protein
MPSVTIAKCSALQVTRTKFYYNSGWLLLDSSGKLIGINISIYSPSRASSGVGFCILVDIVNGIVDQLVKFGKITRHILGIKFAPDQFVDQLGVSAVRWRKSLIKILGPENVGIHGDIYIIALDMAGGQFNWSDVYREAKQVADVLAKFGFFIEGQG

SEQ ID NO: 179392 - protein, 213 aa, Glycine max
  Coding DNA Sequence Number=SeqID_87707
  Homolog annotation: Hit_ID=A7QYM8; Match level="QueryCoverage=17%, HitCoverage=17%, E-value=2e-09, Identity=78%"; Hit description =Chromosome undetermined scaffold_252, whole genome shotgun sequence
MTFYDSHSMTTLGLQPACFKPLTHSLTHVYHFPHHGRVLPPLFSLLTFHDNSLVYQSNADPDLLAAFETGDAELLYEIRLLSASQRVAAARFLVENRCDGKELVGTKDFDVGHGGDKGDDKCDFGGVGGEGGGCDACSGGEAEDWGGGEGEFNGVVVGLRDGGEGDFGGMHNKLMDTNAQLWYIIKEYISNFEDRGVDAADLISFMLESVFMT

SEQ ID NO: 179393 - protein, 299 aa, Glycine max
  Coding DNA Sequence Number=SeqID_87708
MPPAITATYTTRAISPVLTARCSTYIMNSIITVLYFNGRVYEDNDSVIFEGSKKAIQIKHGISFNALKKKLEIRFLVSGKYVALQICDDEDVETMIESFQQQQQISVLELYVEKDVAGGSIFHVANSVTSCGRNVSHHESELPRNISNLHVDEDDDDDDDYLASNSYVEESFDEDDSDDGISDIDDEVTDIVEPVSIVHPSEGVPEIQNPFWNDAMHYNNINWSHPNEEDICGLDMPTTFNVGQELYVGMNFDSKDAVKNALKQYVMKVHQSFKVVETKSHKYIVCCPNNTEESPCPFI

SEQ ID NO: 179394 - protein, 656 aa, Glycine max
  Coding DNA Sequence Number=SeqID_87709
  Gene Ontology: Mol. function=alpha-N-arabinofuranosidase activity; Cellular component=extracellular region; Biological process=L -arabinose metabolic process
  Homolog annotation: Hit_ID=A0ZNJ6; Match level="QueryCoverage=98%, HitCoverage=92%, E-value=0.0, Identity=69%"; Hit description=Alpha -Arabinosidase1
  Pfam annotation: Domain name=Alpha-L-AF_C; Domain location=412-630; Score=135.4; E_value=1.6e-37; Accession=PF06964.3; Description=Alpha- L-arabinofuranosidase C-terminus
  Pfam annotation: Domain name=CBM_4_9; Domain location=30-192; Score= -1.0; E_value=0.0034; Accession=PF02018.8; Description=Carbohydrate binding domain
  Pfam module annotation: Pfam domain module=Alpha-L-AF_C::CBM_4_9; Domain location=412-630::30-192
MPLIQISENDQFMEFHLQEINHAGAGGLWAELVSNRAGGPNTPSNIDPWSIIGNESLINIETDRTSCFDRNKVALRLEVLCDSKGDNICPADGVGVYNPGFWGMNIEQGKKYKVVFYVRSTESLNLTVSLTGSNGVGNLASSVITGSALDFSNWTKVEKILVAKATDHNSRLQLTTTTKGVIWLDQVSAMPLDTYKGHGFRTDLVEMLTALKPRFIRFPGEWLRNAFRWKASVGPWEERPGHFGDVWMYWTDDGLGYYEFLQQLAEDLGTAPIWVFNNGVSHNDQVDTSAVLPLVQEALDGLEFARGDRTSKWGSLRAAMGHPAPFDLRYVAVGNEDCGKKNYRGNYLKFYSAIKSAYPDIQIISNCDGSSRPLDHPADMYDYHVYTNANDMFSRANAFDHTSRNGPKAFVSEYAVTGKDAGTGSLLAALAEAGFLIGLEKNSDVIQMASYAPLFVNANDRRWNPDAIVFNSFQLYGTPSYWVQVFFSESSGATLLSTSLQAPSSNSLVASAITFQNSVDKKNYIRIKGFCVLFRLAPGSQDLMVLPVCLYLVILVPLVVNFGTTAVNLKISLDGLEPNSLQLSGSTKTVLTSANVMDENSFSQPKKVVPIQSLLQNVGKDMNVTVPPRSFTSFDLVKQSSTLKMAGSDSSTRSSI

SEQ ID NO: 179395 - protein, 194 aa, Glycine max
  Coding DNA Sequence Number=SeqID_87710
  Gene Ontology: Mol. function=alpha-N-arabinofuranosidase activity; Biological process=L-arabinose metabolic process
  Homolog annotation: Hit_ID=A0ZNJ6; Match level="QueryCoverage=98%, HitCoverage=31%, E-value=7e-49, Identity=49%"; Hit description=Alpha- Arabinosidase1
  Pfam annotation: Domain name=Alpha-L-AF_C; Domain location=21-189; Score=65.6; E_value=1.7e-16; Accession=PF06964.3; Description=Alpha -L-arabinofuranosidase C-terminus
MFNNAHVFDKTPRNGPKAFVSEYALIGDIQAKHGTLLGAVSEAGFLIGLERNRWSPAAIVFNSNQVYGTPSYWVQFMFRESNGATFLKSQLQTPDPDSVAASAILWKNLQDKKTYLKIKVANVGSNQINFKISLNGFESSNATKATKTVLTSKNALDENSLANPTNIVPKRSPLQSANNEINDILPPVSLTITV

SEQ ID NO: 179396 - protein, 74 aa, Glycine max
  Coding DNA Sequence Number=SeqID_87711
MTCVNSSLRLRWSMIIVRQWPRRYCRYFFTVAIIANSSRTTAPIPTLEASVSMVKGSLKSDKAKIGAWDRACLS

SEQ ID NO: 179397 - protein, 19 aa, Glycine max
  Coding DNA Sequence Number=SeqID_87712
MVSKVKVEGLEKRMRRGWG

SEQ ID NO: 179398 - protein, 483 aa, Glycine max
  Coding DNA Sequence Number=SeqID_87713
  Gene Ontology: Mol. function=heat shock protein binding; Cellular component=membrane; Biological process=protein folding
  Homolog annotation: Hit_ID=O24074; Match level="QueryCoverage=100%, HitCoverage=100%, E-value=1e-177, Identity=68%"; Hit description =DnaJ-like protein
  Pfam annotation: Domain name=DnaJ; Domain location=14-72; Score =127.0; E_value=5.7e-35; Accession=PF00226.22; Description=DnaJ domain
  Pfam annotation: Domain name=DnaJ_C; Domain location=298-424; Score =54.3; E_value=4.3e-13; Accession=PF01556.9; Description=DnaJ C terminal region
  Pfam annotation: Domain name=DnaJ_CXXCXGXG; Domain location=218-285; Score=63.8; E_value=5.9e-16; Accession=PF00684.10; Description=DnaJ central domain (4 repeats)
  Pfam module annotation: Pfam domain module=DnaJ::DnaJ_C::DnaJ _CXXCXGXG; Domain location=14-72::298-424::218-285
MFGRGGPRRSDNSKYYDILGISKNASEDEIKKAYRKAAMKNHPDKGGDPEKFKELGQAYEVLSDPEKKELYDQYGEDALKEGMGGGGSFHNPFDIFESFFGGASFGGGGSSRGRRQKHGEDVVHSLKVSLEDVYNGTTKKLSLSRNILCPKCKGAIVLHCKLDCHSIKSWASLYPSMFEVEVEHSINGNSSHLVTCYTISVLGLACLSHYLVLITVWKGSKSGTAGRCFGCKGTGMKITRRQIGLGMIQQMQHVCPDCRGSGEVINERDKCPLCKGNKVSQEKKVLEVHVEKGMQQGQKIVFEGQADEAPDTITGDIVFVLQVKDHPKFRREQDDLYIDHNLSLTEALCGFQFAVKHLDGRQLLIKSNPGEVIKPGQYKAINDEGMPQHNRPFMKGRLYIQFNVDFPDSGFLSPDQCQLLEKVLPQKSSKHVSDMELDDCEETTLHDVNFKEEMRRKQQQQYREAYDEDDDEPSGQRVQCAQQ

SEQ ID NO: 179399 - protein, 87 aa, Glycine max
  Coding DNA Sequence Number=SeqID_87714
MRKLGLPDVFGKIVFDEFLVLVLVKAYEDGEIVRFGARFEVKHHRVVLLCFHTHGKKQVGCVGAQEEGVGWGLDAEPLLLTLRGIGA

SEQ ID NO: 179400 - protein, 123 aa, Glycine max
  Coding DNA Sequence Number=SeqID_87715
MLQPYGINIGLKEHSNPVTPKAYTPKSPSGPLPPDSGNLRFLFNIAHLHFSQDNTGRIKITIGENARNWAANIVLKLHNDPTVNEPEIVVFLRHVRWPAGKRGSFGRRKKKRNCEVEENEESV

SEQ ID NO: 179401 - protein, 93 aa, Glycine max
  Coding DNA Sequence Number=SeqID_87716
SELFLVRQLPNDVHLYLPQLPLVVLRGRFGDSGVPMEELAVECIGDGEDEERAGSEGEEAMEELGGEREHVGEVCEDPREEKEGEAKFKNVKG

SEQ ID NO: 179402 - protein, 100 aa, Glycine max
  Coding DNA Sequence Number=SeqID_87717
  Subcellular localization annotation: CTP_CleavageSite=17; ConfidenceScore=5.32e-01
MGLGAVPSNTFRNTRLRAFSLSSSSSGVAFPSSNQGQEKYKNLESVFKTYMIIKEGRIPKELASYFTPDQTHRHTPASGAVAAPERTVYSAAGEDVGEDI

SEQ ID NO: 179403 - protein, 536 aa, Glycine max
  Coding DNA Sequence Number=SeqID_87718
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=82%, E-value=1e-114, Identity=43%"; Hit description =Glucosyltransferase-13
  Pfam annotation: Domain name=UDPGT; Domain location=53-535; Score= -51.0; E_value=4.9e-08; Accession=PF00201.9; Description=UDP -glucoronosyl and UDP-glucosyl transferase
MEKKTCIAMVPCPGLSHLIPLVEFAKTLVHQHQHFHVKFIVPTLGPPTPSTKAILNSLPSNINFTILPQVNLQDLPPNIHIATQMKLTVKHSLPFLHQALTSLNSCTHLVAFVCDLFSSDALQIAKDFNLMTYFFSASGATSLSFCLTLPQLDKSVTSEFIIDATKRVSFPGCGVPFHVKDLPDPVVLCGRSSETYKAFLRVCQRLSLVDGVIINTFADLEEDALRAMEENGRELDLTEEISFSQHIHNGLQSESLSKEMSIFNTPPSIKQNDHEKAIDIEEREKAQAKANSPCVYYYPVGPIIQSESRSKQNESKCIAWLENQPPKAVLFVSFGSGGTLSLDQLNEIAFGLELSGHKFLWVVRVPNDVSCSAYFVRQKDDPLGYMPCGFLERVKAKGQGLVVPSWAPQVEVLRHESTGGFLTHCGWSSVLEGVVHGVPMIAWPLYAEQRMNATTISDLLKVAVRPKVDCESGIVKREEVARVIKVVMKGDDESLQMRKRIEGFSVAAANAISEHGSSTMALSSLAFKWQSCSRKS

SEQ ID NO: 179404 - protein, 83 aa, Glycine max
  Coding DNA Sequence Number=SeqID_87719
MSVPDLILLSTFRTVERNELVSEIGLLKKEAERSLDELTRMKNLKYEKEMAVYIYNVFDIPPQHLLEEVLPKVIMQVSKTKSL

SEQ ID NO: 179405 - protein, 601 aa, Glycine max
  Coding DNA Sequence Number=SeqID_87720
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=80%, E-value=1e-132, Identity=52%"; Hit description =Glucosyltransferase-13
  Pfam annotation: Domain name=UDPGT; Domain location=5-437; Score= -111.1; E_value=5.2e-05; Accession=PF00201.9; Description=UDP -glucoronosyl and UDP-glucosyl transferase
  Subcellular localization annotation: CTP_CleavageSite=84; ConfidenceScore=5.02e-01
MEKITHIAVVPGPGFSHLIPILEFSKRLVKLHPLLHVTAFIPTLGSLSSVSKSFLKTLSPSITPTFLPPVDPIDIPQGLETAIRMQLTVTYSLPSLHNALKSLTSRTPLVALVVDNFAYEALDFAKEFNMLSYIYFPKSAFTLSMYFHLPKLDEDTSCEFKDLPEPIQMPGCVPIHGLDLHHQIQDRSSQGYELFLQRVKRFCTVDGIFINSFIEMEKEPIRALAKEWNGYPPVYPIGPIIQTGIESDGPIELDCIKWLDKQQPKSVLYVSFGSAPSSSASSAYLSGQNENPLEFLPYGFLERTKGQGLVILSWAPQIEILSHSSIGGFMSHCGWNSTLESVLQGVPLIAWPLFAEQRMNAVMLSDDLKVALRLKGNGNGVVEKEEVAEVIKSLMEIESGKMRKIMKRLKEAAINAIKEDGPFVQNESCNDQGSDTKCLRWLDKQQHNSVLYASFGSGGTLSQEQINELAWGLELSGQRFLWTTQGRGWVVPYWAYQIQILAHGAIGGFICHGGWNSTIEGVVQGIPLIAWQLFAGQKMNAVLLTEGLKVALRANVNQNGIVEREEIGRVIKKQMVGEEGEGIRQRMKKLKGVAADACIEG

SEQ ID NO: 179406 - protein, 67 aa, Glycine max
  Coding DNA Sequence Number=SeqID_87721
  Gene Ontology: Mol. function=metalloendopeptidase activity; Biological process=proteolysis
  Homolog annotation: Hit_ID=A7NY13; Match level="QueryCoverage=88%, HitCoverage=5%, E-value=2e-12, Identity=55%"; Hit description =Chromosome chr6 scaffold_3, whole genome shotgun sequence
MGDAQGHQSSNGKRRMLHSFVYQYLKLLREDTPPAWIFKEIQNIGNMDFRFVEEQPPHDHAVELAGK

SEQ ID NO: 179407 - protein, 127 aa, Glycine max
  Coding DNA Sequence Number=SeqID_87722
MKDKYIVLSLLKNLEKIKNKLVRTSFACMISTRQVCGYVSMNYYQYIDVVYTNEHILKAYSAQWWPLGNEVAIPPSDDAWTLILDPTTIRAKGQPKSTRIRNEMDWLEPSDHRQKCSRYGAEGHNRR

SEQ ID NO: 179408 - protein, 146 aa, Glycine max
  Coding DNA Sequence Number=SeqID_87723
MSGAGRGKADPVGDGDGVNIHPRWVLGAGAGREMGSRELHPYNQYEEERTLNLESVFAEFTAYHASSTTNQNSMQNEDICVGASYSMENYQWEKELQPYNQYEEERSSNMDNLLMQFKETTESTQRAFKSLEIEVGKLAEEVAKTL

SEQ ID NO: 179409 - protein, 229 aa, Glycine max
  Coding DNA Sequence Number=SeqID_87724
  Gene Ontology: Mol. function=calcium ion binding; Cellular component =oxygen evolving complex; Biological process=photosynthesis
  Homolog annotation: Hit_ID=Q5PYQ5; Match level="QueryCoverage=56%, HitCoverage=56%, E-value=9e-56, Identity=84%"; Hit description =Chloroplast oxygen-evolving enhancer protein
  Pfam annotation: Domain name=PsbQ; Domain location=1-140; Score =188.7; E_value=1.5e-53; Accession=PF05757.2; Description=Oxygen evolving enhancer protein 3 (PsbQ)
MVGVLWNMAAGTLNSDEPRDLKLPLKDRFFLQPLSPTDAAQRAKESAKEIVGVKKLIEKKAWPYVQNDLRLRAEYLRFDLNTVIAAKPKDEKKSLKELTGKLFQDISNLDHAAKIKSSPEAEKYYAATVSSLNDVLAKLDTLLTDILRKSNDEGKFSINKINISRPLLSCLSKTKRNTRCRMKDEMKLEKIDGSNMKKRSKKYINKLSWNTSVHNEANPDITRVYNILK

SEQ ID NO: 179410 - protein, 566 aa, Glycine max
  Coding DNA Sequence Number=SeqID_87725
  Gene Ontology: Cellular component=plastid chromosome
  Homolog annotation: Hit_ID=A7PKD7; Match level="QueryCoverage=94%, HitCoverage=93%, E-value=1e-134, Identity=47%"; Hit description =Chromosome chr15 scaffold_19, whole genome shotgun sequence
  Pfam annotation: Domain name=mTERF; Domain location=205-541; Score= -18.1; E_value=6.4e-07; Accession=PF02536.5; Description=mTERF
MSLLRHVCTTSKLSAAAAASTATMAIPWKYKKFAISQGQKSLTDYLHATRSIPYAYANQIAKNSLTSLTTLITTLGTSSFSPLHFPHNLNKFLMYHPINEFEFFFESIGIHPSNFHSLLPQDKFFFSQDDTLLSAACVLYEFGFPWDRLGVLYVESGCFLNWGASELKDRVCGFKRYGLCNEQVVGVCMAFPFVFDGQKGDDEVEALFRDLGLLFGEFGLAECVEGKGNYSVDDWIRVCRKIRLFYDLNGGKSLVELIGRNNGGGVGVIVEHGEEELVQAAEYFCRFGAKKEDVARLIVDGPELLELDLEAWVVDVVKLLKYFGMRSDDVEDVRRDYAHVLGTVKMGNLPNVMRALGLREWFFDKIKDGNHQLLVSFVTSCPGEFQDEGYLGRLKAIKASRTPTHNISKLNFLHAIGFGENALTMNVYAQMHGTSGKLQKRFNCLLRLGIEFSKICKMITIHPKILSQNPQNLEQKVNFFCQEMGYSLEHLITFPAFLCFDLENRIKPRYRFHMWIMEKGLSSKNYSITSMVATSDKNFVARALKIHPAALKHWFEQFYLRNLPVQ

SEQ ID NO: 179411 - protein, 279 aa, Glycine max
  Coding DNA Sequence Number=SeqID_87726
MQNPEANDREKTVENALLETLDALATSACLVAAPSSTVDVPLLSVGVATTSAPTISPPLSSAPPVPPFAMLASVSPSSFSCPHVSLDHLYTSNNVDSLWGENYKLKQKTSIGFIWGGECYGFYQNFPPEKFGDFGGEWTMTPRGSTQGGILGDRGCQMEGYCSHSLKSGAPQVREKGLGKVEHIAAKRDELAKVVVELEARLKELMSKLEESEANKEVVEQHEKGFQKAVRQARFFAKDLDFGLFYPFKDVNDGVLLYEEDIVAEEEASEEQDANDVDV

SEQ ID NO: 179412 - protein, 701 aa, Glycine max
  Coding DNA Sequence Number=SeqID_87727
  Gene Ontology: Mol. function=unfolded protein binding; Cellular component=cytoplasm; Biological process=response to stress
  Homolog annotation: Hit_ID=A8IXR4; Match level="QueryCoverage=49%, HitCoverage=66%, E-value=1e-112, Identity=57%"; Hit description=Heat shock protein 81-4
  Pfam annotation: Domain name=GDI; Domain location=1-340; Score=195.1; E_value=1.7e-55; Accession=PF00996.9; Description=GDP dissociation inhibitor
  Pfam annotation: Domain name=HSP90; Domain location=277-697; Score =396.7; E_value=3.5e-116; Accession=PF00183.9; Description=Hsp90 protein
  Pfam annotation: Domain name=tRNA-synt_2b; Domain location=147-329; Score=20.7; E_value=1.4e-06; Accession=PF00587.16; Description=tRNA synthetase class II core domain (G, H, P, S and T)
  Pfam module annotation: Pfam domain module=GDI::HSP90::tRNA-synt_2b; Domain location=1-340::277-697::147-329
MDEEYDVNMLGTGLKECILNGLLSVVGLRRFRGDDKSLLYLGTSRDYNIHMNPKFIMANGNLVRVLIHANVTKYLYFKAVDGSYVFNKGKVHKVPANDMETLKSLLMGLFAKHWTHKFFIYVQKYNESDPKTHEGDDRYLAELALDIVKRIKLYAESLVHFQGGSPYIYPLYGLGELPQAFSQLSVVYGETYMLNKPECKVEFDEEGKIVGVTSEGELLFLRYDLTIPFARFVAMNGLTSFKRYQIAKVYRVNNSSKGRYREFYQCDFDTAGNPSVSEIMGPDFEVVRILTELVNELDIGECEIKLNDRKLLDGMLQIRRVPRENFRTICSNIDKLDKQSFQQLRKEMVAEKGLTAETTNRIETEEHLPVKNFSVAGHQEFKVVLFIPMRAPFNLFDTRKNPNKIKLYVLRVFIMDNCKELMPKYLSFVKEMLQQNKILKLVKKCIEMFFEIVENKKDYNRFYEAFLKYLKLGIHEVSHNKTKLVELLRYHPTKNGDEMTSLKDYVTRMKEGQNDIYYITGESKKVVENSPFLEKLKKKGYEVLYMVDAIDEYVEGMKLDESEDEKKKKEELKEKFEGLCHVIKDVLVTSTNMERIMKAQALRNSSMSGQMSSKKTMEINPDNGIMEELRKRVEADKNGKSVKDHVLLLFETTLLTPSFSLDDPNTFALVWKSLYNIKGKVVFFQQRVLIAIAHKSTGPRG

SEQ ID NO: 179413 - protein, 358 aa, Glycine max
  Coding DNA Sequence Number=SeqID_87728
  Homolog annotation: Hit_ID=A7QAS4; Match level="QueryCoverage=82%, HitCoverage=60%, E-value=3e-27, Identity=30%"; Hit description =Chromosome chr5 scaffold_72, whole genome shotgun sequence
MEVRCGLRAVMACTATEAFGSLAGNVKEKKMKQLQSQARKYEKELAAYNHSKQLDLAHFTLEDSNIKSIPISDRMHRNKVMKRNKRKRVEEQCDIESYMSNHSLFSYYEKTDCTADTCLKDVCDVGIGGVNDSNQEFKLNDEWSSEEYGNVDKSLDDIIQKIEAIQSEVQQLKTRTDKVISESCGKFCSITQFSMRGRSDGFNHFDSTFTSNENTLPFSFPRSSSQLESEFHMGDLLMPGNASASREVMIPCIVTTDGPELDDPLKDTKDEVLIHNQVAKEEWHDFIDYDGTKDSIEEGKFSFDVQVSEPDPHENEVKLNPIGMVIQQVEGIENFSNKLQYACVVLRKFWLFVLYFFS

SEQ ID NO: 179414 - protein, 385 aa, Glycine max
  Coding DNA Sequence Number=SeqID_87729
  Gene Ontology: Mol. function=sulfotransferase activity; Cellular component=integral to membrane
  Homolog annotation: Hit_ID=A7QSR6; Match level="QueryCoverage=93%, HitCoverage=84%, E-value=8e-85, Identity=46%"; Hit description =Chromosome chr4 scaffold_162, whole genome shotgun sequence
  Pfam annotation: Domain name=Mem_trans; Domain location=9-384; Score =179.7; E_value=7.5e-51; Accession=PF03547.9; Description=Membrane transport protein
MDFWKLFIVALLPVLKVLLITAVGTILAINRLNILGETARKNLNTMVFYVFSPTLVCSSLAETITLENVLILWFMPVNILLTFVIGSVLGLLVVKLTRVPHHLQGLVLGCCAAGNLGNLPIILVPAVCKQSGSPFGDVNVCYKNALAYASLSMALGSVYIWSYAYNLVRLYSPKISNEVKVDDNSVVENPVSTTKSDPENPSTFSTELPFVSADDRSQTEDHVKHFEIQCTGHNGQVEEVSKNRTIMNHLIILVQKVNLKVLFTPSTIGAIIGLIIGVVPQFRKLLVGDNATLRVVEDSVIMVGYACIPVMTLLVGANLIKGLNGLGKQLPLIIGVTMVRCIVLPAIGIGVVKGVVRLGLIHPDPLYEFLLLLQFALPPAVAMSK

SEQ ID NO: 179415 - protein, 101 aa, Glycine max
  Coding DNA Sequence Number=SeqID_87730
MNINWGRSKKGCETTVHGTVICIYWLVVVALKMLNSGTERTLLTLALRVEVWQLQVLLLLSSVYLVFPEPSPTLPEGIFLEPQYVAAGVFAPEYGVRWVFS

SEQ ID NO: 179416 - protein, 57 aa, Glycine max
  Coding DNA Sequence Number=SeqID_87731
MVPVDRLDATPITIDHFRYCYIPWRFMSRVTTGVVTENWRDHIDMMLEEEEEYHKLL

SEQ ID NO: 179417 - protein, 128 aa, Glycine max
  Coding DNA Sequence Number=SeqID_87732
MMHMRKRVRFVPLFKGPTWEGAKGPLVIIPKVVISLLMVSRGIIIFEKHIAAVGTTSKIMFSKRLLRVLYGRRHVLDVEAYCRNLPFGGRTTRDSQVRLPRKEYAWSRHQRLFEENVGKTGKDVIYEL

SEQ ID NO: 179418 - protein, 26 aa, Glycine max
  Coding DNA Sequence Number=SeqID_87733
MDAWQCDICGSKSGRGFGIHNVGRIS

SEQ ID NO: 179419 - protein, 116 aa, Glycine max
  Coding DNA Sequence Number=SeqID_87734
MPRQAQGDAPQAADAPPPPHQADPTGSLGMERYLQHLVRQQAANHRGQVQIHECLYQLSLNQQGQDQFRTEVAWPGDWPEAQAEEAPAGAPGDAEEAHMDEEMTDLLGFLGGSGAT

SEQ ID NO: 179420 - protein, 129 aa, Glycine max
  Coding DNA Sequence Number=SeqID_87735
MVLLTRHEESIKRVHLLGLLTKNKRGYISCGSVLVEGTSTRFKENKGGYIPCGSLLLVEAMQEMDFVGEAFVVEGAFSVGWASDWKEVRYWLSNCTGAGNIGKWGGEGFVGTLATWELQLRHGHLPPFS

SEQ ID NO: 179421 - protein, 219 aa, Glycine max
  Coding DNA Sequence Number=SeqID_87736
MLPQTDKRSFERWRYKHRGIHQTPLNPFKCHLTIIVPLDGLIFTQQFEKRLETSDLFLGVWLRHFEDCLYFFWIYHQPSSIWTILLKHQPSSIDQALYLVLEGYTLLDRVPRNTTMIGAGCIGIVPLGKRRLVDLPRAQHNHLVAEQSVEAKLHDESRLIQRCFDDNKDDDKGDDKKLKGQSKNEFKMFKIESRTLQDSRGKLKNTSRFKRKVKFKNQE

SEQ ID NO: 179422 - protein, 256 aa, Glycine max
  Coding DNA Sequence Number=SeqID_87737
  Gene Ontology: Mol. function=3-oxoacyl-[acyl-carrier-protein] synthase activity; Cellular component=mitochondrion; Biological process=fatty acid biosynthetic process
  Homolog annotation: Hit_ID=A7PXC0; Match level="QueryCoverage=65%, HitCoverage=59%, E-value=9e-42, Identity=45%"; Hit description =Chromosome chr12 scaffold_36, whole genome shotgun sequence
  Pfam annotation: Domain name=Ketoacyl-synt_C; Domain location=89-162; Score=31.8; E_value=8.1e-09; Accession=PF02801.13; Description=Beta -ketoacyl synthase, C-terminal do
MKKILGLQAPMELASISAHPQEKGPNHAAVPACAIGSHSIGDADVMVNGGTGSNIDALSIAGFRRIGEGSRVLVLEEFEHAKNRGAKIYAEVRGYGMPGDAYHITQPPSDGRGAILAMTRALRQQFFQGAIGHLLGAAGAVEAIFAVLAIRHGIAPLTLNLTKPNPMFGDGFMPLSALEEMPIRVAMSQSHEKSVSSLAFSYDGHCLESGGLDGIIKVKFGSFRNDVETPHSASVANSKMMCRSKLHDESITSDSF

SEQ ID NO: 179423 - protein, 209 aa, Glycine max
  Coding DNA Sequence Number=SeqID_87738
  Homolog annotation: Hit_ID=A5B5G7; Match level="QueryCoverage=99%, HitCoverage=14%, E-value=1e-08, Identity=26%"; Hit description =Putative uncharacterized protein
MASGKRKAKALVPQAKYDRSKFSSQEAWDRFTENILGWKILLERNVKLYVTELVEFRRELERRNWHKELINFADGSIDVAIVKEFYANLYDPEDKSPKQVRVRGHLIKFDSDALNTFFRTSVVIEEGESLPAYSRFAQLRPDLQELAARLCIPKRGFELNADRLPLKILRKNLTTLAQTWSVLSFSNLAPTSHTSDITLDRARLIYGII

SEQ ID NO: 179424 - protein, 118 aa, Glycine max
  Coding DNA Sequence Number=SeqID_87739
MSVKEFLLSVAWPGVQPSPSGGGEAYAAQEPQPEEEDDTIILEPTPPEPFTFEADTIIAQEDVASPEPFPQAEPSPSPSSEPEPSAPALVPNQSTSQDPSSAPVLDLNKHAEDHSQDD

SEQ ID NO: 179425 - protein, 148 aa, Glycine max
  Coding DNA Sequence Number=SeqID_87740
  Gene Ontology: Mol. function=glutathione-disulfide reductase activity; Cellular component=cytoplasm; Biological process =glutathione metabolic process
  Homolog annotation: Hit_ID=A7XTY5; Match level="QueryCoverage=49%, HitCoverage=13%, E-value=3e-24, Identity=75%"; Hit description=Dual -targeted glutathione reductase
MEEEIEYIHPILKRGVERKNQLGKRFHYLAPPFLSLPLPKSLLSLSTRHCTFTVHAESQNGVNLVSTHYDFNLFTIGADSDGVRAARLATNYGASVAICEFPFSTISSETTGGVDGTLVRKVRANQAFFSFPCYFIGKGVAAAKVVLK

SEQ ID NO: 179426 - protein, 38 aa, Glycine max
  Coding DNA Sequence Number=SeqID_87741
MNLVPELIPSNSVLYTIKRKEERAWKNQNKELFMAMAG

SEQ ID NO: 179427 - protein, 308 aa, Glycine max
  Coding DNA Sequence Number=SeqID_87742
MGENNNEFHAVATLPLKYLALQDLEWEGTLICLPPNLTSLSNNFTPKVLPLSMFPPSETTTTPVPPMLPSVEDTTYVQLNLQDQLSALQNINSGNNTHDYPQTQFLNRAAKKVAPVWPGSQSNHSLSVKGSSSKSNECRRWSEEEHRNMEKEIGKKFQESSKQETQLKLLLMPKSISFVKPQVIKAKEEAFMTWSYQIMVLSLTAFTSRMKFLFQILMSLSRTTLIIRMGFLFKIIQCRSYMKFIWQSLTTLINKIGFLDQCDKYIKSTGRDHIDDCSLTTLEAHLRNFFVFEGCIACLVYSRKFSDC

SEQ ID NO: 179428 - protein, 80 aa, Glycine max
  Coding DNA Sequence Number=SeqID_87743
GDLDTYCLVFLSESVVWTRLGYFLGDGTTLHLRVELVGLGSSSSMDSFASWKINGSGMEKEEREEMPLQGEDESRRSSPP

SEQ ID NO: 179429 - protein, 60 aa, Glycine max
  Coding DNA Sequence Number=SeqID_87744
MSHGRLYQQRIKNAFDKKGQDPLRQQSEVETRLKAETNQGAQGRTQGEARVTTHRSLSFA

SEQ ID NO: 179430 - protein, 318 aa, Glycine max
  Coding DNA Sequence Number=SeqID_87745
  Gene Ontology: Mol. function=sequence-specific DNA binding; Cellular component=intracellular; Biological process=regulation of transcription, DNA-dependent
  Homolog annotation: Hit_ID=A8G7X2; Match level="QueryCoverage=96%, HitCoverage=78%, E-value=1e-151, Identity=86%"; Hit description =Transcriptional regulator, AraC family
MQCATGLRERATMHEKRYRITLLFNANKVYDRQVVEGVGEYLQASQTDWDIFIEEDFRCRIDNIREWLGDGVIADYDDSSIESLLSNVPVPIVGVGGSYHRQQDYPPVHYIATDNAALVESAFLHLKEKGIHRFAFYGLPAASGKRWAQEREQAFRQLVMRERYQGVVYQGMETAPENWQHAQNRLADWLQTLPPQTGIIAVTDARARHLLQACEYLKIPVPEKLSVIGIDNEELTRYLSRVALSSVAQGTRQMGYQAAKLLHRLLDRQTLPLQRILVPPVKVIARRSTDFRSLRDPAVIQAMHYIRFNACKGIKVEQ

SEQ ID NO: 179431 - protein, 172 aa, Glycine max
  Coding DNA Sequence Number=SeqID_87746
MEAIKEQMATMIKAMMSMKKIMEANAVATAATRVVAKVNLMSPSGINQMNHPTSDMVGKDLGSTGSPHDVQIQNEHAFPSYGLPLNYTPPNVAYTPNKNTHEIPHHNLADFEPWLGYTTEGQAVGGIPLQNPLEGPQYHPQLHLLHSTAVKNPHDYGRNGKVGSSRGKAQGH

SEQ ID NO: 179432 - protein, 100 aa, Glycine max
  Coding DNA Sequence Number=SeqID_87747
MQLVGLQERCQSESCSEGWYSTITVAFLSAAKGTLGRFSAFSLPTRDPVHPLKRIGSLVSHSGGESTKRKSDLPERGSTIFSRSLAKVRLSSGQQIHSKT

SEQ ID NO: 179433 - protein, 182 aa, Glycine max
  Coding DNA Sequence Number=SeqID_87748
MAPTRHPLDPDKSNRALGFSALITGLCQSFRVPVAPSKVIRPPITRAFIEKYCTQRQSQGDAPQAADAPPPHQAGPAGSFDTEQYLRHLVRQQVANHRAHVQTHDCLYQLRLSLQSQGFTSFPCPTPDQFKAEVAWPGDWPEARAGVAPAEAPAEAPDEADEAREDEEMTDLLDFLGGSGAT

SEQ ID NO: 179434 - protein, 120 aa, Glycine max
  Coding DNA Sequence Number=SeqID_87749
MIQSWSTNEQLLVGKVYEYIRGVKPTVSWKSLQVWAHIRDLAHFRRRFTSLQRITDSLIKGRSTLGVQGKLRCLVIAITVYCIWLSKNKLIFEDYQFSVIEVISKIKFLMYRQAHLLHLF

SEQ ID NO: 179435 - protein, 51 aa, Glycine max
  Coding DNA Sequence Number=SeqID_87750
MQNSRRYMYLGTYLNGALKGFNDSQGSKSKDAARWIVVKISTIVLGGFKDN

SEQ ID NO: 179436 - protein, 40 aa, Glycine max
  Coding DNA Sequence Number=SeqID_87751
MPTICRTEPISEDIKDRIEDMIHNLGQDYFQQAHAPLYEK

SEQ ID NO: 179437 - protein, 47 aa, Glycine max
  Coding DNA Sequence Number=SeqID_87752
MCEIRMLRIRMLKIIMLKIRMFRITNKRMHRFASYGMLRMIKRIKGL

SEQ ID NO: 179438 - protein, 276 aa, Glycine max
  Coding DNA Sequence Number=SeqID_87753
  Gene Ontology: Mol. function=nucleoside-triphosphatase activity; Cellular component=HslUV protease complex; Biological process =response to stress
  Homolog annotation: Hit_ID=A1G134; Match level="QueryCoverage=100%, HitCoverage=52%, E-value=1e-149, Identity=98%"; Hit description=Heat shock protein HslVU, ATPase subunit HslU
  Pfam annotation: Domain name=AAA; Domain location=59-235; Score= -15.5; E_value=0.00044; Accession=PF00004.20; Description=ATPase family associated with various cellular activities (AAA)
  Pfam annotation: Domain name=AAA_2; Domain location=56-184; Score= -35.0; E_value=0.0051; Accession=PF07724.5; Description=ATPase family associated with various c
  Pfam annotation: Domain name=AAA_5; Domain location=59-202; Score= -14.1; E_value=0.034; Accession=PF07728.5; Description=ATPase family associated with various
  Pfam module annotation: Pfam domain module=AAA::AAA_2::AAA_5; Domain location=59-235::56-184::59-202
MSKIEVSSATMTPREIVQELDRHIVGQHDAKRAVAIALRNRWRRMQLVPELRNEVMPKNILMIGPTGVGKTEIARRLATLANAPFVKVEATRFTEVGYVGKDVEQIIRDLADTAVKLYREQAKVRVRTQAEERAEDRILDALLPRRSGGIGFDPEVARNEPSAQDNETRIKFRKMLRNGELDEREIELDLAANVSMDIMTPPGMEEMGQQLKSMFANLGGGAKAHKRTLTIKAARPLLVEEEAGKLVNEDDIRTAAIEACEQHGIVFIDEIDKVAK

SEQ ID NO: 179439 - protein, 56 aa, Glycine max
  Coding DNA Sequence Number=SeqID_87754
  Subcellular localization annotation: CTP_CleavageSite=37; ConfidenceScore=5.10e-01
MHQASDVKGALTGRQPSFSFPLLFFILTSCIVDLALSAQSSRAKPSMLALSAQTPD

SEQ ID NO: 179440 - protein, 81 aa, Glycine max
  Coding DNA Sequence Number=SeqID_87755
MARNTFARELRSRSRIVSGHDQKSRQVNGRNQPRYIGTDTSGDRVATDRSLPLPGAKQAENVAAGQPSILCVRSSFYYCLF

SEQ ID NO: 179441 - protein, 228 aa, Glycine max
  Coding DNA Sequence Number=SeqID_87756
  Gene Ontology: Mol. function=transferase activity, transferring phosphorus-containing groups; Cellular component=integral to membrane; Biological process=two-component signal transduction system (phosphorelay)
  Homolog annotation: Hit_ID=P0AE84; Match level="QueryCoverage=100%, HitCoverage=49%, E-value=1e-96, Identity=76%"; Hit description =Sensor protein cpxA
  Pfam annotation: Domain name=HAMP; Domain location=164-228; Score =37.4; E_value=5.2e-08; Accession=PF00672.16; Description=HAMP domain
MIGSLTTRIFAIFWLTLALVLMLVLMVPKLDSRQMTSLMESEQRQGTMIEQHVEAELSQDPPNDLMWWRRLFRAIDKWAPPGQRLLLVTSEGRVIGAQHNEMQVIRNFIGQSDNADHPQKKKYGRVEMVGPFAVRDGEDNYQLYLIRPATSSQLDFVNLLFDRPLLLLIVTMLISSPLLLWLAWSLARPARKLKHAADEVASGNLRQHPELESGPQEFLAAGSSFNQM

SEQ ID NO: 179442 - protein, 64 aa, Glycine max
  Coding DNA Sequence Number=SeqID_87757
MEKRERKIFRPDKFSAGLPFKVVLDWKYPTPPEQRGKDRNTQLPLQKNTTLEKILFVRDRTFDL

SEQ ID NO: 179443 - protein, 160 aa, Glycine max
  Coding DNA Sequence Number=SeqID_87758
  Homolog annotation: Hit_ID=A5BEV8; Match level="QueryCoverage=89%, HitCoverage=20%, E-value=3e-09, Identity=31%"; Hit description =Putative uncharacterized protein
MVSRYTLNEIAAEYERVAYAGKTLHDVDVTITEEMETISKRFEQLDVCGKVHLKSKLREIAYHDMNSMFPPPKKMKTKVALLGMGEESWSLVRNHLHKELISWSEEYINLVGGIERFEELKHSLLVDGLSMVTMDKWMNITDMGYVIASQYNVIIISLSR

SEQ ID NO: 179444 - protein, 71 aa, Glycine max
  Coding DNA Sequence Number=SeqID_87759
MPKRYKFKSVATYPSVRGRRETRGMRVPRKEYARSRHQRLFEENVGKTGKDAIYELLSERFGSCIYARGRY

SEQ ID NO: 179445 - protein, 291 aa, Glycine max
  Coding DNA Sequence Number=SeqID_87760
  Gene Ontology: Mol. function=binding; Cellular component=cellular _component; Biological process=signal transduction
  Homolog annotation: Hit_ID=A7P3U9; Match level="QueryCoverage=83%, HitCoverage=40%, E-value=1e-84, Identity=60%"; Hit description =Chromosome chr1 scaffold_5, whole genome shotgun sequence
MEYRYLVYAFLAVKQSFENCIKSSISTGWDHEPAMSMVVLLVLDVHACIARDPHLFRQLVVFLVHNFQLDNFLLEKHGALIVRRLCVLLNAERVYRELSTILEGETDLDFASIMVQALNLILLTSSELSEIRDLLKQSLVNPAGKDLYVSLYASWCHSPMAIISLCFLAQLLEPGRYIWLFKALYGLLMLLPQQSAAFKILKTRLKAVPSYSFNGEQLKRMPSGDSYQFHNVPDGFRTIQDGDIAEDGGSSRNGINFAARLQQFRQIQHQHRLLSKTGKIVQFFHFIVKGC

SEQ ID NO: 179446 - protein, 172 aa, Glycine max
  Coding DNA Sequence Number=SeqID_87761
  Gene Ontology: Mol. function=cysteine-type endopeptidase activity; Biological process=regulation of catalytic activity
  Homolog annotation: Hit_ID=Q2HV09; Match level="QueryCoverage=32%, HitCoverage=15%, E-value=6e-22, Identity=83%"; Hit description =Peptidase C1A, papain; Somatotropin hormone; Peptidase C1, propeptide
MLLLLLALKCISPTLLRITFDIIFSLARIKVVVLLANQWNSEWGDDGYFKIRRGTYECGIKEDVTAGLPSTKNLVREVTDMDADAAVSFRMSWLIDIGGFAKKVKSTTLSSATCLSMSSSQHWKETKEFATHIRKIFQVLRKMGVMSICFTEQSMHMLLVNESIERFIINRV

SEQ ID NO: 179447 - protein, 35 aa, Glycine max
  Coding DNA Sequence Number=SeqID_87762
MEMQQKTKEKRLGSFLEKLEKTSLRSFFEKTSLRS

SEQ ID NO: 179448 - protein, 262 aa, Glycine max
  Coding DNA Sequence Number=SeqID_87763
  Pfam annotation: Domain name=zf-CCHC; Domain location=190-207; Score =11.7; E_value=0.026; Accession=PF00098.14; Description=Zinc knuckle
MNYSVFGDVVAFDATYKKNKYLSPFVIFLVVNHHNQMIVFVLLLWLQMRLKRPMYGYWNNFGRHERCLTYFRHREVVSDYFLNYGNVPLETNLQSLIITMLVCLNLNEFLKSLLLDRWSKSAKHPIKGKYPDASIELERLKLKNSSAPSMNVGDEQIETRFGNVFYPTVVRAKGSSQVVTNQSSRRKRIQTCRQCGGTGHNKRSCMFASYNGGITGATSFVHITQQINNSPNMDDNYNYQWVIVGVMNECQSNFYMVLLLMT

SEQ ID NO: 179449 - protein, 216 aa, Glycine max
  Coding DNA Sequence Number=SeqID_87764
  Homolog annotation: Hit_ID=UPI00006A2D9E; Match level="QueryCoverage =50%, HitCoverage=57%, E-value=4e-08, Identity=16%"; Hit description =UPI00006A2D9E related cluster
PIAIRGLHVLTFKGLHALTIRGLHALTFNGLHVLAFRGLHTPAFRGLHALAFRGLHVLAIRGLHVLAIRGLHVLAFRGLHILTFRGLHVFTFRGLHILAIKGLHVLANRGLHRATHPRLKRTTRPHLHKAARPHLQRTTRPRHQRTTRPCHQRTTRPRIQRAARPHHQRTTRPRFRGLYVLTFRGLHVLTFRALHALAFRGLHALAIRGLHVFASE

SEQ ID NO: 179450 - protein, 144 aa, Glycine max
  Coding DNA Sequence Number=SeqID_87765
AYHGGTPRHSIEKCVTLKHKVQCLIDAGWLTFQEDGPNVKTNLLANHGGQGCEEQVAMIHDEAPQDHSNWVQPCLPDFQLGKWQVVERPKVFVAGIIFNDKFCEGTNIKDPDVDFEQVANRAKDEDDEDTGFPSKLEMMVAQED

SEQ ID NO: 179451 - protein, 264 aa, Glycine max
  Coding DNA Sequence Number=SeqID_87766
MVAAFVQHQARATRIHHFQFSRQQGRLLGLQHQRAAGEQRHLVAAQVLAQLDLIDFRQLRLRRDDPVQQATVVGQQQQATGLAVEAAHCGQHRIAVAEARRQQVVDQAAGVLGRAGVAGRLVQRDRQAHRRVQRLAVDADRLVRHLVVGIQHLAVGVGDAAFAEHPLHLLAAAVAQVGDELDQLHLPFPFTASTSLKPSRSAITRTAPKLSLSVYSYGRWRLATTYRRPPGRSACAATAMKRWPMSGRSAREGVWNGGLLMMTS

SEQ ID NO: 179452 - protein, 254 aa, Glycine max
  Coding DNA Sequence Number=SeqID_87767
  Homolog annotation: Hit_ID=Q6WAY6; Match level="QueryCoverage=92%, HitCoverage=45%, E-value=1e-26, Identity=30%"; Hit description =Putative uncharacterized protein
MAEVSTEAIASLAQYYDQPLRCFTFGDFQLSPMVEEFEKILGCPLGGRKPYLFSGFYPFLARISKIVQISAQELDHRKQVENGVVGIPRKYLEAKARILAGRGEWAPFIDILADLYDTFDRRCQKSSIRIVCCTPALYVWLVSHLFRQEVRHACPLESHRSSTEKRGENWDRLLASKEGAFVNWFPRWKEGRTGILISCGGFPNVPLMGTRGCISYNPILVIRQLGYLMRGAPLEEELTPTIAPGFNKTNMEAL

SEQ ID NO: 179453 - protein, 82 aa, Glycine max
  Coding DNA Sequence Number=SeqID_87768
MLVGKVFSFELNRSCVSTDTSMFSFARHGSDEDMTKSKGKDPLEGLGGPMTRARARKSKEALQQVLSILFEYSPSFKEKVQG

SEQ ID NO: 179454 - protein, 107 aa, Glycine max
  Coding DNA Sequence Number=SeqID_87769
  Subcellular localization annotation: CTP_CleavageSite=85; ConfidenceScore=5.55e-01
MRTRPSLSDTRGDRVSFRPDLSPPIGVLTTRTASVSTVKMRTRPSLSDTRGDRVSFRPDLSPPIGVLTTRTAVIPLRALSAAFCQSQARRKVVGGRNLRTLEDLLWT

SEQ ID NO: 179455 - protein, 101 aa, Glycine max
  Coding DNA Sequence Number=SeqID_87770
  Subcellular localization annotation: CTP_CleavageSite=26; ConfidenceScore=5.12e-01
TYQGNPCGVYPDLSSFTGSGVYPDLSSFTGSGVYPDLSSFTGSGVYPDLSSFTGSGVIQKLYSLYQVIRPVAEDAASDGHVDDKLGVAEGGEEGAKAGNGN

SEQ ID NO: 179456 - protein, 154 aa, Glycine max
  Coding DNA Sequence Number=SeqID_87771
MSCLVIITPTFLCRSVSWCMPPTRHPLDPDKSNRALGKVNRPPITWAFIEKYCTPRQAQAADASPPPHRADPAGSLGMERCRYMSVSTSSASVSRGQGFAPFACPTPDQFRAEVAWPEAQAGEAPAGAPDDAEEARIDEEMTNLLGFLGGSGAT

SEQ ID NO: 179457 - protein, 330 aa, Glycine max
  Coding DNA Sequence Number=SeqID_87772
NVLGRSNFPERKVEIYHTEFDDFKTELERRNLHKHLTNLADGTIGVALVKEFYANLYSSEDPSPKQARVRGHLVRIDTDSLNTFLETPVVLEEGETLPTYSRYCRLPSDHREIKATLCIPGKGFILNVEGHSRRILGKDLTTLAQVWSVFSYSNLAPTSHTSDLTMDRARLIFGLVSHMDMNIGALISGQMTSIAQSNSCRLAFPTLITVLCRARRVVSDSLTFECLSPAINLAYIRKNCCNIDDLIVAFRGARRARARPTDIPSTFAASAPTLASTSVAPSVPAHVDTQRFEAMLQTIHQGRILLLHSLQVVAPPRSILSMAQFLERVA

SEQ ID NO: 179458 - protein, 126 aa, Glycine max
  Coding DNA Sequence Number=SeqID_87773
  Gene Ontology: Mol. function=nucleoside-triphosphatase activity
  Homolog annotation: Hit_ID=A5FMP5; Match level="QueryCoverage=99%, HitCoverage=24%, E-value=6e-31, Identity=55%"; Hit description =Putative uncharacterized protein
MADKKQFIDELSARYTPKGDHIILGKGMLDGEVVTEVNVTIPLKTINRHGLIAGATGTGKTKTLQVFAEQLSHAGIPSLVLDIKGDFSGIAEAGEMNPIIEERYAKTQLPYNPQAFPVELMSISRW

SEQ ID NO: 179459 - protein, 207 aa, Glycine max
  Coding DNA Sequence Number=SeqID_87774
  Gene Ontology: Cellular component=extracellular region; Biological process=lipoprotein metabolic process
  Homolog annotation: Hit_ID=A0A8Y3; Match level="QueryCoverage=92%, HitCoverage=44%, E-value=1e-08, Identity=26%"; Hit description =Putative uncharacterized protein
MADIGRSGGRRTFDCGIRNDFSLEAPITTNPSPSTIHISTSESMIHVVAQTRNALPIAQDQPNPTFVKESIPTTLVRDASPSAPDDSVTPEYPPDPNCEHIVDERPFIPSYKGEAKFDEPAPSWFKVSVDLRDMWFGEFKKEYRWHPQEERAIRAFFETKDSRILKSAMNKIRNGQDTGKWITVNVQAALDEHWGSTNFLNKSSNAK

SEQ ID NO: 179460 - protein, 27 aa, Glycine max
  Coding DNA Sequence Number=SeqID_87775
MECVTKGEQASIFWHCQNLPYGGHFNR

SEQ ID NO: 179461 - protein, 100 aa, Glycine max
  Coding DNA Sequence Number=SeqID_87776
MLVSTCYHTLSLTDSKRVCAGYRIGRLRVLMDSQVMIAKGGSLPEDADIFGKGVDDHLGLCLSIRLGVSEGRGADNRKVSPHATRLSDRWIAKMCAGYRR

SEQ ID NO: 179462 - protein, 254 aa, Glycine max
  Coding DNA Sequence Number=SeqID_87777
DERQECDESGGVHHRLVAEQRLAAEGRDDLADHAEGGQDHDVDLGVPEEPEDVLVHHRVTATGGVEEAGAEELVGQQHGHRAGQHWHHRNQQEGGDQPGPAEDRHFQQVDARRTHVQHGGDDVDRTHDRTDAGHVDREHAEGHVIAALQRQRRIQRPATSRRTTGQEQGQQQQAEGHRQQPERPVVHARQRHVRRADLQRDHPVGEADEGRHHATEDHHQRMHGGHLVEELGLDELQARLRQLGADHHAPSPHR

SEQ ID NO: 179463 - protein, 111 aa, Glycine max
  Coding DNA Sequence Number=SeqID_87778
MAPKKLSMKRSRRDAPVEGFVAAPEFDSHRFRSAEHQQRFKAIKGWSFHRERRVQLREDEYTDFQEEIARRRWAPLVTPMAKFDHEIVLVFYANAWPTEEGVRDMRSWVRG

SEQ ID NO: 179464 - protein, 179 aa, Glycine max
  Coding DNA Sequence Number=SeqID_87779
MPPTRYLLDPDKSNRALGFSTLITGLCQSFRVPVTPSKVIRLPITRAFIEKYYTPRQAQGGDPQAPDAPPPPPQANPAGSFDTERYLRNLVCQQAANQRAHLQTHDCLYQLNLSLQSQGFPPFPCPTPDQFRAEVAWPRDWPEAQAGEAPAEAPGDADEARMDEEMTDLLDFLGGSEAT

SEQ ID NO: 179465 - protein, 108 aa, Glycine max
  Coding DNA Sequence Number=SeqID_87780
  Subcellular localization annotation: CTP_CleavageSite=72; ConfidenceScore=5.10e-01
MPISPCRRISWFVSSQHRDRTHKDTQWTRRSPTGPWGFQLWLRAFVSPTGCPFPPTRSRHHDIGIVPVRYPVDPKKSNRVLELPALITGLCKFYGVPVAPQQGHQAPY

SEQ ID NO: 179466 - protein, 213 aa, Glycine max
  Coding DNA Sequence Number=SeqID_87781
MAPKKLSTNRYRRDAATEGTSAAPEFDSHYFKSAEHQQRFEAIKGWSFDRERHVQLRDDEYTDFQEEIARRHWTSLVTPVTKFDPDIVLEFYSNAWPTEEGVRDMRSWVRGQWIPFDADALSQFLGDPLVLEEGQECEFSQRRNKADGFDEDAIAQLLCTLGQDFARTAAGRRVRIMHTSMTTLTQMWMTLLLNNVLPSDHNSDLPLPKCQLV

SEQ ID NO: 179467 - protein, 187 aa, Glycine max
  Coding DNA Sequence Number=SeqID_87782
  Homolog annotation: Hit_ID=A5B939; Match level="QueryCoverage=28%, HitCoverage=34%, E-value=3e-15, Identity=75%"; Hit description =Putative uncharacterized protein
  Subcellular localization annotation: CTP_CleavageSite=40; ConfidenceScore=5.33e-01
MALKRATYTRPSGKDQAPMSRRARRSLQTQGASPGGAVVGADLGGSSKYSNENFEGRRGESLPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERALRGLFPGRRTVNSEL

SEQ ID NO: 179468 - protein, 147 aa, Glycine max
  Coding DNA Sequence Number=SeqID_87783
  Gene Ontology: Cellular component=cytoplasm
  Homolog annotation: Hit_ID=Q3E720; Match level="QueryCoverage=55%, HitCoverage=17%, E-value=5e-29, Identity=71%"; Hit description =Uncharacterized protein At4g18900.1
MEHHSDKVQAVAWNHHAPQVLLSGSFDHTVVLKDGRMPSHSGYKWSVTADVESLAWDLHTEHSFVVSLEESCLGSFAILSRSQARIKGEGCVRLSTANVVARKQRAVWLEYSVKRARAAASPPGCSEKSRNGVGIIVDKEWKKDVVD

SEQ ID NO: 179469 - protein, 154 aa, Glycine max
  Coding DNA Sequence Number=SeqID_87784
  Gene Ontology: Mol. function=serine-type peptidase activity; Cellular component=integral to membrane; Biological process=proteolysis
  Homolog annotation: Hit_ID=A9PAC0; Match level="QueryCoverage=70%, HitCoverage=69%, E-value=2e-12, Identity=37%"; Hit description =Putative uncharacterized protein
MVKAYTQDHVYKHPWERVTCASFDASLLTKRTNRKTAVMILRNLEAFEPIIKAGWRFSKFYCFIHVTKTYLIAPDVISPRFGKVACGDIVVLLNPQHPRHFMTKRVVGLEGDSVTYISNPETYEYEGDSFTRISSPDNGDKSKTIVVWSISYEN

SEQ ID NO: 179470 - protein, 611 aa, Glycine max
  Coding DNA Sequence Number=SeqID_87785
  Gene Ontology: Mol. function=nucleotide binding; Cellular component =intrinsic to membrane; Biological process=defense response
  Homolog annotation: Hit_ID=Q6R270; Match level="QueryCoverage=96%, HitCoverage=47%, E-value=1e-140, Identity=55%"; Hit description =Disease resistance protein
  Pfam annotation: Domain name=LRR_1; Domain location=130-151; Score =7.2; E_value=14; Accession=PF00560.24; Description=Leucine Rich Repeat
  Pfam annotation: Domain name=LRR_1; Domain location=153-176; Score =2.9; E_value=91; Accession=PF00560.24; Description=Leucine Rich Repeat
  Pfam annotation: Domain name=LRR_1; Domain location=208-229; Score =11.8; E_value=2; Accession=PF00560.24; Description=Leucine Rich Repeat
  Pfam annotation: Domain name=LRR_1; Domain location=231-254; Score =2.9; E_value=91; Accession=PF00560.24; Description=Leucine Rich Repeat
  Pfam annotation: Domain name=LRR_1; Domain location=286-307; Score =12.2; E_value=1.7; Accession=PF00560.24; Description=Leucine Rich Repeat
  Pfam annotation: Domain name=LRR_1; Domain location=309-332; Score =1.9; E_value=1.3e+02; Accession=PF00560.24; Description=Leucine Rich Repeat
  Pfam annotation: Domain name=LRR_1; Domain location=364-387; Score =6.7; E_value=18; Accession=PF00560.24; Description=Leucine Rich Repeat
  Pfam annotation: Domain name=LRR_1; Domain location=431-453; Score =11.3; E_value=2.5; Accession=PF00560.24; Description=Leucine Rich Repeat
  Pfam annotation: Domain name=LRR_1; Domain location=456-479; Score =3.9; E_value=59; Accession=PF00560.24; Description=Leucine Rich Repeat
  Pfam annotation: Domain name=LRR_1; Domain location=504-524; Score =1.4; E_value=1.7e+02; Accession=PF00560.24; Description=Leucine Rich Repeat
  Pfam annotation: Domain name=LRR_1; Domain location=527-550; Score =9.8; E_value=4.6; Accession=PF00560.24; Description=Leucine Rich Repeat
  Pfam annotation: Domain name=LRR_1; Domain location=552-575; Score =12.5; E_value=1.4; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=130-151::153-176::208-229::231-254::286-307::309-332::364 -387::431-453::...
  Pfam module annotation: Domain location=456-479::504-524::527 -550::552-575
MYTGVRKVPAHLGKLEYLQVLMSSFNVGKSREFSIQQLGELNLHGSLSIENLQNVENPSDALAVDLKNKTHLVELELEWDSDWNPDDSTKERDEIVIENLQPSKHLEKLTMRNYGGKQFPSWLSDNSSLNVVSLSLRNCQSCQRLPPLGLLPFLKELSIEGLDGIVSINADFFGSSSCSFTSLESLRFSNMKEWEEWECKGVTGAFPRLQRLSIGYCPKLKGLPPLGLLPFLKELSIEGLDGIVSINADFFGSSSCSFTSLESLKFSDMKEWEEWECKGVTGAFPRLQRLSIRYCPKLKGLPPLGLLPFLKELSIQRLDGIVSINADFFGSSSCSFTSLESLDFYDMKEWEEWECKGVTGAFPRLQRLSIYNCPKLKWHLPEQLSHLNRLGISGWDSLTTIPLDIFPILRELDIRECLNLQGISQGQTHNHLQRLSMRECPQLESLPEGMHVLLPSLDYLGIIRCPKVEMFPEGGLPSNLKNMHLYGSYKLMSSLKSALGGNHSLETLRIGGVDVECLPEEGVLPHSLVTLDISHCEDLKRLDYKGLCHLSSLKELTLWNCRRLQCLPEEGLPKSISTLTIRRCGFLKQRCREPQGEDWPKIAHIEDVDIR

SEQ ID NO: 179471 - protein, 589 aa, Glycine max
  Coding DNA Sequence Number=SeqID_87786
  Homolog annotation: Hit_ID=A8C976; Match level="QueryCoverage=100%, HitCoverage=85%, E-value=1e-125, Identity=43%"; Hit description =Forisome
MMCTARGEQYAHQTTMLILEQLRDYSWDAKAVIVLAAFALEFGKFWQLAHIPRDKLGQSLAELNGLQSIMENIQHLANFNNLVKKIVQVVKCITDWKKMITAEYNVKDVPSLTDTLHEIPVLAYWTISTLVTCTSHIDFLGDKGYRYDLSKFDYKLDFILKNFKDHQDKCSTQIGQIEDYSRRKDIITSIQTDTQIDIVKFLEALIIPSYSQDSRPIVYNGLTGPQVALGEFKNKHVLLFISGLDHIDNEIQLLKSINAKLKEEPNELEGYRKEDFKILWIPIVSVWDEEQKKKLDVTKVEWYVVKEFNFQTGIDLIKEVFNYKGNPIIMLISPEGKVENSDAKQIISKWGIDGFPFRTSDHTRLTQQWNWFWNEMITLSPIIRELIKRDSYIFIYGGTNTKWIQDFTTAVEKLKKNETLTLEEETTIESYPLGRDSPKIVPRFWITIDNLLASRKLTKKGSEQVQDSTTREIQKLMFLKQDPLGWAILTKGSHVKLLGHGDAMLRTVTDFESWKGTMHNEVSFDVAFKNYYDKCKVKSVPPKCEHREFANYPTDILAHIPCPNKCGHEMEVSSVKYMCCHGREASDIA

SEQ ID NO: 179472 - protein, 32 aa, Glycine max
  Coding DNA Sequence Number=SeqID_87787
MPETVTRKRMRTPSSTFKILGYAPSFHAPIPR

SEQ ID NO: 179473 - protein, 135 aa, Glycine max
  Coding DNA Sequence Number=SeqID_87788
TGLCQSFGVPVAPSKVIRPPITRAFVEKYCTQRQAQGDVSQAAYAPPPHQAGLAGSFDTEQYLRHLMSLSLQSQGFTSFPCPTLDQFKAEVTWPGDWPEARAGEAPAEALDEADEAREDEEMTDLLDFLGGSGAT

SEQ ID NO: 179474 - protein, 163 aa, Glycine max
  Coding DNA Sequence Number=SeqID_87789
  Homolog annotation: Hit_ID=Q2HTA0; Match level="QueryCoverage=80%, HitCoverage=20%, E-value=2e-11, Identity=36%"; Hit description=IMP dehydrogenase/GMP reductase, related
  Pfam annotation: Domain name=DUF1723; Domain location=117-163; Score =12.9; E_value=0.016; Accession=PF08330.1; Description=Protein of unknown function (DUF1723)
AAPQWRRPTTSARWQQEVVPFPEDVCLVDDATDEVFQKPQEAVADAQGFPGRPRDTSILTGYVDHVAVIVGNREECPELKLSSHGRKVQKFGVPTAEIEGLVAATGLSPLIACSLDTGDRGLISAFAEMRHKETSSFHLLVGEVTITLDGGLFASFFHHKRLP

SEQ ID NO: 179475 - protein, 64 aa, Glycine max
  Coding DNA Sequence Number=SeqID_87790
GFQALERRRRDCSLHFVEAMPSKIILMMPKNQELSKIQRIRSQKASTIKFQDSRIKRRLNQDKY

SEQ ID NO: 179476 - protein, 74 aa, Glycine max
  Coding DNA Sequence Number=SeqID_87791
  Subcellular localization annotation: CTP_CleavageSite=53; ConfidenceScore=5.08e-01
AVHVSSTFEFGAMFHDCLSADPQANPPFSPLLRSPVHVSSTFEFGAMFHDCLSADPQGNPPLSPFFRSLMNVIA

SEQ ID NO: 179477 - protein, 59 aa, Glycine max
  Coding DNA Sequence Number=SeqID_87792
MASKKLSAKRSRRDAAAEGTSAAPEFDSHHFRSAEHQQRFEAIKGWSFHRERRVQLRDN

SEQ ID NO: 179478 - protein, 131 aa, Glycine max
  Coding DNA Sequence Number=SeqID_87793
MSIVHIQIALMLVTTKWSRTLTIGIFWTNNNNLIRRMIDSRCFDDNKDDDKNPKRMISRLSQEQFKNQEKDSRESFIKKIQDSRIIKIKIQDLKIQESREDLIKISIKKFFKTLSSTRSFHKIITKEFYSL

SEQ ID NO: 179479 - protein, 60 aa, Glycine max
  Coding DNA Sequence Number=SeqID_87794
MPKDRGTCLDFRDCHHQKGGDCGQRIKLNVLMMPKFHMRLKALFKTKKLKIFKMDDQDNL

SEQ ID NO: 179480 - protein, 126 aa, Glycine max
  Coding DNA Sequence Number=SeqID_87795
MESPPQRHPVDPEKSNRALGFPALVTGLCSPTGCPFPPARSRHHRDRACKTPSGPEEVQQGLEFYGVPVTSSKGIRPPTNRAFIKNYCVSRQAQGETPQQPGDGRQRATDAPPSPLEFISAHPQKG

SEQ ID NO: 179481 - protein, 35 aa, Glycine max
  Coding DNA Sequence Number=SeqID_87796
MAGRNDCAIADALQALAQAIGNPNRGEVAGAAGYQ

SEQ ID NO: 179482 - protein, 63 aa, Glycine max
  Coding DNA Sequence Number=SeqID_87797
MQIFIEAIDLNIWEAIEISPYIPKNDKKKKGIALKASSSIQEESDKEDFNEIEEDDDFSFFIN

SEQ ID NO: 179483 - protein, 86 aa, Glycine max
  Coding DNA Sequence Number=SeqID_87798
  Subcellular localization annotation: CTP_CleavageSite=51; ConfidenceScore=5.10e-01
MTYQGNPCGIYPDLSSFIGSGVYPDLSSFTGSGVYPDLSSFTGSGVYPDLSSFTGSGVYPDLSSFTGSGLYPDLSSFTGSGVIQPP

SEQ ID NO: 179484 - protein, 301 aa, Glycine max
  Coding DNA Sequence Number=SeqID_87799
  Gene Ontology: Mol. function=NADH dehydrogenase (ubiquinone) activity; Cellular component=mitochondrion; Biological process=ATP synthesis coupled electron transport
  Homolog annotation: Hit_ID=Q6R9F6; Match level="QueryCoverage=42%, HitCoverage=75%, E-value=4e-28, Identity=51%"; Hit description =Putative uncharacterized protein orf179
GAGSESSWTGALLSSETLSGTGSVNQPAEGMPVPPANPVVEQAGPANPEDTTEIIGGDSIDSIRNRLLQSYGNPSAEQISRASYDADDLFQVKVEIIRGMTPLDPEGDWPGRGARALDNPRTSTGEDSLENLYRLKDDLNENGRDSETFKRLKDKIVPYVPPQPSDPLMEKISRLERAVNKLSRDKYDVADLENLSLYPKVRLPYGSGLSADDDVHSWLDALNERELPRLRMNFLRASVAYNVNPVADQFQRAFQTIRSFLRFGYEVSFEALDKGAIEILGPYECVMTRGRLPGQVGSSVV

SEQ ID NO: 179485 - protein, 84 aa, Glycine max
  Coding DNA Sequence Number=SeqID_87800
MANKHLQAATTMISLINYISTHDFFQAAHHNYCWYQEMVYPSGTRHESLKHVVKGLNPDECIYGENLVEREIPLMSANRSLGGY

SEQ ID NO: 179486 - protein, 141 aa, Glycine max
  Coding DNA Sequence Number=SeqID_87801
  Gene Ontology: Biological process=transposition, DNA-mediated
  Homolog annotation: Hit_ID=Q1J7G7; Match level="QueryCoverage=29%, HitCoverage=71%, E-value=2e-12, Identity=74%"; Hit description =Transposase
LELLRADQRLISPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFMQQGQADILIVRFPDPNYGVKT

SEQ ID NO: 179487 - protein, 236 aa, Glycine max
  Coding DNA Sequence Number=SeqID_87802
MAPRKLASKRSKKDKADEGTSSAPEYDSHHFRSAEHQQRFEAIKGWSFLRERRVQLKDNEYTDFQEEIVRRRWASLVTPMAKFDPDIVLEFYANAWPTEEGVRDMRSWVRGQWIPFDADALSQFLGYPLVLEEGQECEYGQRRNRSDGFDEEAIAQLLCIPGQDFARTAAGRRVRIMRTNMTTLTQIWMTLLLSNIQPSDHNSDLPLTKCQLVYAILTRMSIHVAHLIADAIYLFA

SEQ ID NO: 179488 - protein, 182 aa, Glycine max
  Coding DNA Sequence Number=SeqID_87803
MAPTRHLLDPDKSNRALRFPALITGLCQSFGVPIAPSKVIRPPITRAFIEKYCTQRQVQGDAPQAADAPPPHQAGPAGLFDKEQYLWHLVRQQVANHRAHVQTHDCFYQMSLSLQSQGFTSFPCPTPDQFRAEVAWPGDWPEARAGEAPAEAPAEAPDETDEAREDEEMTNLLDFLGGSGAT

SEQ ID NO: 179489 - protein, 260 aa, Glycine max
  Coding DNA Sequence Number=SeqID_87804
  Homolog annotation: Hit_ID=Q5XM22; Match level="QueryCoverage=33%, HitCoverage=49%, E-value=1e-08, Identity=37%"; Hit description =Resistance-like protein HAAS-2
MASLLHIPITGTFYNLEHMDKKTAILVLVDLLGVEYEIAFDEKKKTRVGCTLFSNKSATYVEVKFLDIFHDLEGYGRYSWGVVALTYLYEHLSDISIVGTKQIGGYAILLQHMVDHKLVIQDIDAYVVTKKILALTHGVIDDENMDTRGGRGGNVNTSKGRAIISSKDSCILITPLYANCYELEAKNLHPYQESFSCVLVVGMVYQVTSMKMNYHAMNVMHPYAHKRISTSLIRFKGCNVMPKVQGRKGWGGNHERQMGV

SEQ ID NO: 179490 - protein, 63 aa, Glycine max
  Coding DNA Sequence Number=SeqID_87805
MELTRGLGDASSTSALRFGYMALKTPATMARSPWESNGASQTGDLPLTGRTALAGEQEQLFSA

SEQ ID NO: 179491 - protein, 82 aa, Glycine max
  Coding DNA Sequence Number=SeqID_87806
MGLLKLRLLRVNFSLQATVRDRCVAAGGLATVRAGASLPEVIAAACACGVREGRGWVRRVAGGTRLVQGGSRLGSLLDGRLF

SEQ ID NO: 179492 - protein, 566 aa, Glycine max
  Coding DNA Sequence Number=SeqID_87807
  Gene Ontology: Mol. function=RNA binding
  Homolog annotation: Hit_ID=A5B2A7; Match level="QueryCoverage=46%, HitCoverage=47%, E-value=8e-37, Identity=29%"; Hit description =Putative uncharacterized protein
  Pfam annotation: Domain name=DUF659; Domain location=236-317; Score= -41.1; E_value=0.0005; Accession=PF04937.6; Description=Protein of unknown function (DUF 659)
  Pfam annotation: Domain name=zf-C2HC_plant; Domain location=114-169; Score=43.7; E_value=6.3e-10; Accession=PF07567.3; Description =Protein of unknown function, DUF1544
  Pfam module annotation: Pfam domain module=DUF659::zf-C2HC_plant; Domain location=236-317::114-169
MRGASAHPHSHLLTEREKRNLAFLNRLPRSIRSDRIVPLYIALHPFADLEEMDDIFDFQNIMLDQNNGVHHLEYDVYHGRNVVAIHGGHGGCNRIMSGTWICTASSNPTSKRINIGWKHCTTVRKNDTNEICCKHCHKIMKGGITRGKHHLIGKPGNVAPCLVCLKEVVDEIRASEKYPRRRILERGPWISILNFNLQLQRIGISCYKLSFNMIKLQSFQDMLCEVRHFGKHLRPPSYHDIKVILQKEVGTMLMKSIDASNYVKIVDKLFELLDSIEIGEEKVAQVVTNNGSNYVYGSRKLKHFEYVEILYKQKRVSEACNHSICNFLSFLGKDSPRENIRTMFALNDWNENKLSKETKGKEATKTVLMSNFWKNVVYILKVMAPLMKVFQLVDDANKYRDAFQIIDKRWNVQLYSPLHAINHFLNPEFFYDNSQIEFDGEVVRGLYEVINKLEGDLEMEKIIMRELLSYTMGAVGYHVDKPDQPYMFLVDEVVMPPSAKPPAIVLMTCRAVSIMVPSIVIRGPCGLWRKSFKSLGGVSAFRSAHMILELSASSRTLSRLVFKAMY

SEQ ID NO: 179493 - protein, 71 aa, Glycine max
  Coding DNA Sequence Number=SeqID_87808
MGLLKATVRDRCVAAGGLATVRAGASLPEVVAAACACGVREGRGWVRRVAGGTRLVQGGSRLGSLLDGRLF

SEQ ID NO: 179494 - protein, 286 aa, Glycine max
  Coding DNA Sequence Number=SeqID_87809
  Gene Ontology: Mol. function=isomerase activity; Cellular component =integral to membrane; Biological process=protein folding
  Homolog annotation: Hit_ID=A7PNW9; Match level="QueryCoverage=99%, HitCoverage=28%, E-value=2e-46, Identity=69%"; Hit description =Chromosome chr8 scaffold_23, whole genome shotgun sequence
  Pfam annotation: Domain name=FKBP_C; Domain location=158-278; Score =45.3; E_value=2.1e-10; Accession=PF00254.19; Description=FKBP-type peptidyl-prolyl cis-trans is
MAIGTMVREEKAVIYVTSQYLTESPLMPVIEGYDEVHFEVELVHFIQHFTSTISESVHVSCRQSAWRNRECMSPVSLAKQGVHFTSELGETGTALTETHVGTCRLHSEACCRDVAFSEACVLLTPPTKHAHDGHVKAAAFFDIPNVVKAVHVSRDFPMDCPLHDSLLRVHYKGTVLNEEKRVFYDTRVDNDSQPLEFCSGEGLVPEGFEMSVRLMLPGEIALVTCPPDYAYDKFPRLLTKIHCHSVLFLCFIAILPPFMTRPLNVPEGAHIQWEIELLGFETPKVL

SEQ ID NO: 179495 - protein, 20 aa, Glycine max
  Coding DNA Sequence Number=SeqID_87810
MAPKTCSVAASAPDRASSIK

SEQ ID NO: 179496 - protein, 96 aa, Glycine max
  Coding DNA Sequence Number=SeqID_87811
  Gene Ontology: Mol. function=protein kinase C binding; Cellular component=cell projection; Biological process=keratinization
  Homolog annotation: Hit_ID=Q86AI8; Match level="QueryCoverage=96%, HitCoverage=33%, E-value=2e-15, Identity=40%"; Hit description =Similar to Homo sapiens (Human). Mucin 2
MPSPSEDYTPSPSEGYTSSPAEGYTPSPSEGYTPSPYEGYTPSPSEGCTPSTSEGCTPSPLEGYRPSPLEGYTSSPLEDYTPSPLEDYMSSPSEGY

SEQ ID NO: 179497 - protein, 137 aa, Glycine max
  Coding DNA Sequence Number=SeqID_87812
  Homolog annotation: Hit_ID=A2Q1D6; Match level="QueryCoverage=64%, HitCoverage=16%, E-value=6e-07, Identity=33%"; Hit description =Ovarian tumour, otubain, related
MTNSFVGHPYAGRLTKDEKIVVVDMTKSMVKPRNILLTLKEHNANSLKAVCPNATNLCRFHIDKNVKAKCKTLISQKNAWDYVIEAWGSLVDCPCESYFDEYLKNFEMDCSPWPMFVDYVSQNIGDSAQRKFCESMD

SEQ ID NO: 179498 - protein, 177 aa, Glycine max
  Coding DNA Sequence Number=SeqID_87813
  Gene Ontology: Mol. function=magnesium ion transmembrane transporter activity; Cellular component=integral to membrane; Biological process=magnesium ion transport
  Homolog annotation: Hit_ID=P0ABI6; Match level="QueryCoverage=84%, HitCoverage=47%, E-value=1e-76, Identity=95%"; Hit description =Magnesium transport protein corA
  Pfam annotation: Domain name=CorA; Domain location=41-174; Score= -81.5; E_value=0.032; Accession=PF01544.9; Description=CorA-like Mg2+ transporter protein
MALVVVSDCIIPVALIPVMLSAFQLENNRLTRLEAEESQPLIDAVWVDLVEPDDDERLRVQSELGQSLATRPELEDIEASARFFEDEDGLHIHSFFFFEDAEDHAGNSTVAFTIRDGRLFTLRERELPAFRLYRMRARSQAMVDGNAYELLLDLFETKIEQLADEIETSTAIWKADR

SEQ ID NO: 179499 - protein, 101 aa, Glycine max
  Coding DNA Sequence Number=SeqID_87814
MRMLKVGSVHTDKDYHEALCTSFRLPRLPNLTFPIFHGISRIQVITGITIAVLKCRLLTTGSDEGIRKTAWIGERREKGESAHDAWKVGEESDSKPSAIDH

SEQ ID NO: 179500 - protein, 195 aa, Glycine max
  Coding DNA Sequence Number=SeqID_87815
  Gene Ontology: Mol. function=oxidoreductase activity; Cellular component=peroxisome; Biological process=metabolic process
  Homolog annotation: Hit_ID=A2W470; Match level="QueryCoverage=81%, HitCoverage=54%, E-value=6e-49, Identity=53%"; Hit description =NADH:flavin oxidoreductase, Old Yellow Enzyme family
  Pfam annotation: Domain name=Oxidored_FMN; Domain location=4-185; Score=-20.1; E_value=9.1e-11; Accession=PF00724.11; Description =NADH:flavin oxidoreductase  NADH oxi
  Subcellular localization annotation: CTP_CleavageSite=29; ConfidenceScore=5.20e-01
MSAMLFTSHRLGPLTLPNRIVMPPMTRSRAAAGNVATAEMATYYAQRAGAGLIVSEGTQISPQGQGYAWTPGIHSPEQVKGWRQGDTMRCTPPRGYVVPRALETDEIPGIVEAYRRGAQLAHEAGFDGVEVHGANGYLLDQFLQDSTNQRTDGYGGSLECPRPPDAGRGGCLRQRLGRRPGRPAPVAAWRCAYDG

SEQ ID NO: 179501 - protein, 54 aa, Glycine max
  Coding DNA Sequence Number=SeqID_87816
MEGDIGLILDLTLKEKKRIEVKREKFHWLPLTSKGMPSIGGLPLLGKEGFMGIL

SEQ ID NO: 179502 - protein, 174 aa, Glycine max
  Coding DNA Sequence Number=SeqID_87817
  Homolog annotation: Hit_ID=A5C9E2; Match level="QueryCoverage=81%, HitCoverage=19%, E-value=5e-16, Identity=38%"; Hit description =Putative uncharacterized protein
KASEVVALGKLKTLTKSTIRERSLKAQHSSMITISKFEYEYLTNHAASVEEIADKKVAAAEAWIEALKASEKEILMETKIAQRQLKESKLEQELEVYTKEKMLSRRVSSSEELHNSYAYFTLRWHHPVFSLQLHEPQKKVKSLHYRLHKLIMINLKRHMIHSHPTHAKDSSFHG

SEQ ID NO: 179503 - protein, 87 aa, Glycine max
  Coding DNA Sequence Number=SeqID_87818
MDLGIGPCRNVPFASERRRGSRVRFPKEERCAESPPMFICGKRRENQRKPVKMKILSSGVVFTLEEGRQKQGFCSYVPSFGEEIRPT

SEQ ID NO: 179504 - protein, 47 aa, Glycine max
  Coding DNA Sequence Number=SeqID_87819
MTKARQKGVWKENGGDACHPARPGELGCFLQKQPPSQGIFWKAHVGL

SEQ ID NO: 179505 - protein, 150 aa, Glycine max
  Coding DNA Sequence Number=SeqID_87820
  Gene Ontology: Mol. function=protein binding; Biological process =defense response to fungus
  Homolog annotation: Hit_ID=Q1SWI6; Match level="QueryCoverage=66%, HitCoverage=44%, E-value=7e-24, Identity=54%"; Hit description =Leucine-rich repeat, plant specific
  Pfam annotation: Domain name=LRRNT_2; Domain location=27-67; Score =51.0; E_value=4e-12; Accession=PF08263.3; Description=Leucine rich repeat N-terminal domain
MNSSSIYILVFLHLWLCSLPCRESVCIPSERETLLKFKNNLNDPSNRLWSWNHNNTNCCHWYGVLCHNVTSHLLQLHLNTSPSAFEYDYYNGFYHRFDEEAYRRWSFGGEISPCLADLKHLNYLDLSGNRFLGEDSSSDWESLRFGVSLT

SEQ ID NO: 179506 - protein, 52 aa, Glycine max
  Coding DNA Sequence Number=SeqID_87821
MEQVSIGHQNCSEFYRLFAAKFPPWLVFWFVLKVVFVIGSVENTWAAGSLHL

SEQ ID NO: 179507 - protein, 111 aa, Glycine max
  Coding DNA Sequence Number=SeqID_87822
  Homolog annotation: Hit_ID=A5ALB5; Match level="QueryCoverage=100%, HitCoverage=8%, E-value=9e-09, Identity=38%"; Hit description =Putative uncharacterized protein
MSADVTFFEDTPFYPSSTDHSSSIQNVLPIPSPCPLDTSNPDVSEVPSSPPHPIEVASPPLLTNQCRIQQVGPSIPEASFHDSPPSSINPQAMDPATSHPSDSDWPIAIRK

SEQ ID NO: 179508 - protein, 20 aa, Glycine max
  Coding DNA Sequence Number=SeqID_87823
MRGTMHEPQANLGADHKFLP

SEQ ID NO: 179509 - protein, 105 aa, Glycine max
  Coding DNA Sequence Number=SeqID_87824
MGESLTEQCRVKVEGLRVMNFFSRRRSNDAAAVRQRMQALSGMIGRKASVGGFLSSPSNPRAQPWTGGETTSWSTVGAEGISGGAVKCVEIGKNTNGESTLLGRH

SEQ ID NO: 179510 - protein, 159 aa, Glycine max
  Coding DNA Sequence Number=SeqID_87825
  Homolog annotation: Hit_ID=A1IW39; Match level="QueryCoverage=41%, HitCoverage=98%, E-value=1e-17, Identity=70%"; Hit description =Putative uncharacterized protein ophh-69
MNGAKRSAEAVGCKKESVGERSALEGRTRASSAGRSGSENVGLSNANVGENPMPRKPKGSSARFVHGGKCLEPKFEYQAYSAEVIHAILPGKARTTFNKWVPVPETDTGVPPHKGGRSDQARATVYQKHRSPQSREPTTEAPVNGGRNYNGPKVAKFLV

SEQ ID NO: 179511 - protein, 122 aa, Glycine max
  Coding DNA Sequence Number=SeqID_87826
MVMGGFHQQTLLPCGENTETFSSLTSYPELRRSEFLIGGYVGARALLLSTTPPFAVMTQELVTRGDTLRLSAPRHSVTPNVIDEQKCGSFAPFPEMSTSFGGGPDDMQRQFFKSHPSSSRTP

SEQ ID NO: 179512 - protein, 135 aa, Glycine max
  Coding DNA Sequence Number=SeqID_87827
  Homolog annotation: Hit_ID=A1G0K8; Match level="QueryCoverage=81%, HitCoverage=20%, E-value=1e-42, Identity=82%"; Hit description =Putative uncharacterized protein
  Subcellular localization annotation: CTP_CleavageSite=86; ConfidenceScore=5.56e-01
MADWPSLRSFTSAASASLRCCRPSLSRSWLATWASSIITSPELPGPNQKRYCSQPSSRASTSSIQRQSRIGSALQRNERVTTGVTRAGAEGFLDAQQLVVLGHAIAAAQRAGLDLGGGGGHGDVGDGGVFGFAGT

SEQ ID NO: 179513 - protein, 62 aa, Glycine max
  Coding DNA Sequence Number=SeqID_87828
SYSSILTDGNGESELEASISSPSLTFGNLIRTARGKLKECQGTIRDAAIAARTHVSPLRDKG

SEQ ID NO: 179514 - protein, 46 aa, Glycine max
  Coding DNA Sequence Number=SeqID_87829
KDNSFRAPRRLRTPNVASAHVPVQEFNPIPFGVRAQSAIRRASPVP

SEQ ID NO: 179515 - protein, 115 aa, Glycine max
  Coding DNA Sequence Number=SeqID_87830
  Gene Ontology: Mol. function=aspartic-type endopeptidase activity; Biological process=DNA integration
  Homolog annotation: Hit_ID=A7R4K5; Match level="QueryCoverage=56%, HitCoverage=85%, E-value=2e-16, Identity=60%"; Hit description =Chromosome undetermined scaffold_728, whole genome shotgun sequence
MKFDGSRTMHEHVIEMTNIATRLKTLGMTVNKNFLVQFILNSLPPESDPFQMSYNTTKDKWKWNQGAEKKFMKKHDKGKSSLKINDDTLQIQNEVSKRAIIANFMGNLDISRRIA

SEQ ID NO: 179516 - protein, 52 aa, Glycine max
  Coding DNA Sequence Number=SeqID_87831
MAVGQVCPPSSSGSGHLSFKEAAGIRLPLGFNWSEHRPVKAEAAGSSPVSPI

SEQ ID NO: 179517 - protein, 78 aa, Glycine max
  Coding DNA Sequence Number=SeqID_87832
MVEVKEMRRCERVGQYGYWWYETPCQPPETWKEKRIDGKSNLEDKRTTGMDKDKTRQLRVRKRTVGRRQHRSPMMQED

SEQ ID NO: 179518 - protein, 140 aa, Glycine max
  Coding DNA Sequence Number=SeqID_87833
  Subcellular localization annotation: CTP_CleavageSite=32; ConfidenceScore=5.56e-01
GSSTTTIAAGHHRHGTSGDPTTPVPPSLSSPRSSTLFSSDDQCQSQGVPFEGTLVDDWKFDYSRHDAHRMALQANAPLPYPHLVNIFLHHFNVPLDDEPDVKVKRSFSIGAGVVTSFGYRKYADGQWVRKQDLPLPTPDE

SEQ ID NO: 179519 - protein, 194 aa, Glycine max
  Coding DNA Sequence Number=SeqID_87834
MVVGNTTIEKPGEEWSEEEKKLVQYNLKAKNIITSALGMDKYFRVSNCKNAKDMWDTLQVTHEGKIFPNEDLINKVLRCLSREWQPKEHEMELIRLNQHEENDKKKKGISVKASSSTQEGSNQPGHLRVDCPIFKKRIEKSEKKLFNEKKTKKAYITWDDNDMDPFEDSKNEVVNLSLMAKNYESDEEMTFQNH

SEQ ID NO: 179520 - protein, 227 aa, Glycine max
  Coding DNA Sequence Number=SeqID_87835
MHHSHISILIFLFTLVALLIASFLKIRTVIIVIKRKEHALRRLYRTHARARVMSEIEEVQEQMKADMDAMKDQMAAMMEAMLSMKKIMESNTAAVATTSSEQTFLPTIWLASQLYTPNVAHTPDENVDNSAPIPIESQQPQSDHAHVSQAIGETHEAPRNHNLADFKPHLRCSIEGQVVGGVPLPNTSGGPQYHPQPQPLNFVVGRVFPAMVEREKFSHIEERLRAI

SEQ ID NO: 179521 - protein, 103 aa, Glycine max
  Coding DNA Sequence Number=SeqID_87836
MRGVEAKLHGESKVIQRCFDDNKDDDKGDDKKLKGQSKNEFKMFKIESRILQDSRGKLNSRIKNQDSRDQGSRLKIQESRKSYSRIKKKLNQDKYEKVFSKTE

SEQ ID NO: 179522 - protein, 244 aa, Glycine max
  Coding DNA Sequence Number=SeqID_87837
  Pfam annotation: Domain name=zf-C2H2; Domain location=85-107; Score =24.1; E_value=0.00053; Accession=PF00096.17; Description=Zinc finger, C2H2 type
MSDELLVGGVESRKLKRKIEEASSTDVIDSEFVLSLSLGNNKMVGESSSNFLCKSLKSHQESPGFASKLVENINNHVIMPKQRQFSCKFCDKKFSSSQALGGHQNAHKRERVISRMDKDMETFGLGAHMCSYSSIPHHHPFHGPTPLYYGANMHPMAHMSAMPWPNFVLDFGNQGLRTTSISGKRFGMANPWGIAAETPPNVHRRDVGFNVEHNQVPSLDIAHRAAMARSGLSGLLGNQYTRNQ

SEQ ID NO: 179523 - protein, 147 aa, Glycine max
  Coding DNA Sequence Number=SeqID_87838
MVTMIVDTLPVFYYEKLVGYMPSSFADLVFPEERIEMGLKRGKFDYISPVGASGRRVKTAGAKKKKGDAHTVTSTPAWPKPPEPPMVPTNTHNITRVFRLTPGALPTQCSPSQGHPCPHKGELLWLRLQPSLTRPTMPTLARAGDPL

SEQ ID NO: 179524 - protein, 305 aa, Glycine max
  Coding DNA Sequence Number=SeqID_87839
  Homolog annotation: Hit_ID=Q2HW90; Match level="QueryCoverage=54%, HitCoverage=31%, E-value=4e-15, Identity=34%"; Hit description =Putative uncharacterized protein
MFGSKGENLGKSRRIGPAHGHPGTLDLRGGPLSKCGWVGGPADLYGTFDRRCEKNSARIVCCTTTLYVWLVSHLFRQEVRHVCPLEGHRSCTEKKEANWDRLLASKEGASVNWFPRWKEGRTGILISCGEFPNVPLMGTRGCINYNLVLAIRQLGYPMREAPLEEGFTPFIARGFNNTNAGVLQRVRKAWERVQKKDEELRGSSNGPIGGYRRWLKAYAQEVEGEAPEEEEEVQALKTELERAQTAKEKFKSAVVRIRKENAELRDVNIATIKALEQETKRARKEEHGQNKFRGALWVSNSELKL

SEQ ID NO: 179525 - protein, 140 aa, Glycine max
  Coding DNA Sequence Number=SeqID_87840
  Subcellular localization annotation: CTP_CleavageSite=65; ConfidenceScore=5.27e-01
MELHYASLNISSQNPDSSIFGTKDLIWKKSTTFGLAVTLNGPSQLGPSFLARGSFLASPRTRHTRSQGLKARGRTFVLYLLATQSLVASSLILIMSWTLFVVSSSTLIVSSFCCYWNNNLLVYGSSTSMGIMASLPYVSR

SEQ ID NO: 179526 - protein, 98 aa, Glycine max
  Coding DNA Sequence Number=SeqID_87841
MGIEILEPNTCIRGCCTSPSIPLHLPPSSYTLLSPIARGWECIWWSATKYPGRSRPVDGEAHATLREWDWLQVITALKGGELMESSFGSLHRRLLLNC

SEQ ID NO: 179527 - protein, 232 aa, Glycine max
  Coding DNA Sequence Number=SeqID_87842
  Homolog annotation: Hit_ID=Q6WAY6; Match level="QueryCoverage=66%, HitCoverage=26%, E-value=6e-17, Identity=31%"; Hit description =Putative uncharacterized protein
MIKVPIEAITSLTQYYDQSLGCFTFGDFQLAPTIEEFERILGCPLGGRKPYLFAGFYPSMARIAKVVKISEQELDQVKQNRNEVVGIPRKRLEEKAKALENQGEWTSFIDILALLVFGTILLSNVDGLVDLAAIDTFLAYHHNKESPVIVVLADAYDTFDLSHKLVRLTPLRGAPSKEVITSFIVQGFNEAKVKILHKIRKAWNRVGRKDKELRGSSNGVIGGYHKWLKSRT

SEQ ID NO: 179528 - protein, 157 aa, Glycine max
  Coding DNA Sequence Number=SeqID_87843
MDTYVSPLTAQITGKVVGEEEADDVHANQNDHDEGELINIVYCNFLQRQRSPNLDFIQLMFVASFIIHHPYLLWLLTVVYKTKGETKDIDLVEEEQARIGADHSSATSNKYENYKEEARKKTLKHKPKRVESVNDDAEAFGDDWKILIALCIVKLKQ

SEQ ID NO: 179529 - protein, 168 aa, Glycine max
  Coding DNA Sequence Number=SeqID_87844
MDFTKIVEISSRLLEYWILSLLRLLRPQGPTIDADEVMSRETNEVEFMGLGATATIDVEEPSSNTKGKRQGSTSSGTHSHKIEEKEGITTSLDKMANSFDRMVEKMDGKVNDEDIQEVLRETTLIPDLNRQQWAKAIKWLAEDPKQLAIVKALPIREKTDYVLTHLAK

SEQ ID NO: 179530 - protein, 91 aa, Glycine max
  Coding DNA Sequence Number=SeqID_87845
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=95%, HitCoverage=10%, E-value=8e-40, Identity=75%"; Hit description=DNA -directed RNA polymerase subunit beta
  Pfam annotation: Domain name=RNA_pol_Rpb2_3; Domain location=1-45; Score=48.8; E_value=1.8e-11; Accession=PF04565.7; Description=RNA polymerase Rpb2, domain 3
LTGRTASFRIRDIHPSHYGRICPIDTSEGINVGLIGSLAIHARIGSWGDEYYMVATGNSLALNRDIQEEQTVPARYRQEFLTIAWDKGDPL

SEQ ID NO: 179531 - protein, 246 aa, Glycine max
  Coding DNA Sequence Number=SeqID_87846
  Gene Ontology: Mol. function=unspecific monooxygenase activity
  Homolog annotation: Hit_ID=Q5CEG7; Match level="QueryCoverage=42%, HitCoverage=99%, E-value=3e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESLGFPLSVPVSELTCFDARGKRPRRARSQSVPRPARDDPLSPRKQLEQSTDRPTGSGLGPPCQPLRANSFPE

SEQ ID NO: 179532 - protein, 413 aa, Glycine max
  Coding DNA Sequence Number=SeqID_87847
LHADAGVAVAVDEADDAGKGLLLLVVPQPRAPRGDAAIGRDAGHFHHHQPGAAHGAGAQVHQVEVARHAVGAGIHGHRRHQDAVLELDAARLVRRQHGQRRPLAGRRLSAGMLGDPALEAFQPGRIAQPQVLVRDALRAGQQRIGELFGFEFRVARHVLEPFGGVAGGVLDLQHFDAAHFLVMLQAALDAAFGAAQAARQFDGVFQRQLGARADGEVRGMRRVAHQHHGHGALAAAGFQLVPMDPGVADDAREADPDGRAAQMRGVADQGIAVQPGRKQFFAVGDAFFLAHLLDAGGLPGFLGRFDDEGRHAVFVAVGMRLEPAVFGLHEGEGEGIEHLLGAEPDEAAAALVDIGMEGVGVAGVTDGLGGDRIGFAQVLHGGIREHHAPAEGVVGPVALDNGDFVGRVLQLHE

SEQ ID NO: 179533 - protein, 96 aa, Glycine max
  Coding DNA Sequence Number=SeqID_87848
  Subcellular localization annotation: CTP_CleavageSite=60; ConfidenceScore=5.13e-01
MTCRFRIFTNCLMMGAKHLTRTKERSHVIKQRAQMTTLASARQSGSLNDEVRITVRCLPRATSSWVMATKGGVVDKSEAFAPTYPPMRNSDLRSSG

SEQ ID NO: 179534 - protein, 235 aa, Glycine max
  Coding DNA Sequence Number=SeqID_87849
  Homolog annotation: Hit_ID=UPI00005EFF01; Match level="QueryCoverage =65%, HitCoverage=34%, E-value=5e-38, Identity=50%"; Hit description =COG5301: Phage-related tail fibre protein
MASGLILTAVGAEAIEAAYQAGEVVTIPIVAFGDGGGASVTPDPAVTKLVNKFGDVPFTQGESGSGMIAGQAVINAREHPGKVVREFGLMSSAGVLIAYGAYPDTYLPEQNDSIVKELVVNFAMPLVHAESVVLEIDPNISVLTIEEADARYLFRKGDTATGDLGAPMFQANGTNGIPAGAGMYKEQLDNHAPFYSPDYHWSVTPGSTYIPLVKGRGTRKGKGWPTAVSFGYLMP

SEQ ID NO: 179535 - protein, 86 aa, Glycine max
  Coding DNA Sequence Number=SeqID_87850
MTMITNSSSVPIYMTRQLVVHASFLPFDHPEHSITGESVHSVIRDFEHPDLEHYNFEHSDSEHSDFAHSENMAQPPPRERTLRGIL

SEQ ID NO: 179536 - protein, 149 aa, Glycine max
  Coding DNA Sequence Number=SeqID_87851
  Subcellular localization annotation: CTP_CleavageSite=68; ConfidenceScore=5.56e-01
WSPANSLPSAVRQFSILTFIRRPMNSLPSADSCVIHQRVWSPANSLPSAVRQFSILNLIRRPMNSLPSAVHVSSTIESGAPRIHCLALFTNSPFSTFIRRPMNSLPSSVHVSFTIKSGSPANSLPSAVRQFSILTFIRRPMNSLPSAVH

SEQ ID NO: 179537 - protein, 119 aa, Glycine max
  Coding DNA Sequence Number=SeqID_87852
MAGAGDNGGVYHQLDRFQRLLLDAMTTQMQRLLKRNNEELYRRIGGLEHQMNPNAGRPYGGSRRVNDGSNRIEGQDRIEGVKLNVSSFKGRSDPDAYLTWEMKIRHAFSYNDYLEEQKE

SEQ ID NO: 179538 - protein, 113 aa, Glycine max
  Coding DNA Sequence Number=SeqID_87853
MVGYTPSSFTDLVFASKKIEVDMKRGKFNYPAWTNEKTGANKEGEDEGETHAVTAIPIRPSFPPTQQCLYSANNKPSPYPPPSYPQRPSLNQPQTRKPVEFTPIPVSYAEGIL

SEQ ID NO: 179539 - protein, 207 aa, Glycine max
  Coding DNA Sequence Number=SeqID_87854
  Homolog annotation: Hit_ID=A4PP05; Match level="QueryCoverage=38%, HitCoverage=23%, E-value=6e-07, Identity=40%"; Hit description=IMP dehydrogenase/GMP reductase, putative
GVVALVHMYDQLDEACRTTTRQLARYLTLLQEHPTGHFVMGQLRWGAMVVTVGPERVVRQIGYIQSIPPPPVSARLSHDQIDDRWMQFADHLLPADQLCLVPGQVSADYMEWFFRISHPFMTPTQAGDQQRDAPAADPEDYIQPPSPQVPVAFDPPPHVDDYEGYEAIAQRLERVLNLRIVRAGTELYDIMQDYLTIARGGPSADGT

SEQ ID NO: 179540 - protein, 221 aa, Glycine max
  Coding DNA Sequence Number=SeqID_87855
  Subcellular localization annotation: CTP_CleavageSite=27; ConfidenceScore=5.68e-01
MGSPPASTPRPLPPPPSDASDSPSAVKRTRKASRLRSLSTRPPGAESPVVHVDPATGKADGPHRKKLRSYLGIVARDKGGRHIRELEGGPYCSEGTSFWEDIQEEFDIPEASDSRTKRKLLQTVGERWRQFKSDHTRKWAHAADQDGVEDTVCEKYGISKEKWAQFCQTRRDPPERYDVCMKAQAIQKQNTAPHVLSRGGYDYLEQKLLAEKTKKKLEEAA

SEQ ID NO: 179541 - protein, 23 aa, Glycine max
  Coding DNA Sequence Number=SeqID_87856
MTVKKRLSHEVPKVTIELSSSVG

SEQ ID NO: 179542 - protein, 398 aa, Glycine max
  Coding DNA Sequence Number=SeqID_87857
  Homolog annotation: Hit_ID=Q6WAY6; Match level="QueryCoverage=82%, HitCoverage=54%, E-value=1e-21, Identity=29%"; Hit description =Putative uncharacterized protein
DEWVPFIDVLALLIFGGALFPNMDRLVDLAAIDAFLAYHDHKESLVVAMLADLYDTYDRRCEKSSTRVVCYTPALYVWLVSHLFRQEVRHACPLESHRSCTEKGGANWDQLLANKEGASVNWFPQWKEGRTGVLISCRGFPNVPLMGTRGCISYNPVLAIRKLGYPMRGAPLEEELVPIISRGFNKANGETLQKVCKAWEVVQKKDKELRGSNNGPIGGYRRWLKAHVQRPFRTELEQAQTVKERACREEHGRNKFRGALWGSNSELKLQREEMDQSRVDSLILKDELKACSRSKKSLSQRLCETKTNMLAIITKYQEELNLVVAHEHRVADEYAQVYAEKEARGRVIDSLHQEATMWMDRFALTLNGSQELPRLLAKAKAMAYTYSAPEEIHGLLGY

SEQ ID NO: 179543 - protein, 75 aa, Glycine max
  Coding DNA Sequence Number=SeqID_87858
MGCINYNPILTIRQLGYPMRGELSEESITPFIAQGLVIPMQGYFKGFERHGAWCKERIMSLGEAAMRSSVAITSG

SEQ ID NO: 179544 - protein, 245 aa, Glycine max
  Coding DNA Sequence Number=SeqID_87859
  Homolog annotation: Hit_ID=Q2HSV3; Match level="QueryCoverage=65%, HitCoverage=24%, E-value=2e-11, Identity=32%"; Hit description=IMP dehydrogenase/GMP reductase, putative
MVHQCVVDDAYAEASPRASRCLTGKAHMMRIKGAPYRAPMEALTVTDVSWMPYAEHRGVRGFDLISSYTGQLKWGQIVVYVRPKRALRQFGYIQTIPPLPVRDSLTGPDIDDWWLHFSDHQVPMGEIYVVPSQVAPDYMDWFFWISHPFVTPTEDDAEPRHPPTPHDEEFIEPPILEVPVASDLPTHSVVDCQGCEAMVENLGAIAEHLERVINLRMVTEGIDLYDIMARCLRIARGDAADGSLR

SEQ ID NO: 179545 - protein, 326 aa, Glycine max
  Coding DNA Sequence Number=SeqID_87860
  Homolog annotation: Hit_ID=A7QHL0; Match level="QueryCoverage=85%, HitCoverage=81%, E-value=7e-99, Identity=67%"; Hit description =Chromosome chr5 scaffold_98, whole genome shotgun sequence
  Pfam annotation: Domain name=WD40; Domain location=113-151; Score =22.3; E_value=0.0018; Accession=PF00400.23; Description=WD domain, G- beta repeat
  Pfam annotation: Domain name=WD40; Domain location=228-266; Score =26.3; E_value=0.00012; Accession=PF00400.23; Description=WD domain, G-beta repeat
  Pfam annotation: Domain name=WD40; Domain location=3-41; Score=9.9; E_ value=1.9; Accession=PF00400.23; Description=WD domain, G-beta repeat
  Pfam module annotation: Pfam domain module=WD40::WD40::WD40; Domain location=113-151::228-266::3-41
MSLFRMLEVHAHTESCRAARFINGGRAILTGSPDCLILATDVETGSTIARLDDAHEAAINRLINLTESTVASGDDEGCIKPLFNLQPPITILKMVAILMFELWEGQVWDIRERSCCNSFNSHEDYISDITFVSDAMKLLATSGDGTLSVCNLRRNKVQAQSEFSEDELLSVVLMKEKLKDIKDVLILFDRFTDLSSNSIDAMLKLDEDRIITGSENRIINLVGILPNRVIQPIAEHSEYPVECLAFSHDRKFLGSISHDQMLKLWDLDNILQGSGNTQSNEAGAVDSDDDEMDLDDDPSKNSKGNKRKNANNGNALGGSNNFFADL

SEQ ID NO: 179546 - protein, 143 aa, Glycine max
  Coding DNA Sequence Number=SeqID_87861
MIHVVKNVRIPKYLDLEWFFQQGFNISNMLEVQGLPKLVQMKKIFYPELVKVFYSYACVDLEGNLFSIVNGVDMVIDVSMWKEIIGLDMGKVHKFDETPNGYNKMQTYRGMLLDPARNLRNRLGVGGLTIEDRMYQDELGTID

SEQ ID NO: 179547 - protein, 41 aa, Glycine max
  Coding DNA Sequence Number=SeqID_87862
MAAHGGHWWSWVVEETGILLNELILLSGNPLLALSMACRAE

SEQ ID NO: 179548 - protein, 116 aa, Glycine max
  Coding DNA Sequence Number=SeqID_87863
MTGPFSWDETYQQAFLASKKTTATPSVLSDPGQECFDDNKDDDKKAKRMISRLSQEQFKNQEFQVLRFKNQVSSFKFQKSRIKNNQDQDSRLKIQKSRKDSIKISTKKFFNTLSST

SEQ ID NO: 179549 - protein, 91 aa, Glycine max
  Coding DNA Sequence Number=SeqID_87864
  Subcellular localization annotation: CTP_CleavageSite=59; ConfidenceScore=5.13e-01
MDALVLIREIWAAFHVRGIALSSNSCSRYTPLSRLVVILERPSQLGPTFPAQGSFLAIRGRRVESSLLVDGSPTSMRIMAFVPYWYAQSML

SEQ ID NO: 179550 - protein, 55 aa, Glycine max
  Coding DNA Sequence Number=SeqID_87865
MDTHLSQDGVDQLTLRQGEGGHASAHDPHSSPRHTPGKILPQNAQQLAYGLLIKA

SEQ ID NO: 179551 - protein, 68 aa, Glycine max
  Coding DNA Sequence Number=SeqID_87866
ISRICPLDLMLKYVQFQLSLAHQWAKCASTAKRSFSALNEIEESGRASILRLRAKREFSVLSAAVVFS

SEQ ID NO: 179552 - protein, 395 aa, Glycine max
  Coding DNA Sequence Number=SeqID_87867
  Homolog annotation: Hit_ID=Q2HW90; Match level="QueryCoverage=43%, HitCoverage=40%, E-value=3e-14, Identity=31%"; Hit description =Putative uncharacterized protein
MPARRKKTISLFWVLRPPWKHLEEKAKALADQGEWASFIDVLALLVFRVVLFPKVDGLVDLGPTDAFLDYHHSKQSLVVAVLVDAYDTFDQRCKKSGARIVYCTPALYVWLVSHLFHHESRLICPLEGHRMCAEKGKASWEQLLAGFSNVPLMGTRGCINYNPILAIRQLGYPMGGAPSKESITPFIARGFSDPNARMKDKELRGSNNGIIGGYHKWLKARMQEITWLQKLKLSSEEEAETPKESEKVQALKVELEKVQAVKESNNELKLRRAKRDQSRVEGMILENKLKACQRSKRHLSEQLSRTKENMWAIINQYKEKLNLASTHEQRSKDEYAKVSVLQAKREAREKVIDSLNREAIMWMDRFSFTLNGSQELPRLLAKAKAMMDMYSAPEE

SEQ ID NO: 179553 - protein, 148 aa, Glycine max
  Coding DNA Sequence Number=SeqID_87868
MDMMGRSMFMRRTQLSTISMMSLITRSRHLSWYLYSACSWHMTDESGYGVFFNKDECAVKCKDMYSLFSIKGKSNLYKIRLGEPSDQKPLGPPGPTRKLRAEVTSSPRREGVKEKGPTPEIKRFSVKLVRKRRKKKKNQGRGASVTFS

SEQ ID NO: 179554 - protein, 54 aa, Glycine max
  Coding DNA Sequence Number=SeqID_87869
MILLPFIPAEELLPRECTEEPSSTVENNNCIRRFFRGITRKMFFRRNARKNLLP

SEQ ID NO: 179555 - protein, 144 aa, Glycine max
  Coding DNA Sequence Number=SeqID_87870
  Homolog annotation: Hit_ID=A2Q1D6; Match level="QueryCoverage=73%, HitCoverage=16%, E-value=5e-10, Identity=35%"; Hit description =Ovarian tumour, otubain, related
MDENQWMYDSIMFQDVDMDDQNEQECGVNEPHVDCSDAFNISQMFDSRDDVLQWARSVAHENIFVAVIIRSNTNTGSRGRTSFVLIGCEMSGEYRCRKKEFVRRDTGTRKFGCPFKLHGKLVVGGQGRMVKLMCGIHNHELAKS

SEQ ID NO: 179556 - protein, 33 aa, Glycine max
  Coding DNA Sequence Number=SeqID_87871
RSTSVSDSVEILHRSSSFFTVLHPFFVRSSFFN

SEQ ID NO: 179557 - protein, 79 aa, Glycine max
  Coding DNA Sequence Number=SeqID_87872
MVARQDIAEQQCHPYLGQVVMLVRMIRTRLPAAVRAKSCPESSLFVVPPGTLSSVESASDADMIYSEKSTSRSGSSSSS

SEQ ID NO: 179558 - protein, 162 aa, Glycine max
  Coding DNA Sequence Number=SeqID_87873
  Subcellular localization annotation: CTP_CleavageSite=35; ConfidenceScore=5.25e-01
MSVGSLMGSTGRSGTSTSDRAIPVSCAGGLLLFITDQRGSCGSLATRRSFLILLSIHGSRMMIYMIGGCTTRIISYQHAPQTGIPHVPEPGASSTSAEEPRHAVKVCDDIAERLEHHLSLGVVMPGSSTHEVIEEFLRLARSVTQDHLVYVRCRRRRRTDQA

SEQ ID NO: 179559 - protein, 120 aa, Glycine max
  Coding DNA Sequence Number=SeqID_87874
MCWFRIGSKIPLAIYTLGMIAKYLDVLEIPRCAHVQFLVPQNALSMHVCKFSQGDVCDEMAPRKIASKRSRKDKAAEGTSSAPEYDSHRFRALYTSSASRPSRDGRFSGSDASSSGTTIY

SEQ ID NO: 179560 - protein, 122 aa, Glycine max
  Coding DNA Sequence Number=SeqID_87875
MKDKRDEEEKLENQKKKKDSKALSSKAKGKEKEEKDSSKKIVKKKNYFATKCDIKEALLLKQSFYLLLSRETSLSTAIPLSLSNQGFPMDPKRIKVIPEWPTPPCIREIWGFNDLTNFYKRC

SEQ ID NO: 179561 - protein, 58 aa, Glycine max
  Coding DNA Sequence Number=SeqID_87876
MTRQMQGMSDDTVWIYMHESTWLMKRNILDEQPCGMEKEEREETPLQGEDESRRSSPP

SEQ ID NO: 179562 - protein, 42 aa, Glycine max
  Coding DNA Sequence Number=SeqID_87877
MGKDGHSHPGSRFMVSWDFGSRLVERLDIMYVRVWVWPAVQG

SEQ ID NO: 179563 - protein, 114 aa, Glycine max
  Coding DNA Sequence Number=SeqID_87878
MSSTSEDCMFSPSEGYTSFRRLHVLAFRELHALAFRGLHILAFRGLHVLAFRGLLILAFRELHVLAFRGVATYPSRASEGEAHGCASQRRKDAWSRHQRLFMENVGKTEGNRSK

SEQ ID NO: 179564 - protein, 153 aa, Glycine max
  Coding DNA Sequence Number=SeqID_87879
  Homolog annotation: Hit_ID=UPI00006A2D9E; Match level="QueryCoverage =84%, HitCoverage=87%, E-value=2e-09, Identity=16%"; Hit description =UPI00006A2D9E related cluster
MTGPLDKSISSFLIRVDPWVLVPIGFRGLHVHTFKGLHALTFRGLQVLAFRGLHVLTFKGLHALAFRGLHILAFRGLHVLTFRGIHVLTFRGLHALTFRGLNVVAFKGIHALAFRGLHALAFRGLHVLALEDNQSSPSEGYTPSPSEDYTSSP

SEQ ID NO: 179565 - protein, 108 aa, Glycine max
  Coding DNA Sequence Number=SeqID_87880
MHPGTIKAPSLPRSLICTSKVYLLPTSHALPLLNLHTCILKAFWLPKIAYVHILKICANQIPHGLFPYESHALMPLRHFTEHLVGARLGINSKRTGTMWHVPLLQNAL

SEQ ID NO: 179566 - protein, 130 aa, Glycine max
  Coding DNA Sequence Number=SeqID_87881
  Subcellular localization annotation: CTP_CleavageSite=64; ConfidenceScore=5.18e-01
MASTRHPLDLEKSNRALGFPALITGLCQFYGVHVTPSKAGTGRRTSGRGRTATTSIGRSGWATESGAGQGSAPFVCPTPEQFGAEVSWPGDWPDAPTGEEPTESPGEAEESRMDEDMTDLLGFLGGSGAT

SEQ ID NO: 179567 - protein, 228 aa, Glycine max
  Coding DNA Sequence Number=SeqID_87882
  Gene Ontology: Mol. function=DNA binding; Biological process=DNA recombination
  Homolog annotation: Hit_ID=Q6D8C0; Match level="QueryCoverage=98%, HitCoverage=49%, E-value=5e-80, Identity=62%"; Hit description =Putative integrase
MILSQSIVINKLSIETKPEFDSDGRIMYVPNVSGKPYLITDSHRDSPVGFGVKISSTKKTYIIQRRVSGGGRSPSEGKSPSQAREVARTYAQSMKSTKRNPNAVKREADIAELTLSEIFAQYRQHLLGRSKPAKPNSIRVLDKAEQKLKEWERYRVRDLTGSLILKKFDEIASKTRTTAEQTFRWANVAVQHSIDLEAMNAQSQQRLPVLTYNPFTVLRVQKIYRRSL

SEQ ID NO: 179568 - protein, 232 aa, Glycine max
  Coding DNA Sequence Number=SeqID_87883
VDVLSYSNLAPTSHTLDLTVDRARLIFGLVSHMDMNIDAFILGQMTSIVQSNSWVVSDSLTFESLSPIINLAYIRKKCWNPDDLTVTFQGTRRARARPAHIPSTSAAPSPTLASTSIAPSVPTHVVAPPGSILSVEQFLERVAWLGAQPSLDREGEGPTTQARPEMATTPERSLEGRPEPPTPVVDLSSPQLAADPSTPVLDIPEDQTTLVLALNTSPPATPVLHLTDEEDA

SEQ ID NO: 179569 - protein, 123 aa, Glycine max
  Coding DNA Sequence Number=SeqID_87884
MAFLGETSSQTIVNSSLKTRIHNTLQLSDKQFLDENSLPEAIHRYRTPDGIINLLECTMPRIHDAILYYNGKWNMPPQNKFVTGKNPKKFQIPSTCTIDELKNLIKQVAPKGIPPLGIHESQT

SEQ ID NO: 179570 - protein, 155 aa, Glycine max
  Coding DNA Sequence Number=SeqID_87885
  Gene Ontology: Mol. function=nucleotide binding; Cellular component =cytoplasm; Biological process=defense response
  Homolog annotation: Hit_ID=A7PG69; Match level="QueryCoverage=77%, HitCoverage=18%, E-value=6e-23, Identity=47%"; Hit description =Chromosome chr6 scaffold_15, whole genome shotgun sequence
  Pfam annotation: Domain name=LRR_1; Domain location=2-23; Score=7.3; E_value=13; Accession=PF00560.24; Description=Leucine Rich Repeat
  Pfam annotation: Domain name=LRR_1; Domain location=25-46; Score=8.6; E_value=8; Accession=PF00560.24; Description=Leucine Rich Repeat
  Pfam annotation: Domain name=LRR_1; Domain location=48-69; Score =12.9; E_value=1.2; Accession=PF00560.24; Description=Leucine Rich Repeat
  Pfam module annotation: Pfam domain module=LRR_1::LRR_1::LRR_1; Domain location=2-23::25-46::48-69
MVLKVLDFEGSGLRYVPENLGNLCYLKYLSFRYTWITSLPKSIGKLQNLETLDIRDTRVSKMPEEIRKLTKLRQLLSYYTGLIQWKDIGGMTSLQEIPPVIIDDDGVVIGEVGKLKQLRELLVAACPMGDVNKVAKLDFTVPKSCATVFGGLQVD

SEQ ID NO: 179571 - protein, 33 aa, Glycine max
  Coding DNA Sequence Number=SeqID_87886
MVNWASLGKDCFHLLAKPICWLSEHPLSATLLA

SEQ ID NO: 179572 - protein, 109 aa, Glycine max
  Coding DNA Sequence Number=SeqID_87887
MDKSMIDATSEGALMDKTLVVARQLISYMIANYQQFGTRVAATSKVIANEVSVSMVADNQRLENKLTELTSLFGQPFRPQQQQYNPYSNTYNLGWRDHPNLRYGPSPQQ

SEQ ID NO: 179573 - protein, 261 aa, Glycine max
  Coding DNA Sequence Number=SeqID_87888
MAPISNILPERNVELSVETVALETINDFFETPVVLDDREDYLAYSQYLHTYPDHQAIATTLYTPGGGFVLNADGAPWKPLRKDLTTLVQTWSILSYFNLAPTFYTFDLNVGRARVIFDTLTFESLSPVINLAYIKKNYWNPTNLSITFLGPRCVQARATTSDAQPLTQPLPPPATHRQPPSTSVSMDPQRQMLQSIYQGHQIIVQGLHRLSVHLGMDPPLTTPEAFIQQVAWPGVQPSTDGGVSPLRSETLLKPKLGMTSL

SEQ ID NO: 179574 - protein, 65 aa, Glycine max
  Coding DNA Sequence Number=SeqID_87889
MAARPSELRLNHEATGLPRRAGYLTWKSFGSPGEPEASLVTLLFDWAIGENQGSETEKHEDIEVL

SEQ ID NO: 179575 - protein, 101 aa, Glycine max
  Coding DNA Sequence Number=SeqID_87890
MVPRSRSEGIRRNKREEEERRGKQGRGAVESRPSSIPTPFLAPCSSFVIRTRESSKNNEDPFAKKPFRLHQETDRRSRNKKSGTIAVVNERKCTVRGETSH

SEQ ID NO: 179576 - protein, 194 aa, Glycine max
  Coding DNA Sequence Number=SeqID_87891
LRVPFYIGGLDDEGGVSQSQSTQYCQDKFLHNAQIVSFGEIKTLRQDCYCLTVGTVDEVQPAIRARIMLLTLFQVCIKIFGKTANECRQELIASDDEIKVFPACVDQLLGKTWVVRFKHRIQMHQSSVFDFSEQEHHIQSVISTLGLQSSEYDPGNAAFVTPAKRTSDQQGSRQFDSDDFATYELSTNKHIKAE

SEQ ID NO: 179577 - protein, 82 aa, Glycine max
  Coding DNA Sequence Number=SeqID_87892
MEDADFGGEGRGTGRGFSVSAGAGVVVGGGRGGWTNGGNLCCINKFMLKSTESLKRGWLQRLVSDFNQRRFKNIDLGSKMSM

SEQ ID NO: 179578 - protein, 50 aa, Glycine max
  Coding DNA Sequence Number=SeqID_87893
MATRGGHRWSWVVVKKIKLSTTISRSRNPLLALSTASRAEQISSWVGNCA

SEQ ID NO: 179579 - protein, 107 aa, Glycine max
  Coding DNA Sequence Number=SeqID_87894
MEPATEELITKHNSHLKYFQCHHVGLAAPTKESLSTSSTPTNEGSQSSQVPITWYKIARRTELKEEAIMRAWDESVSDCEVLEVEETSPLLEASQIWRAKSSVGSSL

SEQ ID NO: 179580 - protein, 120 aa, Glycine max
  Coding DNA Sequence Number=SeqID_87895
MVVILPKENVVIWFCSLHNRPDNYLKGMIDSALKEFDESPQTKSKAAGRWIVVKCNRQKVSTKCVYYVMHWISTIILGSFKNNWETYSNDARPLEPERMKVHRIQWATYYLKVKNETISV

SEQ ID NO: 179581 - protein, 314 aa, Glycine max
  Coding DNA Sequence Number=SeqID_87896
  Gene Ontology: Mol. function=structural constituent of ribosome; Cellular component=ribonucleoprotein complex; Biological process =translation
  Homolog annotation: Hit_ID=Q9M3V8; Match level="QueryCoverage=71%, HitCoverage=90%, E-value=7e-94, Identity=79%"; Hit description=40S ribosomal protein S6
  Pfam annotation: Domain name=Ribosomal_S6e; Domain location=68-196; Score=266.0; E_value=7.7e-77; Accession=PF01092.10; Description =Ribosomal protein S6e
MIAIGLDIAQLGPTNFVEEPSWGPRVTARVGIKSELKTLLSPYRAHVPSFLIAHREFDAAVAEEDCKMKFNIASPTTGCQKKLEIDDDQKLRAFWDKRISQEVSGDALGEEFKGYVFKITGGCDKQGFPMKQGVLTPGRVRLLLHRGTPCFRGYGRRNGERRRKSVRGCIVSPDLSVLNLVIVKKGENDLPGLTDAEKPRMRGPKRASKIRKLFNLSKEDDVRKYVNTYRRTFTTKAGKKVSKAPKIQRLVTPLTLQRKRARIADKKKRIAKAKSEAAEYQKLLASRLKEQRDRRSESLAKRRSKLSSAAKAAV

SEQ ID NO: 179582 - protein, 121 aa, Glycine max
  Coding DNA Sequence Number=SeqID_87897
MGAQILQELCIFWNLFDGIQEGNVDFHPPESLKKIRIKLHFICRNGSRRKRYRNLFWHQHLLNLEALCHSSRLPFASSAPPRKVHNYYSTQVVQDHTSSSDDLSNQDYKCWSKDYIVVVEV

SEQ ID NO: 179583 - protein, 56 aa, Glycine max
  Coding DNA Sequence Number=SeqID_87898
MSRVATIVYLRKTLEKLKRQGLRSFENKGSGVIYARGRVFPLLLRILGWAEEFRPT

SEQ ID NO: 179584 - protein, 394 aa, Glycine max
  Coding DNA Sequence Number=SeqID_87899
  Pfam annotation: Domain name=RRM_1; Domain location=51-121; Score =11.8; E_value=0.012; Accession=PF00076.13; Description=RNA recognition motif. (a.k.a. RRM, RB
EDTGTKLVSRRSMKVMQKSSLAGRQSQNLEIGDYNKHYRLNWRNNADITSFYFTHFPDEANEELLWRHFKKWGDVHEVYIAKRLNKDGRRYRFMRFKGVSDAKGLEVRLDNIFINDCKLFVNLPRFDRPVRNTELQKKNPIGRKYTDEASKPCGVTIGALRRSYVDVVTKGGCQGDKRTDEAQTPTILINPDEGGEYWCNETWVGMLKKVWEMKNIRRAVAAIGDVIESDDDTEDRRRLDRARVLVRTPLPPLIRSEVIIRVGELEYRVWIVEETGFEGGSNRKGSSPSDGWSEMITSDDEGEVGDVLDDTNTNFSFSPELPNQKLSPSRTQRAEGGTDVRCCDLRPLGNIQADVTPKEKSKGTVEGMLGSSFGKLNLGDSFAGTEEEAANTKE

SEQ ID NO: 179585 - protein, 94 aa, Glycine max
  Coding DNA Sequence Number=SeqID_87900
MQLSARSMSDERAGTDSVPFIIQEQRVEWNNKLGGKRAEIDSAPFIIQEQRVSGTKSWVVNTQRPIMCPLSFRNNKLGGKRAETNSVPFIIQEQ

SEQ ID NO: 179586 - protein, 102 aa, Glycine max
  Coding DNA Sequence Number=SeqID_87901
MQVEGYSICGGAQESGCCIPQDDSAKEVNYMGNQNKQGFHSSGFSGYQQGGNFNQNQGKGWRSHLGNHFNKDQVGPSNKPPNQGPNLYERTTKLEETLAQFI

SEQ ID NO: 179587 - protein, 60 aa, Glycine max
  Coding DNA Sequence Number=SeqID_87902
  Gene Ontology: Mol. function=aspartic-type endopeptidase activity; Biological process=DNA integration
  Homolog annotation: Hit_ID=A5BCY8; Match level="QueryCoverage=85%, HitCoverage=6%, E-value=7e-11, Identity=57%"; Hit description =Putative uncharacterized protein
MRKLGAKRAKDILELSFKAEVELQHGKKIRAVKFDCGGEYYGRHDGSGEQRPELCQANLA

SEQ ID NO: 179588 - protein, 82 aa, Glycine max
  Coding DNA Sequence Number=SeqID_87903
MTRGNPGDLQPFDPEIDRTFHRLVRHSVHPDHSVHFELYEYSVAGDSEYSDFEHSTTNFHTENMVQPPPYERTDMSSFSHIS

SEQ ID NO: 179589 - protein, 75 aa, Glycine max
  Coding DNA Sequence Number=SeqID_87904
MAEINQGKMMTAHDWSHIILALTRRYIGTDASRARVMTDRSLPLPGTKQAENVAARQPSILCGRSFFYYLFVLNG

SEQ ID NO: 179590 - protein, 192 aa, Glycine max
  Coding DNA Sequence Number=SeqID_87905
  Subcellular localization annotation: CTP_CleavageSite=43; ConfidenceScore=5.03e-01
NSDWINSPSFTCQFVMTFVVGSPMILVSKELVLDLFSVCTLVMLEEPSPLRFILRRIEIFPEGMLEVVSNPWRFTVGNWLCDSDLVSPTGIERVLTEKDLLADSYSDLEASILDEKEFLLLKVISTFPELSCLICSMVGAGRGIDGVALSITHLSGRVTSSHFIFLGRDTLAFVISVINKAAGIDPSFMSRP

SEQ ID NO: 179591 - protein, 109 aa, Glycine max
  Coding DNA Sequence Number=SeqID_87906
  Subcellular localization annotation: CTP_CleavageSite=37; ConfidenceScore=5.03e-01
MGSLAQDSASPSQGGRRSHRSEPLIRRKRLVETQEAAATLEKSLETTSEPSEPVADTVSIQQVADPSTPEDQTTPVLSQNTSPLATPVLHLTDEEDVQTQDTQDRSQDF

SEQ ID NO: 179592 - protein, 90 aa, Glycine max
  Coding DNA Sequence Number=SeqID_87907
MARTKKTGEMTTEAAKEIAQKIATQGSFVPHGRQDVLAATIGRPEYPGRVRAAGASVTIKQYFGSAPRTSRNASSLPPDKLQQLTQQIRD

SEQ ID NO: 179593 - protein, 108 aa, Glycine max
  Coding DNA Sequence Number=SeqID_87908
  Gene Ontology: Mol. function=RNA-directed DNA polymerase activity
  Homolog annotation: Hit_ID=Q2HSQ4; Match level="QueryCoverage=73%, HitCoverage=84%, E-value=1e-18, Identity=60%"; Hit description=RNA -directed DNA polymerase ; Zinc finger, CCHC-type; Peptidase aspartic, catalytic, putative
MAQIEESQEVTMARFLHGLNREIQGIVKLHHYDSFEDLIHQAIKVEQQLKRKKIYKKSPYGSSTWKDKETFKKEGGSSFKSHEKVYLILVLLVKVKVNVMYNPWKVIF

SEQ ID NO: 179594 - protein, 377 aa, Glycine max
  Coding DNA Sequence Number=SeqID_87909
  Gene Ontology: Mol. function=oxidoreductase activity; Cellular component=mitochondrial matrix; Biological process=metabolic process
  Homolog annotation: Hit_ID=A6T782; Match level="QueryCoverage=100%, HitCoverage=80%, E-value=0.0, Identity=87%"; Hit description =Aldehyde dehydrogenase
  Pfam annotation: Domain name=Aldedh; Domain location=1-371; Score =522.8; E_value=3.8e-154; Accession=PF00171.13; Description=Aldehyde dehydrogenase family
EELALLETLDTGKPIRHSLRDDIPGAARAIRWYAEALDKVYGEVAPTGGNELAMIVREPIGVIAAVVPWNFPLLLACWKLGPALAAGLAKEAGLPDGVLNVISGFGHEAGQALALHPDVEVITFTGSTRTGKQLLKDAGDSNMKRVWLEAGGKSANIVFADCPDLQKAVNATAGGIFYNQGQVCIAGTRLLLEESIADEFLALLKAQAQNWQPGNPLDPDTTMGMLIDNAHADSVHSFIRGGETKSTLFLDGRKNPWPAAVGPTIFVDVDPASTLSREEIFGPVLVVTRFKSEEEALQLANDSDYGLGAAVWTRDLSRAHRMSRRLKAGSVFVNNYNDGDMTVPFGGYKQSGNGRDKSLHALEKFTELKTIWIALES

SEQ ID NO: 179595 - protein, 406 aa, Glycine max
  Coding DNA Sequence Number=SeqID_87910
  Gene Ontology: Mol. function=transferase activity; Cellular component= cytoplasm; Biological process=sulfate transport
  Homolog annotation: Hit_ID=A6TAC1; Match level="QueryCoverage=54%, HitCoverage=42%, E-value=4e-94, Identity=78%"; Hit description =Putative rhodanese-related sulfurtransferase
  Pfam annotation: Domain name=CDO_I; Domain location=1-166; Score= -24.6; E_value=0.00011; Accession=PF05995.3; Description=Cysteine dioxygenase type I
  Pfam annotation: Domain name=Rhodanese; Domain location=181-274; Score=42.0; E_value=2.1e-09; Accession=PF00581.11; Description =Rhodanese-like domain
  Pfam annotation: Domain name=Rhodanese; Domain location=303-398; Score=31.3; E_value=3.5e-06; Accession=PF00581.11; Description =Rhodanese-like domain
  Pfam module annotation: Pfam domain module=CDO_I::Rhodanese::Rhodanese ; Domain location=1-166::181-274::303-398
MTAPRVEKLRQFIQDLDALHRQFTDEATLLDAVAERLASLVQKDDWLPEEYTLPHPHHYQQYLLHADSGQRFSIVSFVWGPGQSTPIHDHRVWGAIGMLRGAEENQRYRLDERGLPIATGPAERLSPGKVEKVSSRDGDIHRVSNALADHVSISIHVYGANIGSVRRAVYTADGIAKPFVSAEVRQALIDGTKVALIDVREEAVFATNHPLFAANLPLSKLELEIFRRVPRLTTPITLYDNGEGLAEQALERLQRWGYQDVALLAGGLTGWKRSGGELFQDVNSPSKAFGELVESERQTPSLSAEEVKALIEGPQPVVVVDARRFDEYQTMNIPGSISVPGGELALRIEGLLPSAQTTVIVNCAGRTRSIVGTQSLRNAGLANPVYALRNGTIGWTLAGLSRARPT

SEQ ID NO: 179596 - protein, 248 aa, Glycine max
  Coding DNA Sequence Number=SeqID_87911
  Gene Ontology: Mol. function=helicase activity; Biological process =protein amino acid phosphorylation
  Homolog annotation: Hit_ID=Q9LTU4; Match level="QueryCoverage=100%, HitCoverage=21%, E-value=7e-47, Identity=38%"; Hit description =Helicase-like protein
MSKPEQVWDQTWHWMADDIVYNYKKSSTSPALQLDDRTLQNLVLLEIEELLQANQRSLRDYPSMPYPEDANCPAYLDNSLILVELNYNNQELRSEFEHLFSHMTAVNKDEGGMFFLYGYGVSVFEDSTCNIHQGTQLAKLLNQTSLIIWDEAPMAHKFSFEALDHSLRDIIKHNSKDNKIFGGKVMVFGRDFWQILPVIPRGSRSDIVNATMNSSYLWDHCQILRLTKNMHLQNNMQAIDQEEIVAFA

SEQ ID NO: 179597 - protein, 61 aa, Glycine max
  Coding DNA Sequence Number=SeqID_87912
MGHLSGQGVPMNPKRIKVIPERPTPPSVEGKSLEFQEPLDLRSNPFQGGGNDEILPTKGIG

SEQ ID NO: 179598 - protein, 193 aa, Glycine max
  Coding DNA Sequence Number=SeqID_87913
  Subcellular localization annotation: CTP_CleavageSite=50; ConfidenceScore=5.42e-01
MAFRHPRCDRTHPGAAPRMARAAGRSFSLCNARRSRAALHHSFAGALRPSAARVGYTHPRSSERRRRADDLCAGSSGANRQRRTGVGVAGCCPGRKCHGVSPHAPSALRRTSPRRSRDCSGPARSRGFECQHRLGRGARGDTPARPAFHTGTATALSDTDHCRHYPVYCSGGPSGWHCAFHRTSSHTVASWRC

SEQ ID NO: 179599 - protein, 256 aa, Glycine max
  Coding DNA Sequence Number=SeqID_87914
  Gene Ontology: Mol. function=histidine ammonia-lyase activity; Cellular component=intracellular; Biological process=biosynthetic process
  Homolog annotation: Hit_ID=Q2K075; Match level="QueryCoverage=52%, HitCoverage=27%, E-value=3e-49, Identity=74%"; Hit description =Histidine ammonia-lyase protein
  Pfam annotation: Domain name=UTRA; Domain location=1-117; Score=65.6; E_value=1.7e-16; Accession=PF07702.4; Description=UTRA domain
METCDAELAEAPSVDVGATVAHSIIVHAEDSVPMQIEDRFVNHGIVPDYVNQDFSTRTPNGYLTAVAPIIRAEQHIEAVTAQPWECKLLAISKAEPCLLVRRRTWSDVGVISSTAFPEENLMTVMLDKALSWHDVALVSQGDHLVLSDEAYRRIERASRIVDGIVENGIRAYGVNTGVGALADTVVDRAAQGKLSRSIVLSHACGVGPLLGRHEVRAIIASQIANFAHGYSGVRREIVAHLTRFLECDCIPDVPSK

SEQ ID NO: 179600 - protein, 95 aa, Glycine max
  Coding DNA Sequence Number=SeqID_87915
  Subcellular localization annotation: CTP_CleavageSite=38; ConfidenceScore=5.03e-01
LIKVILVGGYPDLSSFTGSGVYPDLSSLTGSGVYPDLSSFTGSGVYPDLSSFTGSGVIQKLYSLYQVIRPAMKLQEGDQLDVLCLLKVAVHEESP

SEQ ID NO: 179601 - protein, 426 aa, Glycine max
  Coding DNA Sequence Number=SeqID_87916
  Gene Ontology: Mol. function=transferase activity, transferring phosphorus-containing groups; Cellular component=cytoplasm; Biological process=phosphoenolpyruvate-dependent sugar phosphotransferase system
  Homolog annotation: Hit_ID=A1FRD9; Match level="QueryCoverage=100%, HitCoverage=48%, E-value=0.0, Identity=84%"; Hit description =Phosphoenolpyruvate-protein phosphotransferase
  Pfam annotation: Domain name=PEP-utilizers; Domain location=9-87; Score=87.9; E_value=3.1e-23; Accession=PF00391.14; Description=PEP -utilising enzyme, mobile domain
  Pfam annotation: Domain name=PEP-utilizers_C; Domain location=112 -399; Score=540.0; E_value=2.6e-159; Accession=PF02896.9; Description= PEP-utilising enzyme, TIM barrel domain
  Pfam module annotation: Pfam domain module=PEP-utilizers::PEP -utilizers_C; Domain location=9-87::112-399
LDPSAAGGGLADLPAQPCILLAADLSPSDTANLDTTRVLGLATALGGPTSHTAILSRTLGLPALVAGGAELLAIQAGREAIIDGSSGRLYLSPSEADLASARAWIAGQQQIRAREAAQRAQPAQTTDGHRIDIGANVNLPEQVPLALEQGAEGVGLMRTEFLFLERGSTPSEDEQYATYMAMANALDGRPLIVRALDIGGDKQVAHLELPHEENPFLGVRGARLLLRRPDLLEPQLRALYRAAKDGARLSIMFPMITSLPELVALRAICERLRTELEAPDVPIGIMIEVPAAAAQSDALARHADFFSIGTNDLTQYVLAIDRQNPELAAEADSLHPAVLRAIRATVDGARTQGRWVGVCGGLAGDPFGAMLLAGLGVDELSMTPNDIPSVKARLRGTALADLQRLANAALDCETAEQVRALDGAGA

SEQ ID NO: 179602 - protein, 50 aa, Glycine max
  Coding DNA Sequence Number=SeqID_87917
MRKRHAFPKGERRTVIRGAEPMEKRQQRGLFTVPGLLLAFCSHVLSCVIP

SEQ ID NO: 179603 - protein, 170 aa, Glycine max
  Coding DNA Sequence Number=SeqID_87918
VVEVLPVKISIPWIIGLNQARAFKKKVRQVKVKYGSNQLAKVGAEDGSEEVQERMKADMEAIKEQMVIMMEAMMSMKKITEVSAAAVAATSAVAEVDPTPPSSLNQINHPTSDMNKHAFPSYGLPPNYTPPNVTHTPDDNVNNSTPILFESQQPQSDHAHVSQPMGETHE

SEQ ID NO: 179604 - protein, 313 aa, Glycine max
  Coding DNA Sequence Number=SeqID_87919
MESNHLREQKKAKTSKKKQGECSQVVINHLDTWFTNKSRKNDYKMIYVVKNMRVPKYLDLEWFFQQGFNFLNLLEVQGLSKLVQMKGTFYPKLLKVFYTCAHADLEVDMVIDATVWKEVTDLDMGGVCKFNEMSIGNRLGVGGLTAKDKMLVYLITYILTPRSSNHAQEVTDDDLQIVYGLKSGIKMNWVLLIKDIMLKCRRLVDYEFPYDVLASRFIDYFKVDVSNEIVDFAKASSEITDRHLKKLGMRFVDHEWIMAGEPTAGNKMDTMLHLHQDQSTRVHSSLENITSRLENIETSLTFSNLLNPDEDEA

SEQ ID NO: 179605 - protein, 52 aa, Glycine max
  Coding DNA Sequence Number=SeqID_87920
MATIMAIEFDASNNRSKLWLETNSQLLVHAFTHPTIVHWTLYTKWMNCMKFK

SEQ ID NO: 179606 - protein, 311 aa, Glycine max
  Coding DNA Sequence Number=SeqID_87921
MAPKKLPAKRARKDAAGEGSSAATQVDVEFDGHRFQSKEHQHFFEAIKGWSFLKERREEIARRQWTQLATPMTKYDPEIVMEFYANAWLTKEGVRDKRTWLCVPGQDFARSVARRWVQIMHTSMTTLTQIWMTLLLSNILTNDHNSDLPLPKCQLVYAILTQVSVHVAQLILDAIYQFVGITPSRHPVDPEKSNRALGFPALIMGLCQFYGVSGEDQQQPAVDAPPPPLLQPPSLKSIFAHLRRIELHMHAYMKHVTDQQAANHRGQFRATIAWLGDKPNFQAGEGPATALGDEDRAQEDDGTTNVMEYFL

SEQ ID NO: 179607 - protein, 170 aa, Glycine max
  Coding DNA Sequence Number=SeqID_87922
MDSIRFTAPFKVQKNLLQVPFTYHRQWLRNYPKYVLFHYDGEIHFIRVRTLGTKCFFADGLNDFRRAYNLNESVILRLVAGDKNTTFTVYIDGPAHHHSSLKPIIYRRRYIFTVDIIDDMLQQNLPLTLPAAASKFVYGSKKSITIHHGLSKSTKWPLTIHHDIPAITQP

SEQ ID NO: 179608 - protein, 59 aa, Glycine max
  Coding DNA Sequence Number=SeqID_87923
MALKRWPQMMHPLHVMVPGLWDLHLPCEEKVGPQARLLSLETAQWKERILEEPPPVNSE

SEQ ID NO: 179609 - protein, 111 aa, Glycine max
  Coding DNA Sequence Number=SeqID_87924
MAGAGDGGGDYHQLDGSQCLLLDAMTTQMQQLLNRNNEELYRRIEGLEHQMNPNAGRPYGWNRRTYQGNPCGIYPDLSFFTGSGVIQISVACIKRSVPSQDHIIWYQSFDS

SEQ ID NO: 179610 - protein, 53 aa, Glycine max
  Coding DNA Sequence Number=SeqID_87925
MKLFGGLGEPKASLGELEAILETKDVESYEAQTRTKDIEVFEMKMKALSSLKV

SEQ ID NO: 179611 - protein, 30 aa, Glycine max
  Coding DNA Sequence Number=SeqID_87926
MDISEPYTGAIRGTMHEPQVNLGADKKFSP

SEQ ID NO: 179612 - protein, 342 aa, Glycine max
  Coding DNA Sequence Number=SeqID_87927
  Gene Ontology: Mol. function=oxidoreductase activity, acting on the CH-OH group of donors, NAD or NADP as acceptor; Cellular component =cytoplasm; Biological process=electron transport
  Homolog annotation: Hit_ID=A8GBM3; Match level="QueryCoverage=98%, HitCoverage=100%, E-value=1e-116, Identity=62%"; Hit description =Alcohol dehydrogenase GroES domain protein
  Pfam annotation: Domain name=ADH_N; Domain location=27-134; Score =175.5; E_value=1.4e-49; Accession=PF08240.3; Description=Alcohol dehydrogenase GroES-like domai
  Pfam annotation: Domain name=ADH_zinc_N; Domain location=162-301; Score=110.8; E_value=4e-30; Accession=PF00107.17; Description=Zinc -binding dehydrogenase
  Pfam annotation: Domain name=Pyr_redox; Domain location=165-239; Score=-8.4; E_value=0.028; Accession=PF00070.18; Description =Pyridine nucleotide-disulphide oxidor
  Pfam module annotation: Pfam domain module=ADH_N::ADH_zinc_N::Pyr _redox; Domain location=27-134::162-301::165-239
MTNMKTLVVAEPRSMVWQQRSVPTPAAHEVLIKPIAAGICGTDIHAWAGNQPFFSYPRVLGHELCGEVVALGAAAQGFQPGQRVALIPYVACQRCDACLSGKTNCCEQISVIGVHQDGGFCEFLSVPDTNLLAVDDVAPEAAALIEPFAISAHAVRRAALVADEQVLVVGAGPIGLGVAAIAAAAGAQVVVADTSAQRRAHVAQQLQLATIDPLAADFTAALRAEFGGRLAAKVIDATGSPAAMNSAVQLIRHGGTIVFVGLHKGDLVIPDTEFHKKETTLLGSRNATREDFHKVRALMAIGQLRADMMLNRHYDFSTLAETFEPGVINNPELIKGVIHFSR

SEQ ID NO: 179613 - protein, 239 aa, Glycine max
  Coding DNA Sequence Number=SeqID_87928
  Homolog annotation: Hit_ID=Q84VI1; Match level="QueryCoverage=97%, HitCoverage=36%, E-value=1e-100, Identity=79%"; Hit description =Envelope-like protein
MATSPKETAASGSPSVPSSPHQEQPEFNIQPIQIIPGQASVPEKLVPRRPQGVKIAENPSPATSPRETPLLPEADEDVPTSSNPNVSVPDVKKDVPTSSAPNAEALPSPGEEGSTEEDDQAAEETPAPRAPEPAPGDLIDLEEVESDEEPIANRLAPGIAERLQSRKGKTPIKRSGRIKTMAQKKSTPITPATSRRSKVAIPSKKRKEISSSDSDKDVELDVSTSKKARLQGKSAWKCP

SEQ ID NO: 179614 - protein, 58 aa, Glycine max
  Coding DNA Sequence Number=SeqID_87929
MKRLQRAGLRSSRGVGLGHNIKCRSLGGECGIWVEVTLSMLSRFFTGAPYRLGLLTHN

SEQ ID NO: 179615 - protein, 37 aa, Glycine max
  Coding DNA Sequence Number=SeqID_87930
MESKNAKNDDPRAANSGCSPRRAQLAQASSACPGELT

SEQ ID NO: 179616 - protein, 166 aa, Glycine max
  Coding DNA Sequence Number=SeqID_87931
  Gene Ontology: Mol. function=transcription factor activity; Cellular component=intracellular; Biological process=regulation of transcription, DNA-dependent
  Homolog annotation: Hit_ID=Q7CS36; Match level="QueryCoverage=100%, HitCoverage=70%, E-value=8e-81, Identity=92%"; Hit description =Transcriptional regulator, GntR family
  Pfam annotation: Domain name=FCD; Domain location=89-166; Score= -35.1; E_value=0.1; Accession=PF07729.3; Description=FCD domain
  Pfam annotation: Domain name=GntR; Domain location=17-79; Score=76.9; E_value=6.6e-20; Accession=PF00392.12; Description=Bacterial regulatory proteins, gntR fam
  Pfam module annotation: Pfam domain module=FCD::GntR; Domain location= 89-166::17-79
MSLAHITVSPDSSHEDRAQAIRDTLRDAIVDRRLAPGTKLSESEVGTLFDVSRTVVRAALQMLAYEGLVKAERNRGAFVSNPTPDEARQVFASRRLIEPGVVDAAIEKITPVAVKKLREHLLEESRHQQERGPSARRAEIKASGDFHLMLASIAGNAILEKFMDDL

SEQ ID NO: 179617 - protein, 78 aa, Glycine max
  Coding DNA Sequence Number=SeqID_87932
MSRERTSLEECFLEASTLKSNQVGTCDGCDFCVALFLCVFFPCLTSSCVQGVMAGRNDRAIVDALQALAQAIRNPNRG

SEQ ID NO: 179618 - protein, 68 aa, Glycine max
  Coding DNA Sequence Number=SeqID_87933
MKLAKYKLKAQVEKDEGPSGEGQSPQVEKDEPISDLSSLYQTIRSYSGSHHLVSELRLLIQCLSDFVS

SEQ ID NO: 179619 - protein, 77 aa, Glycine max
  Coding DNA Sequence Number=SeqID_87934
MVEEEAGETQVRQEVAATPERSREHVADPSTPILKIPEDPTTPILTLNTSPPATHVLHLTDEEDVQTQDTQDQSQEF

SEQ ID NO: 179620 - protein, 151 aa, Glycine max
  Coding DNA Sequence Number=SeqID_87935
MGDVEEVQEQMKADMSALKDQMASMMEAMLDMKRLIESNAATAAATSTVVEADPILPSTANLAHQLAPNMVGQGRDTLGNTNSSCLGYNRSAYPYGLPPKEETHWDPCLMHPGASHDMETCSAVEQLLQRMIDQGRLEIGDEDEKEQHVCM

SEQ ID NO: 179621 - protein, 83 aa, Glycine max
  Coding DNA Sequence Number=SeqID_87936
MSEVEEVQKQMKADMEAFKEKMAPMMEAMMSIKEILEANAVVVAATSVVAKVNLMPSSDLNQMNHPTSDMVGKDLGSTDNPMM

SEQ ID NO: 179622 - protein, 144 aa, Glycine max
  Coding DNA Sequence Number=SeqID_87937
MWHTLSMKISITPLRYSLRTNNLIRHISLKTWGRHGQAVGGIPFENTLEGPQFRPQSQPLAFCGGKSPSCYGRKGKGGSSNRKGSWPLKEVKIMPLLRLEELFLIPKHGHSQVQGAGLWQVQGDYSLQEPSKDVLSEDGGIRKR

SEQ ID NO: 179623 - protein, 159 aa, Glycine max
  Coding DNA Sequence Number=SeqID_87938
ETKFGHSVPLYHPEAAGPMIRGDTLWLSAPFCHPEAAGPMTSRDQVWSFCTLVSSRGGGPDDTRRYLTVIRTLLSSRGGGPDDTRDQYPSGGGNDKSETKFGHPDSRQPRGAKLVSSAPFFVRGPLLDDMGPFVGPCGGPDDYAEIPYGYSAPFLSSRG

SEQ ID NO: 179624 - protein, 207 aa, Glycine max
  Coding DNA Sequence Number=SeqID_87939
MERKDEELRGSNNGVIGGYHKWLKVRTQGIVWLPMLKISSGEEAEVLEESEEVQALKVGHERMRVIKKKLKTVVTRVRKECDELKDGSMGKQQQAQASKGRKGLAEEELSLATSHGQRLKDEHAKIVMQSYPARALDRRLQVDWARDAKEGPRLLDEDMTKSKGKDPLEGLGGPMTRARARKAKEALQQVLSILFEYKTKFQGEKSK

SEQ ID NO: 179625 - protein, 122 aa, Glycine max
  Coding DNA Sequence Number=SeqID_87940
MATARWALKHPVYGIVILRLGIYTARPNVSKLCSFISSMNSSILISDDVPKWKTPHDSGISKNTIDNNEVNTNVTVQTTFMWLRMPPGSWVTVTKSGVVDKSRAFAPTYPQFVMRNSDLRSS

SEQ ID NO: 179626 - protein, 198 aa, Glycine max
  Coding DNA Sequence Number=SeqID_87941
  Gene Ontology: Mol. function=oxidoreductase activity; Cellular component=cytoplasm; Biological process=antibiotic biosynthetic process
  Homolog annotation: Hit_ID=A6T7K8; Match level="QueryCoverage=65%, HitCoverage=100%, E-value=2e-47, Identity=72%"; Hit description =Putative uncharacterized protein
  Pfam annotation: Domain name=ABM; Domain location=10-69; Score=36.0; E_value=1.3e-07; Accession=PF03992.7; Description=Antibiotic biosynthesis monooxygenase
  Pfam annotation: Domain name=ACT; Domain location=138-198; Score =18.8; E_value=0.021; Accession=PF01842.16; Description=ACT domain
  Pfam module annotation: Pfam domain module=ABM::ACT; Domain location =10-69::138-198
MIAVLFEAEALPAAQERYLQLASELKPLLSDTPGFISIERFQSLTTPGKILSLSWWEDEDSVAGEPIRMHDIHVILKNSPGSLGFLGSVLGKNGVGLEGGGVFTTPEGGHAHFLVEDGYKARTVLTEAGFDVCNVCRPLVRKLAQERPGELGEIADTLARNGINILVQYSDHHNRLILITDDDVRAAEVTRKWAVASE

SEQ ID NO: 179627 - protein, 152 aa, Glycine max
  Coding DNA Sequence Number=SeqID_87942
  Pfam annotation: Domain name=G-patch; Domain location=2-41; Score =22.6; E_value=0.00035; Accession=PF01585.14; Description=G-patch domain
MARVMLGNGYEPGMGLGKDNGDITSLINAKGNRGKYGLGYKPTQADIKRSIAGRKGGGQSLRLRQESEGSPPCHISRSFISAGLGDEGQVVAIYKDDVPSTLDLVRPCPPDFQLGNWRVEERPGIYATSIIFDDESPEGTNTWDPSINFEQE

SEQ ID NO: 179628 - protein, 85 aa, Glycine max
  Coding DNA Sequence Number=SeqID_87943
  Gene Ontology: Mol. function=ATPase activity, coupled to transmembrane movement of substances; Cellular component=integral to membrane; Biological process=transport
  Homolog annotation: Hit_ID=Q94IH6; Match level="QueryCoverage=70%, HitCoverage=4%, E-value=1e-19, Identity=76%"; Hit description=CjMDR1
MYKKTHEVACWVSTEERQAARIRGLYLRAILWQDISFFDKETNTGEVVARMSGDTLLIQEALGEKVLMKSYNYQIITISSTTKLK

SEQ ID NO: 179629 - protein, 185 aa, Glycine max
  Coding DNA Sequence Number=SeqID_87944
  Homolog annotation: Hit_ID=Q84VH5; Match level="QueryCoverage=98%, HitCoverage=34%, E-value=2e-29, Identity=82%"; Hit description =Envelope-like protein
  Subcellular localization annotation: CTP_CleavageSite=21; ConfidenceScore=5.18e-01
MATSPKETSSPGSPSVPSSPSSTKAPSNQEQPEFNIQPIQMIPGQAPIPEKLVPKRQQGVKISENPSLATSPREVDTEMDKKIRSIESTEEEDQATEETPAPRAPEPAPGDLIDLEEVESDEEPIANKLAPGIAERLQSRKGKTPITRSGRIKTMAQKKSTPITPTTSRWSKVAIPSRRGKKFLI

SEQ ID NO: 179630 - protein, 56 aa, Glycine max
  Coding DNA Sequence Number=SeqID_87945
MYMRGYLMVIRTFCDPETASSMTCGGALWFYFRHPETFKPDDAQDSSLLGRDNRAR

SEQ ID NO: 179631 - protein, 132 aa, Glycine max
  Coding DNA Sequence Number=SeqID_87946
MEHETFLATWLAEIDSSPNGLKTIVSLADDKREMSPHVMQDGGSSQYCIIIVILQRILLSEREVYAMMLVFPPEFSPLTTILFGNPSQDTVEPLMEALEEDYKDGNEINESRQFIEGVLDLEKRINRLDTLT

SEQ ID NO: 179632 - protein, 32 aa, Glycine max
  Coding DNA Sequence Number=SeqID_87947
GIREGHNAGWRSSGKENPQALDSLEGLGNEPG

SEQ ID NO: 179633 - protein, 250 aa, Glycine max
  Coding DNA Sequence Number=SeqID_87948
METCLEVEELLQRMIDQGRLEVGIEGKEEQHICMQSTEGSGVAKPKPLVIYFTKSAASQKPGHSLMAKPVPFPYQDSHAVPWRYTPPEKKEEEVTDVSSLSAKVTNITGLSGVTRSGRVFAPPDLPVQPADVKGKGKELVEEQDGFEAPGMDASEKDIPAKGPRITRRSDDESPEGTNTWDPSIDFEQEMNQTEDEGDEDVGVPLELERMSPRPKAEIRSGGALGHRVRRGRYLGKLPILHALCGSRRRS

SEQ ID NO: 179634 - protein, 46 aa, Glycine max
  Coding DNA Sequence Number=SeqID_87949
VDSRGSPSEMWQKEKESMDRPHRLHPVGTTRSPQGRLRHPGVADRP

SEQ ID NO: 179635 - protein, 163 aa, Glycine max
  Coding DNA Sequence Number=SeqID_87950
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=33%, E-value=5e-78, Identity=71%"; Hit description=DNA -directed RNA polymerase subunit beta'
  Pfam annotation: Domain name=RNA_pol_Rpb1_2; Domain location=52-130; Score=49.5; E_value=1.1e-11; Accession=PF00623.11; Description=RNA polymerase Rpb1, domain 2
MCQEKLVQEAVDTLLDNGIRGQPMRDGHNKVYKSFSDIIEGKEGRFRETLLGKRVDYSGRSVIVVGIAKSKIREKEPIVWEILQEVMQGHPVLLNRAPTLHRLDFDGDQMAVHVPLSLEAQAEARLLMFSHTNLLSPAIGDPISVPTQDMLIGLYILTSGNRR

SEQ ID NO: 179636 - protein, 191 aa, Glycine max
  Coding DNA Sequence Number=SeqID_87951
MQKRKVFALDAPALKKAKKAQPIDEPQELSKSHLSGTSLKAKKGPLERSGTSKDTVLEEGALMDAHHHTPLIHTLDTHDARTFRIWIVWVDSQKVSTFGYNRSDNIVHHDIIEVDEDVVVAETKNVASIQIEAFSKVMDDAIVPRVVINLTNTGVMDEIGEVSNATMVDEVEPHIQNLASKQSTTSNKATS

SEQ ID NO: 179637 - protein, 36 aa, Glycine max
  Coding DNA Sequence Number=SeqID_87952
MVPNGVANCCNLPFGGRATRDSRGCFPLLLRIPQLR

SEQ ID NO: 179638 - protein, 140 aa, Glycine max
  Coding DNA Sequence Number=SeqID_87953
  Subcellular localization annotation: CTP_CleavageSite=28; ConfidenceScore=5.26e-01
MATQLNQAQSQNSDKLPSQTVQNPKYVSAITLRSGKQIEVPPLVAAPTPEPVKLHSTPEKEDELAAQKRKLPDHEGANKNFHAGGPSSSSPDLQQPPIPLPFPNKKMEEVKKEILETFRKVEVNIPLLDAIKQIQDMPSF

SEQ ID NO: 179639 - protein, 156 aa, Glycine max
  Coding DNA Sequence Number=SeqID_87954
MRDLATLEKSMIDAASGGALGDMTPIEARNLIEKMAFNSQQFSARNEANVLRGVHEVAMDSSSSAENKKLEGKLDALVNLVTQLAMNQKSASAPVARVCGLCSSEDHHTEYAISAREKSLSLLSRMLLVQEGHMFLLQCSSNNKDNMQLRPLLNLP

SEQ ID NO: 179640 - protein, 135 aa, Glycine max
  Coding DNA Sequence Number=SeqID_87955
MAAELIHDCVVMECLEGVWETLEGNERCRIYGTIRLTATSLVHPEQPARTLQQPVGWILPTPTPYRLVEPVQVIEVSSSEEDLEEDLEGLPPEPAVDAPDLPEDDEDPLHDVDSPEDFMSASEADSIEESGPGGT

SEQ ID NO: 179641 - protein, 198 aa, Glycine max
  Coding DNA Sequence Number=SeqID_87956
MNSRFKRRNQEATSQDFTREVLKRIFQKPNIAQFCFTKEFFSNFSKLPEYLLSGNRLPISCNRLPVLKFDFKKLLTEFATFQMVMGTSFVVQVEGTSTWVVVTENKRGYISCGLVQVEGKSTWLFKENKGGYIPCESLLVKNFTRLKEISRNGGCLCRQRIKLKVLMMPKDYMNHMLLKDLLKTKQLEIFKMDNQDSL

SEQ ID NO: 179642 - protein, 80 aa, Glycine max
  Coding DNA Sequence Number=SeqID_87957
MKLTSSISMEEGVGLQCQRAEVNVKERSKQKAPLELVGLGSSSSMDSFASWKMNGSGMEKEEREEMPLHGEEESRRSSPP

SEQ ID NO: 179643 - protein, 145 aa, Glycine max
  Coding DNA Sequence Number=SeqID_87958
MSLSGSVYFVKMASRKRKSIGARPTAQYDTRRFHSLDAWNRYTNNILGMSILPERKVEIYYTEFDDFKTKLERCNLHKRLTNLADRTIDVALVKEFYANLYSFEDPSPKQAKVRGHLVKIDTTSLNTFLETPVVLEKGETLPSYS

SEQ ID NO: 179644 - protein, 225 aa, Glycine max
  Coding DNA Sequence Number=SeqID_87959
MKNGEERTKTFTDLLTETSRKRYGSTSAWIFFTETIFLSKFERERRNPLFLEERQQCEYTSRKGQTTGFDEEAIGQLLCFPGHDFARSMVGKRLQIMCTNMTTLTQILMTFLLNNVLPSDHNSDLTLPKCQLVYSIMEHIIVCVAQLISDVIHQFVIGKPHTHPVHPDKSNKALDFPALITGLCQFYGVLVTPTKLIRSSINRSFIDKYCMPRLVQQPEKISHLS

SEQ ID NO: 179645 - protein, 262 aa, Glycine max
  Coding DNA Sequence Number=SeqID_87960
MANRGGEGNRPPRRTLGDYAYQQGPKHYNSIVIPPFSNKVVGLKPTMLSLIGSHPFAGMDHEDPYTRLSTFMELCNTMELLTKMLKLSTLVLSHSPWKKSLQGSFLHLDSSMQNLPLLLSPKGLMNLSMKHRRDSKRYCGAGGTMTPKSPEEAIVIIDSIAANVTSVVVTITIDTVQHLVIVNKKMRPIICRIKLDLNKTSKETTKATEVAQVNPKEQSKVITTRRRTIFGLKDDGECSDKKKNEGVEDDEMEGVEKEKGEK

SEQ ID NO: 179646 - protein, 114 aa, Glycine max
  Coding DNA Sequence Number=SeqID_87961
MGIAPTETPSGPEEVQQGPGGSRPQDTQWTRRSPTGSWSCQALITGLYQFYGVLVAPSKVIRPPTNRAFIKKYCVPTPQAGAGRNTTAAWGWPAAGNRRTAITLEFTSAHPQKG

SEQ ID NO: 179647 - protein, 40 aa, Glycine max
  Coding DNA Sequence Number=SeqID_87962
MTKARQKGVRKENRGGACHPARPGEPGCFIQKQPPSGGRI

SEQ ID NO: 179648 - protein, 98 aa, Glycine max
  Coding DNA Sequence Number=SeqID_87963
MDGLVDLAAINAFLAYHHGKESPVVAVLADAYDTFDRRCEKSSMRIVCCTPALYVWLVSNIFLHESRPDCPLQGHRMCAEKGKANWEQLLAGMEGGVR

SEQ ID NO: 179649 - protein, 373 aa, Glycine max
  Coding DNA Sequence Number=SeqID_87964
  Homolog annotation: Hit_ID=Q2PEW8; Match level="QueryCoverage=92%, HitCoverage=83%, E-value=1e-102, Identity=48%"; Hit description =Putative uncharacterized protein
  Pfam annotation: Domain name=SURNod19; Domain location=26-373; Score =394.3; E_value=1.9e-115; Accession=PF07712.3; Description=Stress up -regulated Nod 19
MEFISNAMILSFSILLLLPSASYSLYQKPKNHIKTAIFVTGSFEMGPGSIATKTFENIKFPKGHVGIKSFYAELVDQEGNSIPSYETYLHHWFAIKYHQNITMSPNPKLRRPEDAFFQRNEGTCNGDILPHYWGFGVESRGTTSKIPDPFAIEQGNPTKIKNGYEEKWLLNIMVIDTRGAQDKKACTQCRCDNMNLPKDFYNVTRDIHNQRLTTNYKGGLFCCQDNLQCKQIEGFQGSRRMVSLRYKISWVDWNIYQIPVKVYILDSTDKVRSNGSKILHDCLAEYTIPAGGGGDSPHVQKANIPMENGGYLIYGTAHMHSGVVNATLYGQDGRTLCTSTPKYGTGKKAGNEKGYLIGMSVCYPQPGSIKIHD

SEQ ID NO: 179650 - protein, 214 aa, Glycine max
  Coding DNA Sequence Number=SeqID_87965
MEGRKRRSPFLMWKIPKHSADQELRGIRNGIIGGYHEWLKVRIRGLDWLAKLKVVSEENFEAPEEDEEVQALKSELGKAKLAKEKFKLAATHVRKECAGLREKNAITARALEQETKRARKEEYGRNKFRGALWGSNNELKLRREERDQSRAHSMVLKEELIACSRSKRSLSQRLCETETNMLAIIAKYQEELGLATAHEHRIADEYAQVYAKKS

SEQ ID NO: 179651 - protein, 219 aa, Glycine max
  Coding DNA Sequence Number=SeqID_87966
  Homolog annotation: Hit_ID=UPI00006A2D9E; Match level="QueryCoverage =53%, HitCoverage=84%, E-value=3e-08, Identity=17%"; Hit description =UPI00006A2D9E related cluster
MTGPLNESISCFLKRVDPWVLVPSPFEDYTSSPSEGCTPSPSEGCTPSPSEDNTSSPSEDYTSSPLEENTSSLSKDYTSSPLEDYTSSPSEDYTSSPSEGYTPSPSEGYASSPSEGYMHALRGLRVLTFRGLHALAFRGLHALTFRGLHALTFRGLHVLTIRGLHVLAFRGLHALTFRGLHVLTFRGLHVLAFKGMHTLSFNGLHAVAFRGLDALAFKG

SEQ ID NO: 179652 - protein, 50 aa, Glycine max
  Coding DNA Sequence Number=SeqID_87967
MHALLGSFNSGNWSDSKVLDSAGLSCCAFMRNRGASWLSLVLQEESADDA

SEQ ID NO: 179653 - protein, 77 aa, Glycine max
  Coding DNA Sequence Number=SeqID_87968
MTNANCPQESLHSVSNGNLRLWKSIHYCFKSEGPSKIDNICARAKGQEDEDNLWTLCFGKRHISFESSSHSHKVCLC

SEQ ID NO: 179654 - protein, 79 aa, Glycine max
  Coding DNA Sequence Number=SeqID_87969
MQAKGNQKWLEGARTASLQTANAKDTGLLYSDVLCLFSAGKGQRPVGRDPSPTCIRPYVPISRKQKYAANRDRSSSYLG

SEQ ID NO: 179655 - protein, 18 aa, Glycine max
  Coding DNA Sequence Number=SeqID_87970
MSLHVDGFSQVSVEKWMD

SEQ ID NO: 179656 - protein, 172 aa, Glycine max
  Coding DNA Sequence Number=SeqID_87971
  Gene Ontology: Mol. function=transporter activity; Cellular component= membrane; Biological process=oligopeptide transport
  Homolog annotation: Hit_ID=Q7XAC2; Match level="QueryCoverage=26%, HitCoverage=14%, E-value=3e-11, Identity=69%"; Hit description =Peptide transporter 2
MVLVLITTCIPGIIIAQPTTLFNRQGTTLDRRMGPHFEIPPACLIALRQTIEQWIFIINIQQIRTKDSFPGSLQAKHNGPPKSSPTLSGTQFYPSFLRLAKVSKCSNEERLMFKPKDVRQKISARHELHKHELDNVVAVTKVQPSLQQTRTQAEGETTRTPWEYHFRDSFLS

SEQ ID NO: 179657 - protein, 86 aa, Glycine max
  Coding DNA Sequence Number=SeqID_87972
MQGQTAHKGESAKKEHTDQQLHQIQPIWWESMSWMNIKGDFPFSPKQHFMQHISIQIEGLRAVGPCGLNNLTRDRLRIQKKQQQSI

SEQ ID NO: 179658 - protein, 74 aa, Glycine max
  Coding DNA Sequence Number=SeqID_87973
MSRQRDFPSHFEYSEKVIEFEIIELKTDDDVLKVLVHSNYWKQFGLIEILTVFSKLVIKMEDDMSQSQHNSMQN

SEQ ID NO: 179659 - protein, 53 aa, Glycine max
  Coding DNA Sequence Number=SeqID_87974
MGEKEEKKKKKKGVNLSKWGANSSFQIFESRLYQNILETWLLKEEVTQLAWAS

SEQ ID NO: 179660 - protein, 134 aa, Glycine max
  Coding DNA Sequence Number=SeqID_87975
MCLMQASLEEQTRQGTFVPHGREGILNTAIGPPDHGGHVRAVGSGVTISQYFGRVARGSSCSSGSISHVQWAEIIGGLQEQWKNEIQRGSLIPTHIQPDIHVLGARVSTKGSNAESVVNPCLPNDVAPVEPPMG

SEQ ID NO: 179661 - protein, 137 aa, Glycine max
  Coding DNA Sequence Number=SeqID_87976
TLVRIATPLRLEFIPQVKELLDEGLVRKSLNPCALLVPKIGIIRHQIPKIGGMMNALGGATLICKITRAPNIFMICVHRDSLGRNNQHENTEKGVPMNPKRIKVIPEWPSPPSVLRKKPRVSRTSGFEVKSFSRGRE

SEQ ID NO: 179662 - protein, 171 aa, Glycine max
  Coding DNA Sequence Number=SeqID_87977
  Gene Ontology: Mol. function=endonuclease activity
  Homolog annotation: Hit_ID=Q2HUP4; Match level="QueryCoverage=59%, HitCoverage=34%, E-value=5e-30, Identity=63%"; Hit description =Endonuclease/exonuclease/phosphatase
MEEYTIHIPPPIIFMINNLARELLRAFKTGLKPKRYVKPRRFGPIWELGLFFIFKLWYTGKIRSRNGVGIIVDKEWKKDVVDVRRVGDRIIVLKLVVGQDTFNVISGYAPQVGLAEHFKVKFWEDLEGVLQDIPQGEKVFLGGDLNGHVGSVTRGFEGVHGGFGLGEMNGE

SEQ ID NO: 179663 - protein, 532 aa, Glycine max
  Coding DNA Sequence Number=SeqID_87978
  Gene Ontology: Mol. function=transporter activity; Cellular component= membrane; Biological process=oligopeptide transport
  Homolog annotation: Hit_ID=Q2HSV0; Match level="QueryCoverage=96%, HitCoverage=99%, E-value=0.0, Identity=62%"; Hit description=TGF -beta receptor, type I/II extracellular region
  Pfam annotation: Domain name=MFS_1; Domain location=16-480; Score =15.4; E_value=0.0058; Accession=PF07690.7; Description=Major Facilitator Superfamily
  Pfam annotation: Domain name=PTR2; Domain location=77-472; Score =203.4; E_value=5.3e-58; Accession=PF00854.12; Description=POT family
  Pfam module annotation: Pfam domain module=MFS_1::PTR2; Domain location=16-480::77-472
MEDTLTCCGEAQNKRGGSTAGISVASAGIIGNLIVYLIREFNIKSIDAAQVANVANGSSSLFPIVAAIMADSFFGSFPVALVSSCVSFLGTVIIVLTTIIKSLKPDPCNNTGPNLCNPPSKFQHAVLYGGITLCAIGFGGARFTTASLGANQFNEAKHQDVFFNWFFLTWYITSIASFTGIFYVQDNVSWAWGFGICSAGNFIGLVIFLLGYRFYRPDNPKGSAFLDLARVLVASIRKWKSQLSSANKHYYSDHDGILTVQLPAATPGKRLRFFNRAALITDGDLQSDGSIEKPWRLCTVQQVEDFKAIIGILPLWSTSIFLSTPIGIQGSMTVLQALAMDRQIGPHFKFPAGSITVIPLISTSIFLTFLDRVVWPAWQKLNGNSPTTLQRIGVGHVFNVLGIAVSALVESKRLKMVHSDPSVAMSILWLFPQLVLVGIGESFHFPAQVAFYYQQLPQSLRSTSTAMISMILGISYYLSTALIDQVRRSTNWLPADINQGRLDNFYWMFVLVGGINFVYYLVCSTLYKHTKV

SEQ ID NO: 179664 - protein, 1026 aa, Glycine max
  Coding DNA Sequence Number=SeqID_87979
  Gene Ontology: Mol. function=nucleic acid binding; Cellular component= cytoplasm; Biological process=regulation of transcription, DNA -dependent
  Homolog annotation: Hit_ID=A7NZC1; Match level="QueryCoverage=90%, HitCoverage=91%, E-value=0.0, Identity=50%"; Hit description =Chromosome chr6 scaffold_3, whole genome shotgun sequence
  Pfam annotation: Domain name=RRM_1; Domain location=70-156; Score =19.0; E_value=0.0026; Accession=PF00076.13; Description=RNA recognition motif. (a.k.a. RRM, RB
MAEKDDTEGRCPACRSPYDKEKIVGMAANCERLVAEVHMEKKVKNQKAKSKSSEARKQLSSVRVIQRNLVYIVGLPLNLADEDFLQQREYFGQYGKVLKVSMSRTTAGVVQQIISSSSGSPHSGIAEYITYSKEEEAIRCIQNVHGFVLEGRPLRYLSGFTEAIQGLVLEPLNIVMHGSETCNPDCLYLHEIGSQEDSFTKDEIISAYTSHVQQITGAANNIQRQAGNVLPPPLDDCMDNSSGKPIVKNSSSTSVSIVRSSPPNGTSGRPIALSAVAWGTRATNCQPAADGLLCPNGLSRPKPDTISSSLPFSSAVACTIQASLNSDVTKRPLLSDGSRSMTPQIKNELLKPVEQNRSMDILDSAGERTLVSDVSLSAVKLNNQLSSLPLAGDSGRGSFTATNTTSSIDITRQPLSFGPEEAVISTCEEIENLSCEFSSVYIDRNAQNKHYSLSIPSSSPDNVLVKSMQSQELQYNTDKLKDLMIKNADSKAAALYNEVCNLKEQCDLSLDSQSQVVSANTEVEDDVTTFDNQRLKDPEVIGSYLPESASFLHVSNHSSPLLLQRGDPCNVVNAGFLDANDKVEDNSLLHAHNICNGYSDEISTSSYWFRHDASNEHHIGRLVSDAVNIGSDAVMDKGESSIISNILSMEFDAWDDSLASHESLTKLLGDNTDSQNGPLKKSSSRKVQSNNQSRFSFAWQEESKFQANVPPSSGATQPFPKNGSLIQDFVERDFSLNKLGFANGFPSNNLKESGNLGSGHFIASNNKLSAVSRAQISAPPGFSVPNRAPPPGFSSVERMGQAFDSLSGNSLLDPSFLLRNSYQTPSNGNIGGPGDVEFMDPAILAVSKGPEQFNYFENEARVQLLMQRSPSPQQDLRFSEIGNSFSQFGDSYGISSRLNQSQVSNLASFPQLSLQQSRNAVLSNGQLDGRNGNGLGHLGFEIVGYIGHGKAKSEINKQNFSALPKVMGMAHDITCLLGYERMKLSLIAAAGYCSQSPSLLLVVLDLQKQAALRFKKSIMDRKVFGR

SEQ ID NO: 179665 - protein, 164 aa, Glycine max
  Coding DNA Sequence Number=SeqID_87980
MRAHPEREAIMHLLCIPGQDFPRAAAKRRVRIICTNMTTLTWMTLLFSKILPSDHNANLPLSDVSVGIVPTRHQVDPERSPTGPWGFQLWLWASVVLQGARSPGKGSRLQDTQWTRRSPTGSGSCQALIMGLCQFYGVPVTSSKGIRPPTNRAFIKKYCIPRQA

SEQ ID NO: 179666 - protein, 103 aa, Glycine max
  Coding DNA Sequence Number=SeqID_87981
  Subcellular localization annotation: CTP_CleavageSite=90; ConfidenceScore=5.28e-01
MSPPPLEHHNRSRTQLKLSGRLPLQAPFSAGALVGACTLSATLARLARISEFWLSARLFAQQMDSSGALSGISPRSVNIHSSSFFQILPRAQPKECCAQRMAR

SEQ ID NO: 179667 - protein, 291 aa, Glycine max
  Coding DNA Sequence Number=SeqID_87982
  Gene Ontology: Mol. function=methionyl aminopeptidase activity; Cellular component=cytoplasm; Biological process=proteolysis
  Homolog annotation: Hit_ID=Q1GZC4; Match level="QueryCoverage=89%, HitCoverage=59%, E-value=1e-95, Identity=62%"; Hit description =Aminopeptidase P. Metallo peptidase. MEROPS family M24B
  Pfam annotation: Domain name=AMP_N; Domain location=1-117; Score =128.2; E_value=2.3e-35; Accession=PF05195.7; Description =Aminopeptidase P, N-terminal domain
  Pfam annotation: Domain name=Peptidase_M24; Domain location=161-290; Score=3.1; E_value=1.8e-09; Accession=PF00557.15; Description =metallopeptidase family M24
  Pfam module annotation: Pfam domain module=AMP_N::Peptidase_M24; Domain location=1-117::161-290
MQAGIAVIPTAPEVTRNRDSHYPYRFDSYFYYLTGFKEPEAVLVLIASAQPRSILFCRDKDIEREIWDGFRYGPEAAKSEFGFDEAYSITQLDEQLPKLMANQPELFFSLGADAGWDTKISGWLNAVKAQARTGVQAPGKLVDVRQALDAMRLLKSPDEIELMRRSANIAAAAHNRAMQAVIPGKWEYEIEAEFLHEFYRQGAQAPAYTSIVAGGANACTLHYNANNAELKAGDLLLIDAGCELDGYASDITRTFPVSGRFSGQPGSRAGNRQLSPVLHASHRALAGAGCA

SEQ ID NO: 179668 - protein, 236 aa, Glycine max
  Coding DNA Sequence Number=SeqID_87983
  Gene Ontology: Mol. function=hydrolase activity; Cellular component =periplasmic space; Biological process=defense response to bacterium
  Homolog annotation: Hit_ID=P00726; Match level="QueryCoverage=63%, HitCoverage=98%, E-value=2e-73, Identity=93%"; Hit description =Endopeptidase
  Pfam annotation: Domain name=Phage_lysis; Domain location=54-206; Score=359.5; E_value=5.7e-105; Accession=PF03245.4; Description =Bacteriophage lysis protein
MRKEKIPHQAPFAIQAAQLLGRAIGAGLFAITPAGERGMCCKAIKLGNARVFPVTTLSTLEDPLVICIIVCLSWAVNHYRDNAITYKAQRDKNARELKLANAAITDMQMRQRDVAALDAKYTKELADAKAENDALRDDVAAGRRRLHIKAVCQSVREATTASGVDNAASPRLADTAERDYFTLRERLITMQKQLEGTQKYINEQGYRARIRNHGHSCFLCEIVIRSQFHTTYEPEA

SEQ ID NO: 179669 - protein, 160 aa, Glycine max
  Coding DNA Sequence Number=SeqID_87984
HPLDPDKSNRALGFPALITGLCQSFGVPIAPSKRQAQGDAPQAADVPPPYQAGLAGSFDTEQYLRHLVRQQAANHRAHVQTHDCLYQLSLSLQSQSFTSFPCPTPDQFRAEVAWPGDWPEARAGEAPAEAPAKAPDEADEAREDEEMTDLLDFLGGSGAT

SEQ ID NO: 179670 - protein, 99 aa, Glycine max; identical to SEQ ID NO: 94036
  Coding DNA Sequence Number=SeqID_87985

SEQ ID NO: 179671 - protein, 138 aa, Glycine max
  Coding DNA Sequence Number=SeqID_87986
  Subcellular localization annotation: CTP_CleavageSite=64; ConfidenceScore=5.80e-01
MVKVGTSYVPINVSFSPKVGPGLPRAPVASVSISCPSCSATDGGGGVTAKSTRRTSALASVAVTAARRVPFAIQAAQLLGRAIGAGLFAITPAGERGMCCKAIKLGNARVFPEFDVEKDEGPEAEALPRLLIVAEGPN

SEQ ID NO: 179672 - protein, 130 aa, Glycine max
  Coding DNA Sequence Number=SeqID_87987
MRGPEVSFGANVIASNTTDDGVNVASSNPDEEVDIFEHIRQKDEATEKGKKCRKIKKREAKRVRITCLKQMGNMKEYPLVDLSLFTWVFGEVDTHTSIFLTTKFIIDLKERVKLTYDNNSDWVVVDHCLP

SEQ ID NO: 179673 - protein, 105 aa, Glycine max
  Coding DNA Sequence Number=SeqID_87988
  Homolog annotation: Hit_ID=A5BEV8; Match level="QueryCoverage=67%, HitCoverage=8%, E-value=3e-07, Identity=38%"; Hit description =Putative uncharacterized protein
MDEDQWMYDTIMSEEVDMDDQNEQECGVNEPQVDCSDPFNTSQLRGKPVVGGQSWMVKLMCGIHNHELAKSLVGHPYAGRLTKAEKTLIVDMTKSMVKPRNILLT

SEQ ID NO: 179674 - protein, 153 aa, Glycine max
  Coding DNA Sequence Number=SeqID_87989
LGGRQRYPSGYPYKHFFAIRQTQSPIYVVFYTIVILTREVRQRYPSGYPYKHFFAIRQTQSPGLANPLTRRDLHRLLHLCHPDPKSGGRRGYRMVIRTFRQPGANELADAQRLTSSFAPFVIQGQRVRWQAEIPYGHPHLSLTKANEFNGIRM

SEQ ID NO: 179675 - protein, 154 aa, Glycine max
  Coding DNA Sequence Number=SeqID_87990
  Homolog annotation: Hit_ID=A5ATL8; Match level="QueryCoverage=55%, HitCoverage=68%, E-value=2e-20, Identity=65%"; Hit description =Putative uncharacterized protein
AFKSRQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSREGELTPKTRPQFGL

SEQ ID NO: 179676 - protein, 109 aa, Glycine max
  Coding DNA Sequence Number=SeqID_87991
  Gene Ontology: Mol. function=endonuclease activity
  Homolog annotation: Hit_ID=Q2HUP4; Match level="QueryCoverage=99%, HitCoverage=56%, E-value=3e-20, Identity=41%"; Hit description =Endonuclease/exonuclease/phosphatase
MDQLRNNVNARSLPGSNALYGSSTVSKEQGPLHPRPDVVKSTLTGKSMEIVDVMVRRKINFMCLQETKWTGIIVDKEWKKDVVDVRRVGDRIIALKLVVGQDTFNVISG

SEQ ID NO: 179677 - protein, 109 aa, Glycine max
  Coding DNA Sequence Number=SeqID_87992
MHIDEFCILYHSDFANWVINAYTNYASFIIQEQQVGWFYWQGGSLAEWCFARTKLVSYLYFPFISNKRQVKRGNCHTLILSGDHPLLGCDPRLTTLRYLAPIVRQFVKF

SEQ ID NO: 179678 - protein, 306 aa, Glycine max
  Coding DNA Sequence Number=SeqID_87993
  Gene Ontology: Mol. function=transferase activity, transferring phosphorus-containing groups; Cellular component=integral to membrane; Biological process=two-component signal transduction system (phosphorelay)
  Homolog annotation: Hit_ID=A6TH11; Match level="QueryCoverage=100%, HitCoverage=40%, E-value=1e-143, Identity=85%"; Hit description =Sensor protein
  Pfam annotation: Domain name=HATPase_c; Domain location=106-223; Score=117.6; E_value=3.7e-32; Accession=PF02518.17; Description =Histidine kinase-, DNA gyrase B-, and HSP90-like ATPase
  Pfam annotation: Domain name=HisKA; Domain location=3-65; Score=43.2; E_value=9.3e-10; Accession=PF00512.16; Description=His Kinase A (phosphoacceptor) domain
  Pfam module annotation: Pfam domain module=HATPase_c::HisKA; Domain location=106-223::3-65
MKAVGQLTGGLAHDFNNLLAVIIGSLELVQPDERDAPRISRALKAAERGALLTQRLLAFSRKQALNPQAVALQPLLENVCELMRHSLPASLRLEIEAQSPAWPAWIDVGQLENAIINLVMNARDAMEGRSGVIALRTWNQRVTRSDGRRQDMVALEVIDHGCGMSQEIKAQVFEPFFTTKQTGSGSGLGLSMVYGFVRQSGGRVAIESAPGQGTTVRLQLPRATAAAEDERTPLVSEPMVSGERLALVLEDEADVRQTLCEQLHQLGWLTLEAQNGEQALQMLAASGDIALLISDLMLPGGLSGAE

SEQ ID NO: 179679 - protein, 663 aa, Glycine max
  Coding DNA Sequence Number=SeqID_87994
  Gene Ontology: Mol. function=4 iron, 4 sulfur cluster binding; Cellular component=formate dehydrogenase complex; Biological process= formate metabolic process
  Homolog annotation: Hit_ID=P07658; Match level="QueryCoverage=99%, HitCoverage=99%, E-value=0.0, Identity=86%"; Hit description=Formate dehydrogenase H
  Pfam annotation: Domain name=Molybdop_Fe4S4; Domain location=1-54; Score=81.8; E_value=2.3e-21; Accession=PF04879.7; Description =Molybdopterin oxidoreductase Fe4S4 domain
  Pfam annotation: Domain name=Molybdopterin; Domain location=61-454; Score=529.0; E_value=5.3e-156; Accession=PF00384.13; Description =Molybdopterin oxidoreductase
  Pfam annotation: Domain name=Molydop_binding; Domain location=523 -630; Score=121.4; E_value=2.7e-33; Accession=PF01568.12; Description= Molydopterin dinucleotide binding domain
  Pfam module annotation: Pfam domain module=Molybdop_Fe4S4::Molybdopter in::Molydop_binding; Domain location=1-54::61-454::523-630
MKKVVTVCPYCASGCKINLVVDNGKIVRAEAAQGKTNQGTLCLKGYYGWDFINDTQILTPRLKTPMIRRQRGGKLEAVSWDEALDYVATRLGAIKEKYGPDAIQTTGSSRGTGLHQSVGNGAMSNAITEIDNTDLVFIFGYNPADSHPIVANHVINAKRNGAKIIVCDPRKIETARIADMHIALKNGSNIALLNAIGHVIIAEDLYDKSFVASRSEGFEEYRKIVEGYTPESVEEITGVSAQEIRACARMYASAKSAAILWGMGVTQFYQGVETVRSLTSLAILTGNLGKPSVGVNPVRGQNNVQGACDMGALPDTYPGYQYVKFPENREKFARAWGVDSLPEHTGYRISELPHRAEHGEVRAAYIMGEDPLQTDAELSAVRKAFEQLELVIVQDIFMTKTAAAADVILPSTSWGEHEGVYTAADRGFQRFFKAVEPKWDLKTDWQIISEIATRMGYPMHYNNTQEIWDELRHLCPDSPARPMKKWGTSYLFKEKFDTPNGLAQFFTCDWVAPIDKLTDEYPMVLSTVREVGHYSCRSMTGNCAALAALADEPGYAQINTADAERLGIEDDALVWVNSRKGRIITRAQVSDRPNKGAVYMTYQWWIGACNELVTENLSPITKTPEYKYCAVRVEPIADQHAAEQYVIDEYNKLKARLRESAMG

SEQ ID NO: 179680 - protein, 74 aa, Glycine max
  Coding DNA Sequence Number=SeqID_87995
MTTSGHHKPPLLAAEPPHQEERCNQSRILLKDSMEKIPSIFHFVASLRLVWSEDLGSANLRHELYMYIYAKGIL

SEQ ID NO: 179681 - protein, 276 aa, Glycine max
  Coding DNA Sequence Number=SeqID_87996
  Homolog annotation: Hit_ID=Q84VH5; Match level="QueryCoverage=87%, HitCoverage=44%, E-value=2e-56, Identity=85%"; Hit description =Envelope-like protein
  Subcellular localization annotation: CTP_CleavageSite=21; ConfidenceScore=5.47e-01
MATSPKETSSPVSPSVPSSPSSSKTPSNQEQPALNIQSIQMIPGPGPVPEKLVPKRQQGVKISENPSFATSPREEDTEMDKKIRSFVNNILKNASVPDADKDVPTSSTPNAEVLPFIPVKRNQQRKRIKPQRRPLHQGHQNLLQKKSTPITPTTSRWSKVAIPSKKRKEISSSDSDDDVELDVPDIKRAKKSGKKVPGNVPDAPLDNISFHSIGNVERWKFVYQRRLALERELGRDALDCKEIMDLIKAAGLLKTVTKLGDCYECLVRGIHCQHSL

SEQ ID NO: 179682 - protein, 160 aa, Glycine max
  Coding DNA Sequence Number=SeqID_87997
MDDSSTIEETEVNPEFEEVLEVLNEMHEEAQRLAILNKKMKSDLKLHITKLASTQKAFNEMHEKAQRLVVLNKKLKSEQKLYVNKLASTQEELNKLKQENEKLVSKCKATTCDDTSNSFNMDDCKFLQAKFENFKKDHQVECIKLQTELSYLKDLFGKLK

SEQ ID NO: 179683 - protein, 163 aa, Glycine max
  Coding DNA Sequence Number=SeqID_87998
  Homolog annotation: Hit_ID=A0ST23; Match level="QueryCoverage=27%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPTKSHFTRLHSINPIRTDLRIKQLGTELEFVIMVIAVSFGKPVVPAALMNRPTRGERRFAYWALFRFLAH

SEQ ID NO: 179684 - protein, 310 aa, Glycine max
  Coding DNA Sequence Number=SeqID_87999
  Gene Ontology: Mol. function=motor activity; Cellular component=cell projection
  Homolog annotation: Hit_ID=UPI00016621D1; Match level="QueryCoverage =83%, HitCoverage=40%, E-value=7e-24, Identity=35%"; Hit description =UPI00016621D1 related cluster
GLHVLPFKGLHVLTFRGLHVLTFRGLHALAFIGLHALTFRGLHVLTFRGLHVLTFRGLHALAFRGLHVLAFRGLHILTLRGLHVLTIRGLHALAFRGLRAFTFRGLHVLAFRGLHVLAFKGLHVLAFRGLHALAFRGLHVLVIRRLHALAFRGLHVLAFRGLHILTFRGLHVLPFRGLHALPFRGLHILTFKGLHVLTFRGLHTLTFKGLHVLTFREQHVLSFRGLRALTFRGIHVLAFRELHVLAFRGLHALAFRGLHVMQSYPPRVLDRRLQEDWARATKEGSRVLMTLRVYFLSPWTKVGSSLLCKY

SEQ ID NO: 179685 - protein, 123 aa, Glycine max
  Coding DNA Sequence Number=SeqID_88000
  Homolog annotation: Hit_ID=A6FJQ2; Match level="QueryCoverage=30%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGWEKAGNEGTSLKKQVQALTLRNSTLEDRVTHLDSALKECVRQ

SEQ ID NO: 179686 - protein, 121 aa, Glycine max
  Coding DNA Sequence Number=SeqID_88001
MQKRFTQIVNHLASLRKIFPNEDLINKVLRCLSREWQPKEHEMEHQRLNQNEEIDKKKRSIALKASSSMQEENEEEESEDEEDFSLFVKKFQKFVKKRRIEKRQNFNNGRRSQEDSQILRC

SEQ ID NO: 179687 - protein, 204 aa, Glycine max
  Coding DNA Sequence Number=SeqID_88002
  Gene Ontology: Mol. function=metal ion binding; Cellular component =cytoskeleton; Biological process=regulation of the force of heart contraction
  Homolog annotation: Hit_ID=A7PD59; Match level="QueryCoverage=90%, HitCoverage=97%, E-value=4e-91, Identity=70%"; Hit description =Chromosome chr17 scaffold_12, whole genome shotgun sequence
  Pfam annotation: Domain name=LIM; Domain location=123-179; Score =70.5; E_value=5.5e-18; Accession=PF00412.13; Description=LIM domain
  Pfam annotation: Domain name=LIM; Domain location=24-80; Score=49.9; E_value=9.1e-12; Accession=PF00412.13; Description=LIM domain
  Pfam module annotation: Pfam domain module=LIM::LIM; Domain location =123-179::24-80
MCHYMPTECEIPAVNVMNGTTQKCKACEKTVYLVDQLTADNKIYHKSCFRCYHCKGTLKLSNYCSFEGVLYCKPHFDQLFKKTGSLDKSFEGIPRTARLERSADQVQTNTKVSNLFAGTQEKCVACKKTVYPIEKVAVDGTSYHKACFRCTHGGCVISPSNYVAHEHRLYCRHHHTQLFKQKGNFSQLDKQENDEGVTENRITE

SEQ ID NO: 179688 - protein, 118 aa, Glycine max
  Coding DNA Sequence Number=SeqID_88003
  Gene Ontology: Mol. function=nucleic acid binding
  Homolog annotation: Hit_ID=A5AV98; Match level="QueryCoverage=84%, HitCoverage=13%, E-value=4e-23, Identity=54%"; Hit description =Putative uncharacterized protein
MDTKLYDYWFMGTLKFIVISVLDLDLAILEEKPATIIDASSNEEKSHYKAWEKCNRLNLMFMKMTVVDSINTTLPKNDNAKEFMRLVGERSQTNNKSLVGTLMSTSTTMKFDGLRTMH

SEQ ID NO: 179689 - protein, 132 aa, Glycine max
  Coding DNA Sequence Number=SeqID_88004
MRLVKRLLFLLRLLRPQGPTEGTSFVVQVEGTSTWVVVTENKRGYISCGSVQVEGTSTWLFKENKGGYIPCESLLVKVFTRLKEISRTAGCLGTGSRHGLLPNQYKILVFVFFFPTLFNFRCALLIIAFTFG

SEQ ID NO: 179690 - protein, 261 aa, Glycine max
  Coding DNA Sequence Number=SeqID_88005
MEGLGSQHKMEDNGDSVTMVFMMIKLDGEAINRSFKLKRPRALDDYSLYLRYGGDDHNGPWGSEMTLSCDTSTRMGNSCSRLGNPNNHREHNQVMVRVTVHNTKHSWIIIPEQVFSAKQVFSAVAGELLSVYKEEFSNTSAGDLAPLDLEIEASCRRNNAERRRKILQDKTAQPSLEEAQSSESSSIFPEIRESEVGALEANIMADEQPHILLRTILAPPCYPYAHLATYIEICNTMKIVGVPEDAIRLSLFSFSLSGEAK

SEQ ID NO: 179691 - protein, 216 aa, Glycine max
  Coding DNA Sequence Number=SeqID_88006
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=50%, E-value=1e-23, Identity=100%"; Hit description=LacZ protein
MSSRRSRSRQTSSSRNITDDQINDLVSKLQQLLPEIRDRRSDKNYEVCRGLMRSDAAVSPDVFRQLQRCVVDLSVIFKNNAMGGRDLNPVLPPPSPPFILKLFLLHRNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 179692 - protein, 88 aa, Glycine max
  Coding DNA Sequence Number=SeqID_88007
  Gene Ontology: Mol. function=aspartic-type endopeptidase activity; Biological process=DNA integration
  Homolog annotation: Hit_ID=Q69FA4; Match level="QueryCoverage=61%, HitCoverage=4%, E-value=4e-16, Identity=77%"; Hit description=Gag -pol polyprotein
MAFPLYYKGTMMLIGSPIHIRQNPLCVHIWPGAVARRSTKQSIIARSTMESEFIALELASSEAKWLKNFLVYIPLGMKPTPSVPMQKP

SEQ ID NO: 179693 - protein, 336 aa, Glycine max
  Coding DNA Sequence Number=SeqID_88008
  Subcellular localization annotation: CTP_CleavageSite=21; ConfidenceScore=5.08e-01
MATLPASPPPPPSPPPPPSTVTSAPPGAERPVVHVDPETGKADSPYKKKLRTYLGIVAHDKVDVTYETSKEVPATQKDLIWEDIQPTRTMWTMLFVKSTTLARRNRPSFIRPAETPHGRMCGKRQRKKLEEAAQSGSTEGMIDPPSPIRRHVKWKMARTKKTGQMMSEAAKEIAEKIGLAVPPETEVGPSATRVSTKGICVDPSSIDPDMGDSDKCGLVYKGSTTVHSIPLLHNQVKVGVEEVKDVEALVPVPTDEAIVSPAKPPDRSDHEVDDPLYLMTFTIPQLFLKPLQVMWDATLFGVFNEDFPLYIKHEDLSKIAHSGQCLSISVIQLWIL

SEQ ID NO: 179694 - protein, 107 aa, Glycine max
  Coding DNA Sequence Number=SeqID_88009
MGQGPTNSTPPPFDQEKSMVGITQRFGAQCGKLNRRGKQLLHLQCNSHFMAIKAHNRQGEEPKHDYEEYYSTANHDVTNSQTPGPKGILPSALLNTHAPKTSVRNNK

SEQ ID NO: 179695 - protein, 204 aa, Glycine max
  Coding DNA Sequence Number=SeqID_88010
  Gene Ontology: Mol. function=protein serine/threonine kinase activity; Cellular component=plasma membrane; Biological process =protein amino acid phosphorylation
  Homolog annotation: Hit_ID=A7PST2; Match level="QueryCoverage=33%, HitCoverage=7%, E-value=6e-23, Identity=77%"; Hit description =Chromosome chr8 scaffold_29, whole genome shotgun sequence
MKHLEIAEDFTKGIEYLHMGCVHPVIHRDLKNNNILLDKQMRAKVSDFGLSKLAVDGASHVSRIVRGTCFVCGDNNGDGGGVSSNSDRDANGGCGGSSDIGNGDGCVSNADGVDDDGGHGISVDGDSRGGICGSSDDNDGDGDNDGGDGGDLVVVVVVVALVVVVIVVVIWWLGGGGDYGDSDGGGDSEDLGSSDDDSDSNSER

SEQ ID NO: 179696 - protein, 99 aa, Glycine max
  Coding DNA Sequence Number=SeqID_88011
MGALNIINHNMKIRLNIYSRTRFKQKNSRVDDPTQEYCADPVFDHQQTSANVSFLDNDENPRIEELHGVGTLGGGSGRMHVVQLDEDVDVETLEDIGES

SEQ ID NO: 179697 - protein, 121 aa, Glycine max
  Coding DNA Sequence Number=SeqID_88012
  Gene Ontology: Mol. function=protein serine/threonine kinase activity; Biological process=protein amino acid phosphorylation
  Homolog annotation: Hit_ID=Q8GRZ5; Match level="QueryCoverage=48%, HitCoverage=21%, E-value=5e-21, Identity=79%"; Hit description =Phosphoenolpyruvate carboxylase kinase
MEVGESTKEKVDDASPSQNETLVTEVNASQLSTDNADLYGPWMIPDNIVFDSANNLNLIDFDLVEWFRDGKSMSNVVGTPYYVTPEVLLGREYDEKVDVWSYGDLPNYVPRRQGSLQKNVL

SEQ ID NO: 179698 - protein, 102 aa, Glycine max
  Coding DNA Sequence Number=SeqID_88013
MKASNVWEKGSWNLAKLFTNITEVVVDAIHLVRPMMVEGMSNVWVWGNEISGTYTTKSAYKDVLTKMGAMMANPLVIVHEAPQLLKPKLHTDALGVLFPRGF

SEQ ID NO: 179699 - protein, 110 aa, Glycine max
  Coding DNA Sequence Number=SeqID_88014
MAGNGIFMKGSESGNCEKHHKDIVLVTEVTKVDGEVVDDDDENVYVVVPLSQNDREACGLTKMTCICGSRQKMTLSSKSLMELELRITKMILRAQRESTSKVEGKMRIEE

SEQ ID NO: 179700 - protein, 37 aa, Glycine max
  Coding DNA Sequence Number=SeqID_88015
MEETIISLGNRGVGGGDAKVGLYFLVGLVVIEGRLCA

SEQ ID NO: 179701 - protein, 54 aa, Glycine max
  Coding DNA Sequence Number=SeqID_88016
MIYEEGGFKQLRQRKSLLVLAPLAKQNAIEDGDFLQRGMVVAWKLNKVKLRVEI

SEQ ID NO: 179702 - protein, 49 aa, Glycine max
  Coding DNA Sequence Number=SeqID_88017
MAVSRRSRLMKERSTSAIGGRQGRATTILLSGGAFRESVDCSKKESTVK

SEQ ID NO: 179703 - protein, 253 aa, Glycine max
  Coding DNA Sequence Number=SeqID_88018
  Gene Ontology: Mol. function=ion transmembrane transporter activity; Cellular component=integral to membrane; Biological process=ion transport
  Homolog annotation: Hit_ID=A5BPE3; Match level="QueryCoverage=84%, HitCoverage=24%, E-value=1e-67, Identity=57%"; Hit description =Putative uncharacterized protein
  Subcellular localization annotation: CTP_CleavageSite=55; ConfidenceScore=5.33e-01
MADSTPLLSQPNPSSSSSPDTQEAPPSNQHHPSLGSTVELCIGEFNWSQFLQSILVSLAWIFDAQQTFISVFTDALPEWHCTERGANACKTATTVCSLPKGSWAWDVPTQASIVSEWGLECANSAITGLPASMFFLGCLIGGFVLASLADSSLGRKNMLFFSCLVMAITSLLVTLSPNVWIYSALKFLCGFARATIGTSALVLASELVGKRVLVPASHGLHKQEFFMEEPLSVDIHFNHVLLHTGEVVRYGVP

SEQ ID NO: 179704 - protein, 52 aa, Glycine max
  Coding DNA Sequence Number=SeqID_88019
MSCILNLMCFNFNFSEACALSESHALSETLSSLRELGESGGESEKHLHSARH

SEQ ID NO: 179705 - protein, 148 aa, Glycine max
  Coding DNA Sequence Number=SeqID_88020
MKDISPPQDHSQSATKHKTKVKIATQTHKPPRCEKHNMNQTHHPKQSLRRRHWNGVPLHRVTWLGANNGRDIYVVDADGRIVLLFGVGFKGVIRRGRGENLEYLVRWKDSGASEWVTRKFVALSTESERDNKNTKSLENNIKSFKMVL

SEQ ID NO: 179706 - protein, 96 aa, Glycine max
  Coding DNA Sequence Number=SeqID_88021
  Homolog annotation: Hit_ID=A5AUE6; Match level="QueryCoverage=51%, HitCoverage=2%, E-value=2e-08, Identity=59%"; Hit description =Putative uncharacterized protein
MTVADCIKTTLPKTDNAKEFMRLVGERSQIDDKSFAGTLMSTLTAMKFDETGLKNQGSHSVHYVSHQGSQGAEKKFIKKHDKCKGPLKINDDSLQI

SEQ ID NO: 179707 - protein, 514 aa, Glycine max
  Coding DNA Sequence Number=SeqID_88022
  Homolog annotation: Hit_ID=Q9LX59; Match level="QueryCoverage=60%, HitCoverage=72%, E-value=2e-09, Identity=23%"; Hit description =Putative uncharacterized protein F4M19_70
MPLRDRIASTQVHFKKKGSFEQERCISRRKVHLNKKAMSRKENLISELHPRKGTWKIAVCITDMWDVKKHNGRQAIDMVLIDQMLVKKGVKIGATLWQELFPEFQPKLTLGCSYLIQNIKVVDNQSEYKEVERLEIPANVHVITEIADIISGIAPRHTLVDFVGVVAEVIERKIVNPAYKVTVKLRDNSDAEILMTLWEDYALQLDDAIEKNHFVRESLVLMLTLAKIKDAKGEYNDLPPCSLCVPFYVGGLTEEGSGSQSQYTSNSQRGDRDKFLHNAQMTSLGDISRLREDYFCLTVATVDEILIDTPWSYDSCPNCTTTFDPLKIVGACRSCQNQVSHTVPRYKLVVKMEHNGEKANFHFWDATCIKMFGKTTEECRQELIAGGDEIKVFPECVDDLVGKTLALRFKYRVNMRQSSVMDVSQEEHHIQTLTFKIVLQDEQTIRKSPASCDETSSGDYHPKPSLSQSANYDPGNTAFITPAKKLSGQQATNEFDSKDTTAYELSTNKHIKAE

SEQ ID NO: 179708 - protein, 56 aa, Glycine max
  Coding DNA Sequence Number=SeqID_88023
GRPSGLNDAHDPTMLDICETPPFSTAMPNINDSHYVDDVHANRNDHDEGLWENIAT

SEQ ID NO: 179709 - protein, 956 aa, Glycine max
  Coding DNA Sequence Number=SeqID_88024
  Gene Ontology: Mol. function=pectinesterase activity; Cellular component=cell wall; Biological process=cell wall modification
  Homolog annotation: Hit_ID=A7QJA8; Match level="QueryCoverage=24%, HitCoverage=64%, E-value=5e-61, Identity=49%"; Hit description =Chromosome chr8 scaffold_106, whole genome shotgun sequence
  Pfam annotation: Domain name=Pectinesterase; Domain location=656-894; Score=16.9; E_value=6.1e-23; Accession=PF01095.10; Description =Pectinesterase
  Subcellular localization annotation: CTP_CleavageSite=46; ConfidenceScore=5.37e-01
MGTPPTSPPQSNIQSEAKSRNTRKSTRLRRLTVRSLDHPRPTVQVDAATGRGSGPHKEKFHNYLGVVAREKIPIVHNSWKDVPDKLKDCPHVLSRGGYDLLEKKLMDDKIKKRQHEAMLTESTVDMDEPPSPIKRHVKWVLARTKQFGQMTSEAAREISDKIASLEEQSSQGTFVPNGRQDILNTAIGRPDHGGRVRAAGSGVTITQYFGKAARGSGSSYRSFNQQQLDEIIVTIKEQNERRLETFKHVLKEQIILEISQRGSTVAAPIQPDIQLLGARVSTKGSNAEAVVNPSPPDHVGPVKPTMGLYVHRELCTKLVALGKTYDGGSTIHGVAYADDVVRVSVDLVINGEAEVPFLTSDIKYVSQSLDTFIAWPTSLVKLVSNERTSCTPNKNNDVPVEDPLRELIKSLVDIYEKPVEFVWDPARFGIPNGATSLFVTCADVNKIISGVQCLNITILQLWTIHMEDWTNTLGLGSIYGFLEPQSILNAKDKRQESENRVVWFCSLRRKPDVHIKSAINNAFKTLNSTSEGKSDQTTPRWLEIKSHVQSGGYECGYYVMQWMWNIIGGEVKTDWAMLAASIPVVDLSLLTSHDPQIHTKVLYQLGKACAEWGFFMGEGESGELTNHEIPEKLVEDVKKKSREFHDFSVEEKEFSDKVPFTPIRKKVVVQANKNYLIIQGQGYLNTTIEWNNTANSTGYTSYSYSFFIFASKFTAYNISFKNMAPPPPPRVVGAQAVALRDTLNDDSGRHYFKECFIQGSIDFILGNAKSLYEDCTIKCVAKEEKDEISGSITAQGRQSMNEESGFSFVNCRIVGSGSGSGREWLGRAWGAYATVFFSRTYMSDVVAPDGWNDLRDPFRDHLMSSAFIYYAAPLAVHSMKDATSCIMFLVASKLVAILLMINVGSNLVNDCTDVEILTYKDVPGDPTIKHDFNIGADVITDVEILTYKDVLGIPPM

SEQ ID NO: 179710 - protein, 105 aa, Glycine max
  Coding DNA Sequence Number=SeqID_88025
MVMGSVPVMTYKICTIVQTSDYLIKLLLIGDSSIGKSFLLLRFANRGDGRENRQAADCEYSHFTDTNQCLLPTTSFIMPRKHDHAWNGTLFPLFYCWSLNVWDGA

SEQ ID NO: 179711 - protein, 204 aa, Glycine max
  Coding DNA Sequence Number=SeqID_88026
MVVDLIDPPLAIGENFGTEAEGWKIPIPLKEYVESTFYQYQREAITADLSSKAFVLIQVGLYFWLCFCCKICLMFYILAFSFSLTNSLSGGPRDWEDSDHTWDSKYHFACYSYKNAFKSSMSKNFVPHCPEALRYAKFFVVYAFFSFILSSAIRCRLYMSGCLEFHLLKSGYKWQKEHIDFKYILLFLAVASIDNVLGSDKQRS

SEQ ID NO: 179712 - protein, 184 aa, Glycine max
  Coding DNA Sequence Number=SeqID_88027
MKALKEIFDISGSGRGGVEGSYQEHLELKKGSGKTGKDYSTTCFCSTVVDEEANITKMPPCKKLLRARTIDVECASNGENVSDAGGEILELLDDVVEGGPTGKDEQNGDGDGGAGALVSRNVTILSPSSRRFFSVALVSESCSSVAGPLQRSSPSKLEDERPESVSSLCPALYDGNEESRYKKK

SEQ ID NO: 179713 - protein, 243 aa, Glycine max
  Coding DNA Sequence Number=SeqID_88028
  Gene Ontology: Mol. function=hydrolase activity, hydrolyzing O -glycosyl compounds; Cellular component=membrane; Biological process =carbohydrate metabolic process
  Homolog annotation: Hit_ID=A7Q2G5; Match level="QueryCoverage=55%, HitCoverage=38%, E-value=1e-25, Identity=47%"; Hit description =Chromosome chr1 scaffold_46, whole genome shotgun sequence
  Pfam annotation: Domain name=CBM_4_9; Domain location=39-174; Score= -12.5; E_value=0.034; Accession=PF02018.8; Description=Carbohydrate binding domain
MKFFDFGYSCYFDSLYVFGSFCQQLIHKLTGVAIALKTTSVWQNHPGFDHNIEGWTVFGKGAIKERISNASSRFIVAHNRTHPLDSFSQKVQLKKGMLYTFSTWLQVSEGSDIVSVMFKTKGSKMTWIIRNYPAELVIVLTRGNFWVSLRSIVHIWVMSKKGPLYVAMFKPIGIIFAVIMGIAFLGDSIYLGSVLGAAIAVIGFYAVIWGKSQEQAKEECEVYDDSESYSPVVPLLENKRMEE

SEQ ID NO: 179714 - protein, 84 aa, Glycine max
  Coding DNA Sequence Number=SeqID_88029
MSQDQAADIFTKPLKLETFVKLRKGHFEQGEEAESGDEPDQNHRFGMAQVQSLTRHHFVRQTISKINLVSSTVPTKSVSSPPFC

SEQ ID NO: 179715 - protein, 265 aa, Glycine max
  Coding DNA Sequence Number=SeqID_88030
MKGAQAYDAMMQRILFEPCGWRVRWRARDRVHPHMSLYGLCDPSASPSHKKSLAGKQQQSWFVGTSVRMMKHQIIEIIGYMMCRSTVKQKIMLRWAGSCSIDLNLSSVSRRVTRWRWDTRMLLLEGFALRENMTFDVAPLTAAKKRFVRCFGIGVFEKDPKIMRGLGVRHQGGHFIRENGEESTIYKAVLSTPGLEIIAIKESFNLLFPIRIIVGKKFGDIGESDASKGFGWLMGVGNEGVVVGHGRQGWGTTSLIEEIGNGWIV

SEQ ID NO: 179716 - protein, 88 aa, Glycine max
  Coding DNA Sequence Number=SeqID_88031
  Subcellular localization annotation: CTP_CleavageSite=32; ConfidenceScore=5.03e-01
MATSSSCSSVNDPTQTQTGIRNESASVGHHVRAGNLTVGHLPSPVVGPVGAGVVCHVHDAASEVGTEGQQTEKHAYPPLIDATPLSLD

SEQ ID NO: 179717 - protein, 88 aa, Glycine max
  Coding DNA Sequence Number=SeqID_88032
MDVCTQVVLSACWITQFTWSGTASSVGESELTLLDPAEEQRLRSQCWVAIAGPKHKGYLYGTGDPAHTYKCENDSFMQQISSNRVEDA

SEQ ID NO: 179718 - protein, 63 aa, Glycine max
  Coding DNA Sequence Number=SeqID_88033
MGCALSPSVVLHPRRQWYRQLTLLLEKQIDVAFVKKFYSNIYDPDDGSSKQCRVQGKIIKFDT

SEQ ID NO: 179719 - protein, 91 aa, Glycine max
  Coding DNA Sequence Number=SeqID_88034
  Gene Ontology: Mol. function=aspartic-type endopeptidase activity; Biological process=DNA integration
  Homolog annotation: Hit_ID=A7QX73; Match level="QueryCoverage=81%, HitCoverage=17%, E-value=8e-10, Identity=40%"; Hit description =Chromosome chr6 scaffold_214, whole genome shotgun sequence
MFDTLKNDGEFGHFKLGNGGKMKVEGIGSVKMKLHDGAIRTLSNVRFVPFAVVNMISMGEMTSQGCKYVGSKWRCKVYKGRQLVLQGQKNK

SEQ ID NO: 179720 - protein, 92 aa, Glycine max
  Coding DNA Sequence Number=SeqID_88035
MSGFVTNIYSRKTLEKPKRGMRISKRKGFGSCLRIGKAKGHLGAVTACPGELKLNPEAGSKDKDTNFVQATLLFDREIGENQGSETEKTRGH

SEQ ID NO: 179721 - protein, 134 aa, Glycine max
  Coding DNA Sequence Number=SeqID_88036
MERFSDAGWEWSFQWRQSLFDAEIDVADRFLGDTKGISIHPNHQDKWVWKGDSSDNYSVGSVYKLLLGDSIDENQDGQNSSSLVGIDVLVKHFGCFSTNSEISFPPTWFWEAFWSQVSEMADLADSFNLEYMAA

SEQ ID NO: 179722 - protein, 133 aa, Glycine max
  Coding DNA Sequence Number=SeqID_88037
MGLPTTMPYQKRKTLDEVSLLSSESETRHDHKSTSTPYGSHRPRNPQWSRHLSQPTSQRNDESKIDKPKRSSPREKMSGVTTNIYSRKTLEKPKRGLRISKRRVRELFTHREGISTPHACHKGRQPLIECAKT

SEQ ID NO: 179723 - protein, 132 aa, Glycine max
  Coding DNA Sequence Number=SeqID_88038
MAFSILARQCSIGKFPHDGINDSSNLLRRARYLALVEVDVRVFVGDAFVAFSPLFCPSFCPYLGFCDYHLGDPQVLLLLGCCQVSSRIELGIRPCLVLFNSGLGAGTRGSCIGISSLKASSRMVARFTVKGV

SEQ ID NO: 179724 - protein, 174 aa, Glycine max
  Coding DNA Sequence Number=SeqID_88039
MVVLGYTLIPMKVITPSITCWVVKAQVSRLWKTIEHANGDAIGRHSWMDFSNIVSGKLCENGITTQKLVRDSNVAAPFLVIQHSRLQGCGALTHGEMYVETVVANVSNILLDPSLPTMYNSGIRVRPSKVYVINLGPFAKDAYFTFLILNAHKRITDLHLFGSVNIFTPRYTTV

SEQ ID NO: 179725 - protein, 139 aa, Glycine max
  Coding DNA Sequence Number=SeqID_88040
MKAKCYQLAKIMMQITKIEDEMFKTILAKDQMFGEVSRLFVVRWKDQLDHYWHSVDKHDNMHDVVYNKDLPKPTIVHGWTTLRTFYGLKGDHHVTLTYYVPNSMTFKVLLNEYKAMCSSLGKRPLYAAKSTLALSSTKI

SEQ ID NO: 179726 - protein, 147 aa, Glycine max
  Coding DNA Sequence Number=SeqID_88041
MNDKKFMVTRSQRVEIPEHNPKIERACHRNNANTRKRRMGETNRGNNRNRGNEADPLEHTLQDYLTSMVGITTSIMLPNLGDLNFELRHRLINMIERMQFHGLPSKDLVLHLKKFLRIIGTMKSPTTTPDYIKLDAFMFLLGVKAED

SEQ ID NO: 179727 - protein, 257 aa, Glycine max
  Coding DNA Sequence Number=SeqID_88042
  Subcellular localization annotation: CTP_CleavageSite=72; ConfidenceScore=5.96e-01
YPSPSPSPSHVPATVLSSSSSSSSSSSSSSSSSSSSSSSSSSSSSSSSFLCFASSCPQEAIIRPFIRIVPPMSAPVVDVNFAIIFAISPFVFAPLPLSHLRQRPTTFARRQQAVAPVAEDVKHVYHAVDKVHEQPQEAVTDDVVANAQGFLGGPNDTSILMEYVYHVTTTIWNRGERPELKLSSYGRKVEKFGRSALEIEGIVAATRLSLLIACSLDTVGEVTITLDDVALLLHLPITGTFHTFDALHEDQVVDLLE

SEQ ID NO: 179728 - protein, 152 aa, Glycine max
  Coding DNA Sequence Number=SeqID_88043
MVRGRRLRRFFREKDRRGHPRKTTFFRWIPWKNLQNLLSLDPAEEHLLLLEYQQFTFTRAEEGSSPRKNLRLQPQAPHVTNVIYPTTICTIHRDTRLEHYPGWRKETNKESQWRKNPMEGKPGRTKANTEEKKPYEKKRMAQRKKKPDEKQI

SEQ ID NO: 179729 - protein, 49 aa, Glycine max
  Coding DNA Sequence Number=SeqID_88044
MDDSFVLVIGFAVVENNNTDFNALMMAAVSMPTILLVFIAGENLISIDV

SEQ ID NO: 179730 - protein, 312 aa, Glycine max
  Coding DNA Sequence Number=SeqID_88045
  Homolog annotation: Hit_ID=Q5XM22; Match level="QueryCoverage=32%, HitCoverage=71%, E-value=4e-35, Identity=62%"; Hit description =Resistance-like protein HAAS-2
IFADGVAGGVCRGGQSQDSTHTWGISRAYLLHLVGCTLFANKSATYVHVVNLDAFRDLAHSGGYAWGVAALIHIYDQLDEACRTTIRQLAGYLTLLQCWIYEHFPSVHQCVTDDTYQETSPRASRWLTSKAHMKGITGASYRACCDGLTVTECPGCRTQSIGGLGRFRRFHLSRIDDMWMQFADHLLPASQLCLVPGQVSADYMEWFFRISHSFMIPTQAGDQRRDAPAADPEDYIQPPSPQVPVAFDPPPHVDGYEGYEAIAQRLEHVLNLRIVTAGTELYDIMHDYLTIAKGGPSADGTVRARQRRRTDH

SEQ ID NO: 179731 - protein, 154 aa, Glycine max
  Coding DNA Sequence Number=SeqID_88046
  Homolog annotation: Hit_ID=A7PD61; Match level="QueryCoverage=32%, HitCoverage=36%, E-value=5e-20, Identity=88%"; Hit description =Chromosome chr17 scaffold_12, whole genome shotgun sequence
  Pfam annotation: Domain name=DUF393; Domain location=76-152; Score= -25.4; E_value=0.037; Accession=PF04134.3; Description=Protein of unknown function, DUF393
  Subcellular localization annotation: CTP_CleavageSite=56; ConfidenceScore=5.63e-01
MALRFAAAASASVSRISRPQNPPFFSLQHRNNGTLKFHSPPFHHPLPTPSKRCNVRAISEVAVEPEISKKEQNESPKDWKIKMLYDGDCPLCMREVNMLRERNKSYGTIKFVDIGSDEYSPEENQGLDYETVSLSSSLYGLCQLSLLMFNRHEP

SEQ ID NO: 179732 - protein, 612 aa, Glycine max
  Coding DNA Sequence Number=SeqID_88047
  Gene Ontology: Mol. function=triacylglycerol lipase activity; Biological process=lipid metabolic process
  Homolog annotation: Hit_ID=Q2TQV0; Match level="QueryCoverage=99%, HitCoverage=98%, E-value=1e-161, Identity=50%"; Hit description =Enhanced disease susceptibility 1 protein
  Pfam annotation: Domain name=Lipase_3; Domain location=51-204; Score =76.6; E_value=8.2e-20; Accession=PF01764.16; Description=Lipase (class 3)
MAGGLLGDNLGLKEDVIKRVCGLASKAHNHKSTDKLYFYDKVRTSSGTYHVFSFSGSWDPAEWFFSKPFGGSKIDPTQFPSLRSIGNDEPALVNEGFAKRFDRVLKTSFKAEVNKAIGDGKQVVFTGHSSGAAIAILATFWALEEYLNPTKIQKPTPPFCVTFGSPLIGNHIFSHASRRENWSRYFIHFVLRYDIVPRILLSRLASIKQTFGSVLQFLNPNSKTSTQDPTRASLISEFYKTVMTNAASVTSHAACILMGSTSLLLGTVANFVELSPYRPFGTFIFCNGNGQLIVVKNSDAVLQLLFHTAQMSDLAELPEVANVSILQHQAYEAELDDSLGMQNVVYLEQLEQLPLSADGSNSDVATISAALDGLGLSTRARLCLRAAGELEKQKLKNEEKIKKEIQEKAVPSMTKLQNYKTTCEMHKGKGYYDAFKVQNEENDFQANVKRLVLAGVWDEVIEMLKRYELPDEFEGNSKWIEHGTEFRRLVEPLDIANYHRHLKNEDTGPYMIRARPKRYRYTQRWLEHAKRVPKPAPITESTFWAEVEELYSWINSKRHLDDEVKQRVVQLQKDLKKWTDDEKVLTKDTFLKDPNFIRWWDILPQELRVTSF

SEQ ID NO: 179733 - protein, 142 aa, Glycine max
  Coding DNA Sequence Number=SeqID_88048
IKKFANNSTFRKKVFQKLPRPIPEEVLPENTFGSPYSGMGFFQKLLRPIPEEVIPENTSGMDLSNFRKHFFRKTTKSSNTSRDHQWKAQGTTTESNNNQNHRKKAEKEEAVKKLSNESVKSNRATHKFKENYTGAKSSLYMH

SEQ ID NO: 179734 - protein, 622 aa, Glycine max
  Coding DNA Sequence Number=SeqID_88049
  Gene Ontology: Mol. function=binding; Cellular component=microtubule
  Homolog annotation: Hit_ID=A7PD93; Match level="QueryCoverage=98%, HitCoverage=97%, E-value=1e-160, Identity=50%"; Hit description =Chromosome chr17 scaffold_12, whole genome shotgun sequence
  Pfam annotation: Domain name=HEAT; Domain location=208-244; Score =26.3; E_value=0.00011; Accession=PF02985.13; Description=HEAT repeat
  Pfam annotation: Domain name=HEAT; Domain location=86-122; Score =29.7; E_value=1.1e-05; Accession=PF02985.13; Description=HEAT repeat
  Pfam module annotation: Pfam domain module=HEAT::HEAT; Domain location=208-244::86-122
MPRATTTQSQNIKQRVLTCLTKLSDRDTQVAGANELESIARTLDPHSVPVFLSCIHSTDASDKTPVRKQCVHLVATLSHAHGDALSPFLSKILACLVRRLRDPDSSIRAACADSVGALSARVTRQPFAAAFLKPLAEALFTEQDPSSQAGAALCLASAIEAAPDPDPARLARLLPRLERLIKSKVFRAKPALLALVGSVVEARGATSGAALRSLVPCLLEALGSEDWATRKGAAEALKKLASVERDLLAEFKGGCLKVFEDRRFDKVKLVREVMNQMLEAWKHIPDVSDEFSPPPQLQLSSKENASDGRYPPVSQNSCSPGSVMSKLRKKSSPASKSTPPDRSAVRNAKKSALSGDRMGSGVLQKLNHNHWDVRIAVSNVPDRGERRQKDEDVLERSKKDKSRFFKQETKRALFDKNSDDKMHKSGGSKAGSRVVPCSEESQDSGPVCNVTKDLHRNDKESEELSLIRAQLVQIEKQQSSLLDLVQKFMGNSENGMHTLETRVHGLELALDEISYDLAVSSGRISKSDAPKNTCCLLPGAEFLSTKFWKKTQGRYSSYRFSRTGSTPLLASSHYRANRNAKSNRLASHRFRVHGDGSFMTNPLAEIKINSREISGSARSELA

SEQ ID NO: 179735 - protein, 48 aa, Glycine max
  Coding DNA Sequence Number=SeqID_88050
MPVERCSQLSQGGLEAGMASRRSRWLVYDIKAKPEKAIVTTLVCGKPG

SEQ ID NO: 179736 - protein, 295 aa, Glycine max
  Coding DNA Sequence Number=SeqID_88051
MGPKKSEIIRIPINNNIEYAKKVFPKDWFIPKKWVNFENLMEEEFSVKDLFDHEKDITQETVDIMLYQKLHPNTIDKKALVGFLRNVNLEYMCRFIHNFLFNIVMPRLGSRDYHSRTNFKRRTRRTLFLMRNGGVDVFELEPSTGATQLKHSAEKVAIMEVDDEPVPETSIIEASLVEADDDIIETDLGVAAFCPKPMYDVDEQLFAAQSDTTYEDKLRRFNAIYIGPKSVSIAMMNNHLEAQKKMMFSKEHLRAGFPAIDHFFYSSWDTLPKEEEHTLGIYGDRGLVIKEFPPR

SEQ ID NO: 179737 - protein, 40 aa, Glycine max
  Coding DNA Sequence Number=SeqID_88052
MTAAEKMNYNKCTQLDLNVRTVCLSTDRESEPTIELIIRN

SEQ ID NO: 179738 - protein, 352 aa, Glycine max
  Coding DNA Sequence Number=SeqID_88053
  Homolog annotation: Hit_ID=A5C7N2; Match level="QueryCoverage=97%, HitCoverage=99%, E-value=1e-52, Identity=39%"; Hit description =Putative uncharacterized protein
MSKNKEELSMVAISLYRGNLHRVPDVPRRWPMPAPKITLKDFKSLLARRSKALSRLQNSNPNPTPTPLPNGSQTEPPPTVTVNHGEGPSTTVAREDGYRKETPLVAVSSAKKPLAGSDSEKPQLDSKIDEASVKKPSDGVAASEEKQTEPVAENVDQLNEKKKRKKEIEEKLQGLNDNKHNLVLVLKQILNAEEELKRRNSMQVVAMHGPSVPLQGDGTNDTGLMIRHMPPRLGSQGNLVAADVDGGEGDDFANYTMHSRHVLRTSSMSPSSESPLRRTPSLQQNVISHPSRANIGAAGSPSRFALSGHQGNPVNLPSVSVSGTSYIASSPSPAASGGTSVFRDARQPSPWK

SEQ ID NO: 179739 - protein, 175 aa, Glycine max
  Coding DNA Sequence Number=SeqID_88054
  Subcellular localization annotation: CTP_CleavageSite=53; ConfidenceScore=5.22e-01
IVSAQPSHASVIFGSSDATIHSNKQSNPLWRPPPHQHLKILGNNTSFTNQTLFAEEFQHTHNWIKNQCHLPRQAWNEKLASYTRRYEDCKLIHSNFNYNKNVFWTKFLQELPALGKAHAVAGASCTCSTCPPCPHPIDVPRAQTVFLEEEDYWCAGRVTSSRTRFQNFQVEERMK

SEQ ID NO: 179740 - protein, 159 aa, Glycine max
  Coding DNA Sequence Number=SeqID_88055
  Subcellular localization annotation: CTP_CleavageSite=48; ConfidenceScore=5.12e-01
MVAHYPSTVKLASKPEQRAHPISRSPQFNTDAHERNNAATAPAGAVPPAASRSCCIAAASETAATATPRGEAPSSRPLASPAATPRRGVQPIGGGAVGGCGGCFLLIRIGFRRGFGGVLWGRSLGHGVKQRDQKGFRLSTVGLRVEDHGWVRIEGGKSK

SEQ ID NO: 179741 - protein, 112 aa, Glycine max
  Coding DNA Sequence Number=SeqID_88056
  Gene Ontology: Mol. function=oxidoreductase activity; Biological process=ethylene biosynthetic process
  Homolog annotation: Hit_ID=O04076; Match level="QueryCoverage=50%, HitCoverage=19%, E-value=3e-18, Identity=75%"; Hit description=ACC -oxidase
MEKRFREAVESKGLEAEVKDMDWESTFFLRHLPDSNISKIPDLSQEYQDAMKEFTQKLEKLVEELLDLLCENLGLEKCRWTALLQTLPVMKELLRDKRRQSSNHHRNLRCCI

SEQ ID NO: 179742 - protein, 125 aa, Glycine max
  Coding DNA Sequence Number=SeqID_88057
MSKHRQKLHWPTNWRSQIKSFADAGNQFDFQSMQLKNDDDVNTITPDGILNLLQATITPTHNALLYYNKRWNMPHQDDFVGYLFTGKNPKRLDIPLGCSIEKLKDVIKQVALQEIPSYSIHESQT

SEQ ID NO: 179743 - protein, 1057 aa, Glycine max
  Coding DNA Sequence Number=SeqID_88058
  Gene Ontology: Mol. function=oxidoreductase activity; Cellular component=anchored to membrane; Biological process=carbohydrate metabolic process
  Homolog annotation: Hit_ID=A7QI21; Match level="QueryCoverage=56%, HitCoverage=85%, E-value=0.0, Identity=71%"; Hit description =Chromosome chr17 scaffold_101, whole genome shotgun sequence
  Subcellular localization annotation: CTP_CleavageSite=69; ConfidenceScore=5.11e-01
DAQIEKQFRASNVSDPGCASVLKSILCARCDPFSGELFTVQSSPRSVPVLCNSTIPANSSQSKTEVHVFCSQVWDTCNDVSIVNSPFAPSLQGQAGAPAHTNATKLTDLWQSKTDFCTAFGGASDNSSVCFEGEPVSLNKTETSISPPHGLCLERIGNGSYLNMVAHPDGSNRAFFSNQMGKVFLATLPDVGSGGTMKLDESSPFVDLTDQVYFDTQFGMMGMAFHPDFAKNGRFFASFTCDKSKWSGCTGRCSCNSDVNCDPSKLGTDHGAQPCQYQTVIAEYSANSTGSQPSLVESAKPTEVRRIFTMGLPFTSQHGGQILFGPNDGYLYLMMGYGGGAGDPYNFAQNKKSLLGKIMRLDVDNIPSAADISKLGLWGNYSIPKDNPFSEDKDLQPEIWALGLRNPWRCSFDAERPSYFLCADVGQDVYEEVDLITKGGNYGWRVYEGPYPFQPTQSPGGNTSVNSINPIFPLMGYNHSELNKNEGSASITGGYVYRSTTDPCMYGRYLYGDLYAGAIWAATEDPQNSGNFSTSRIPFSCARDSPIQCDSAPGNLPALGYIFSFGEDNNKDIYILASTGVYRAVRPSRCSYACSQEKATTTTTSAPSPTSHATRWRPTIYARRQQQEAHAVEDPLTTAEELNEEKQQPHVEEGVTNVEGFLDGPHDTLVLRDFENLLYESGMERKAKFSRPAPEIEGLVAASGLSPLIALREVTITLDDVASLLHLPIIGAFHNFEQLYVDHVVNMLVKLLETKIDACHWIVVARAYLLHLLGCTLFANKSVIHVHVIFLDALHDLTQSGTYAWGIIALVHMYDNLNKASKSMTRQLAGYITLLQCWIYKYFSSIGSAIAAKDYDERRPRACRWTFGKALPVLTYRRHLDRLTPDVVCWIPYDDHRSFREFKTILPYPALPLTSVEEMDARWMQFGDYIAPVGQIFVVPRQCSSYYMQWFYMISHPFMTPAQSGDPPRFPLVQQYDTFVEPDVSQQSRAATTPNKPDVDVHLPRHAVDGYVAIDAKLERLLNLRILTEGTEAYTVAKECLSIARSYIGQPIGGHRS

SEQ ID NO: 179744 - protein, 49 aa, Glycine max
  Coding DNA Sequence Number=SeqID_88059
  Gene Ontology: Mol. function=nucleic acid binding; Cellular component= nucleus; Biological process=mRNA processing
  Homolog annotation: Hit_ID=A5AQI8; Match level="QueryCoverage=93%, HitCoverage=9%, E-value=1e-16, Identity=89%"; Hit description =Putative uncharacterized protein
RFRDKKEVTEPEADPERDQRTVFAYQMPLKATETNVYEFFSKAGKVSCF

SEQ ID NO: 179745 - protein, 423 aa, Glycine max
  Coding DNA Sequence Number=SeqID_88060
  Gene Ontology: Mol. function=binding; Cellular component=integral to membrane; Biological process=transport
  Homolog annotation: Hit_ID=A7QI24; Match level="QueryCoverage=62%, HitCoverage=50%, E-value=3e-91, Identity=65%"; Hit description =Chromosome chr17 scaffold_101, whole genome shotgun sequence
  Pfam annotation: Domain name=MFS_1; Domain location=109-423; Score= -18.7; E_value=0.078; Accession=PF07690.7; Description=Major Facilitator Superfamily
MALVVAAYLMVVIILENIFSLQSWVRIFIFVVLMVLLASLLCIAFEAHEKNSGRSFLDEGSPLIVEPSPEDTTEKEDARKDSFNNQRTNLQLGENLNLFQAVKTVNFWVLFVSVACGMGSGLATVNNLGQIGESLGYTSHETGSLVSLWSIWNFLGRFGAGYVSDYYLHTRGWARPLFMVITLLIMSIGHVVIASGLPGALYAGSILVGICYGSQWSLMPTITSEIFGVGNMGSIFNTITIASPVGSYIFSVRVVGYIYDKEAWDGNTCIGTHCFMFSFLIMASAAILGSLSALVESPEFSPCAAAAMLTNSASGGDAPSRGFDTPKWDLESAALLHAISEHGGYAYVSMAALAASSGSWAEVGKTQKTKEGCSVLAAWWNFIHSRWLAFWINGVVRKQKLRLSKHLKPYSLSILNRSQSIAA

SEQ ID NO: 179746 - protein, 72 aa, Glycine max
  Coding DNA Sequence Number=SeqID_88061
MKRTLTYSIPYKIKIFNLVRFWNISTLSPSSLSSFIYVNVEVEDDSLPKISAEKVVKPEEHNGEIMSSTTNL

SEQ ID NO: 179747 - protein, 61 aa, Glycine max
  Coding DNA Sequence Number=SeqID_88062
  Subcellular localization annotation: CTP_CleavageSite=48; ConfidenceScore=5.20e-01
MASRLDVAVIHQIFGHPNAMKGSMFFNKTSNSVKLLSLHPNLAFKFTKANTADNRVKDVHP

SEQ ID NO: 179748 - protein, 51 aa, Glycine max
  Coding DNA Sequence Number=SeqID_88063
MAFIVSKINMGLMKAMGSTKRLGEGDGEFQDVGDDVGIGAGDVGEVDVGVD

SEQ ID NO: 179749 - protein, 74 aa, Glycine max
  Coding DNA Sequence Number=SeqID_88064
MSEQHDLEHHQQHKQIVEGVKRERHLHRSMELWKHRENRTVEKLREEGDGGSYVVEEVDFSNNLGQKLMLMYQP

SEQ ID NO: 179750 - protein, 156 aa, Glycine max
  Coding DNA Sequence Number=SeqID_88065
MVSFVDCRGDGVEFMNVSGSFLKVVSGEIMAAYARMSFCNATYEHNVAKIMQLVLCEDAFGMSEEGWAIDQNVVEEHNDEHPEKGSQNVIHGGLKSGQCVPETEWHDFKLVIVMVGSEHHLVDVFFHHSNLVKTLSPIIHATSPASILLLDKENWR

SEQ ID NO: 179751 - protein, 77 aa, Glycine max
  Coding DNA Sequence Number=SeqID_88066
MDFYKVEKKSQGPQVAWGLDVGTGCCRTSIKTLGDKRSDEILPLRALDRRLQEDWAREAREGPRIFMSLRVDFGPMD

SEQ ID NO: 179752 - protein, 70 aa, Glycine max
  Coding DNA Sequence Number=SeqID_88067
  Subcellular localization annotation: CTP_CleavageSite=43; ConfidenceScore=5.11e-01
MNPKAISLLSPVINQEANSLLAMNPKAVSLLSPVFNQEANPASCNEPKERWSLVFSVQPRRPSLKNSRQE

SEQ ID NO: 179753 - protein, 480 aa, Glycine max
  Coding DNA Sequence Number=SeqID_88068
MVLIEGSSLEESVDNGSEVCGYNDEVFEVSSNSNFLGIFEPVAKKMGENITTLVAMDATDTRTSMRVAPQLKKSPVQKEKCSHAPITLLGYTWVDGEVRLPFDDFLAIRASYPKRGFNATSSKWSFARQGSMDIVDLDTKTKPFVSFLPIGNNAPARIMTQANANMNAFCLACRNQIVVSKGPLNPHLNRTSGPCDAPTDVVPPPVTVTTKVARGKLLVIRKGAPERKKVKQQMLEFQPSTTTTLANFSALTNQGLFVKDFQLDRLIPPTMISNHGWQVLSKSNDTANWAIFWAFLAKGLETRTTNVEAFVRSWDGEISRLRSTLVVAEKEKEEAAVLHLCEFSDLGVFGINKDVYYGELMLIDDILKDATPTLERLMTPTKDFQDDGAGAEDEDHAFDDVYNAHEAGLNHCLRQVLHLCEFSDLGVFGINKDVYYGELMLIDDILKDATPTLERLMTPTKDFQDDGAGAEDEDHVWPRD

SEQ ID NO: 179754 - protein, 37 aa, Glycine max
  Coding DNA Sequence Number=SeqID_88069
MEAMMSMRKMMEHNTTTVVATSTAIEMDLDSPGRFNQ

SEQ ID NO: 179755 - protein, 167 aa, Glycine max
  Coding DNA Sequence Number=SeqID_88070
  Gene Ontology: Mol. function=heat shock protein binding; Cellular component=cellular_component; Biological process=response to stress
  Homolog annotation: Hit_ID=A7QI31; Match level="QueryCoverage=83%, HitCoverage=45%, E-value=1e-54, Identity=74%"; Hit description =Chromosome chr17 scaffold_101, whole genome shotgun sequence
  Pfam annotation: Domain name=DnaJ_C; Domain location=17-139; Score =48.6; E_value=2.1e-11; Accession=PF01556.9; Description=DnaJ C terminal region
MEEILTIEIKPGWKKGTKITFPEKGNHEPGVIPADLIFVIDEKPHALYRRDGNDLVINQEITLLEALTGKTLDLTTLDGRSLMIPLTDIVRPGAEVVVPNEGMPISKEPGRKGNLRIKLDVKYPSRLTPEQKSDLRRVLGILSTGETEYKRLTYDEPMSCHLDFFAG

SEQ ID NO: 179756 - protein, 107 aa, Glycine max
  Coding DNA Sequence Number=SeqID_88071
  Gene Ontology: Mol. function=methyltransferase activity
  Homolog annotation: Hit_ID=A7QMK0; Match level="QueryCoverage=41%, HitCoverage=11%, E-value=4e-13, Identity=77%"; Hit description =Chromosome chr19 scaffold_126, whole genome shotgun sequence
MEKGLLMVKRKGFVVVKDTTTDMVCMRLVSLNARSEDRFYVDQRENRQFISRISDGQKVLDICCFSGGFALNVVRGGALNVTDNLVVQLSRPCHLERNDPCNLPSLR

SEQ ID NO: 179757 - protein, 73 aa, Glycine max
  Coding DNA Sequence Number=SeqID_88072
MEDFERDEGFKWLVWNLVGIFSYFIHLVNLVGNMWRYGRGLIPWWPKLHLSSNVFFFILQSFIESNKALFAIV

SEQ ID NO: 179758 - protein, 236 aa, Glycine max
  Coding DNA Sequence Number=SeqID_88073
MAVLDYAGLEHRDNLSFEFILLRAGASEVHGKWNQNDEEGGPREGVDEGHGEAQSSMVPSPIMMGIVDVGVDKRWRKGFPVANGPNRNWEELAEGSRKARRHHQANSSAERRLTGGLGVEREALVVTGVNNEGWNACTSRWSSGDNPEMKQLSKDGEARPTTRCEAIFESLEHGWPGGEEPVAGHPLVPTRGGSIPWDLGHQNEGRLALSKSCYRLFKTFNGGLSGIMFWQSGFLR

SEQ ID NO: 179759 - protein, 89 aa, Glycine max
  Coding DNA Sequence Number=SeqID_88074
  Subcellular localization annotation: CTP_CleavageSite=86; ConfidenceScore=5.38e-01
MATSSKTQLASLDGAFQPTPDHLQVLQPTPAKLCKAEVAGQTSASMQPPGCVNTSGDNTACVTSCSGDMPRVTSSPKAPVVVAPCMAST

SEQ ID NO: 179760 - protein, 117 aa, Glycine max
  Coding DNA Sequence Number=SeqID_88075
MKGYAFTKSPLLLALPKPPQQKGTRCWEWRFHGHVARPCRSAISTGAMHGQLRTKQHPLGNTSKTALVWEILSKRTPNREMCHDAFCKPIIRASVPKLNLDDAFEQKNDIAKAWKMN

SEQ ID NO: 179761 - protein, 115 aa, Glycine max
  Coding DNA Sequence Number=SeqID_88076
MRVVYRKNPSCLVVLGKVYEGSTIVHNIPLLYDKVKVGVEEVRDADTLIPVPTEEVKVIEQTLNTFLAWSTHLVKRLSEHEVVGPAKPANWPDHEVDDPQYLMTLTIPQLFLKPL

SEQ ID NO: 179762 - protein, 473 aa, Glycine max
  Coding DNA Sequence Number=SeqID_88077
MHSLRELERERVAERVKHKVGKVREKQGGWNQKTFNCFRTKNDLKEKEKLEAIPNSVVLHHKLPRGVLRRHRTIKEVFVAYRRLRQGRRYGFVRFSEVLDIDKDSLLLKKVEFMKVLIMTSTQQTISKNFKISINGVITQVKLVEEMKVFENHCFYKGDRISDEEDTCSKDSEMGMCLGSSSSECFFDAWHATKHDVVRRQDYESMNARPQKEEEQLGETNDCHKYLNYKISLVEKGGILKSNSKVSNSLNSNTPPFTPFPTNKVDDALCSSSSNIKRRKITIAGNNNQYCSKSHSSSNDKGEVEKMLNQGVNMGFSNYGRKRVVIGILINLEKRDESKVKTVKRLIRKYDIQFIALQKREKDFIDLEFGKRLWGDYDMSWKVIPTNNTARDNWRDNNEVITLVNVYSPCDLEDPSFHEVVKEIWQNSQVEGQSAYVLKEKLKITKQALKRKREVCVRKKRQEKYIFKVNFGY

SEQ ID NO: 179763 - protein, 226 aa, Glycine max
  Coding DNA Sequence Number=SeqID_88078
  Pfam annotation: Domain name=DUF1723; Domain location=131-178; Score =22.4; E_value=0.0012; Accession=PF08330.1; Description=Protein of unknown function (DUF1723)
TRGLGRALGQVTGRGVGRGDHDDSDDAPQRRRSTASARRQRVAVTAAHNEPVVPTPDVQDDPMEASAAVEDIVVDIPANTGAEAAEDEHEGFSGGPSDPSVLTYLGRPVPAIQGLVAGTGLSPLIACSVDTGNRGFLSAFVERWHRETSSFHLPVGELTIIDLHAFEPLHVDDAVQMLVDLLMVSTESVRAEQPSVVDRCTLFANKSATNVHVVYLEALRDLSMTK

SEQ ID NO: 179764 - protein, 177 aa, Glycine max
  Coding DNA Sequence Number=SeqID_88079
  Gene Ontology: Mol. function=nucleoside-triphosphatase activity; Cellular component=endoplasmic reticulum; Biological process =response to abscisic acid stimulus
  Homolog annotation: Hit_ID=Q9ZPX7; Match level="QueryCoverage=34%, HitCoverage=13%, E-value=3e-20, Identity=75%"; Hit description =Putative uncharacterized protein At2g46620
MAMELDRKNKVKSDLESFLRAKRYYHRLGRVWQKSFLLYGTSGTGKSSFVAAIVNFLSYDIDLCQIPSDSDLKLLLLKTTPSWAIKSVITALQANGDGRRCGLIRRKTEDDLMDEPYGVVCDEDLHKLRICGNYGRMRERNVKGRTEEGWKKERGGRIQEKNYIFCNGFKSFISLFY

SEQ ID NO: 179765 - protein, 727 aa, Glycine max
  Coding DNA Sequence Number=SeqID_88080
MPLRATASSCTSICTQFNSELRAPELHTSIWRDTFVKRTGGKTCKTKDYDAQARESDRERNVHRLATRVLVYCVEGSMKPAPKRGRMLSDVGCGTLDKCEGIAGRCGLSSPRAWTSVVRVAFVKLSGMGMSLVCQVKEVLIVVGSIEDTRYVLSTTTGGASWCENLGHHFYSRQYSFSLTMSSFLFDSFIGMDDGDSRGSIEQPMINQEVISIGSSLSKDTRCGASDNEFFSLERGATFRYCWGACPCYCDPHLLCFWGVRRGSGSGDVKASPHVRHSHRTGSSSSILVMVGYAWVKLANLEDYRKLVVQACGNDNFPFLEAASGTLGYVLFSTPPKQLANADWQDWLGLLEQHFQEAVLSIDVLVDGLSLMFNRDKEPHFPFYRQFNPTRFKSFDEDLLTPVERVDEAILEQLSTLLDTRAILSLPSVGPTGGALPPPAAIAAAGEGGLMPGAGRPLIVQDVPSALPIIEAPAVSDLTYERMRKHKFHASLDDVVTPAPSPPLVIAIQEATLDVAKVNVPTTLASSIVAPSSTVVAPLLSADVATTRAYVVLPPYSLAPMRSLAILEENELRHQEALHKVASSEEEVAKWRANVIIAFVEVVRLNCQLSSKVGGHTTKRDELVKVVADLEAQLKESESRLEEREANKELEEELLVYKKESVEQHEKGFNKAIKQVGFFTKDLDLGLFDPFKDVKDGVLLDKEDFVAEEKIVNEEQGVAKQGNDAHV

SEQ ID NO: 179766 - protein, 115 aa, Glycine max
  Coding DNA Sequence Number=SeqID_88081
MRSLHESAKYTTGDGTTTLDANIDYFLCFLHFQSSLLVMCFDLIDWIVRIILAEARGAAGAMDEVDSELPEFLGGTCKCANQGGRIPRADKSAVKKVDEKASKPKNTTDKTAAST

SEQ ID NO: 179767 - protein, 170 aa, Glycine max
  Coding DNA Sequence Number=SeqID_88082
  Subcellular localization annotation: CTP_CleavageSite=62; ConfidenceScore=5.32e-01
MISSSHLRIRRSKGNTLVDPKKLPSLVTGAWGANTFPVRKQLLNPHFQNTQTFAFLVFLEFSSNKYWWRLRSFSPLETNTLAYYLGLFAPLPKGRLRQYFMQTNFANASPQEMALKKLPAKRSRKNAAGEGSNAAPQVDVEFDGHNFWSGEHQCRFEAIKGWSFLKERRV

SEQ ID NO: 179768 - protein, 98 aa, Glycine max
  Coding DNA Sequence Number=SeqID_88083
MTTACLAGEAGWPEWLAGRASTIDGHGYTRGRLPLEEKTTMWKRLTLEGEMCWVTSVRYHLLWILRVWTLNNVTLNLDKLQKNKNNGKNIYRIGYGTV

SEQ ID NO: 179769 - protein, 124 aa, Glycine max
  Coding DNA Sequence Number=SeqID_88084
MKELLPQMEAQPLSRIPKRMGLPQLKCVPSLNCPINLGPIRRRIMVLDLEILTHFLHHFIVQIGGIISDNLPGGYIYLDLTENKRGCISCGSVLVEGTSTRLFKENKGGYIPCGSLLVKGFLQG

SEQ ID NO: 179770 - protein, 132 aa, Glycine max
  Coding DNA Sequence Number=SeqID_88085
  Gene Ontology: Mol. function=small conjugating protein ligase activity; Cellular component=nucleus; Biological process=regulation of protein metabolic process
  Homolog annotation: Hit_ID=P25865; Match level="QueryCoverage=85%, HitCoverage=74%, E-value=1e-60, Identity=96%"; Hit description =Ubiquitin-conjugating enzyme E2-17 kDa 1
  Pfam annotation: Domain name=UQ_con; Domain location=8-123; Score =178.7; E_value=1.5e-50; Accession=PF00179.17; Description=Ubiquitin -conjugating enzyme
MSTPARKRLMRDFKRLQQDPPAGISGAPQDNNIMLWNAVIFGPDDTPWDGGTFKLTLQFTEDYPNKPPTVRFVSRMFHPNIYADGSICLDILQNQWSPIYDVAAILTSIQDILGENWRWQLHHLFSNHPISP

SEQ ID NO: 179771 - protein, 114 aa, Glycine max
  Coding DNA Sequence Number=SeqID_88086
MGFFWFYFRHGVVLYVNSAPCRTQTAIANGEFGVTEQAANGTGETCLNRHYRWRFVQARNRQSNWRVPLSFKGELQLPLASCLEVATPIGDLGLKIAITSGDFMPIYTFQLCVF

SEQ ID NO: 179772 - protein, 115 aa, Glycine max
  Coding DNA Sequence Number=SeqID_88087
MVSLGETQITPNWVLILSPTMSLIQCNTEQSKPAIEKVESNPAIQPYWQHFHKKYQDTTQNSGHAYLHQHWKGLKNPRLRLRRGSGGGSSGSQGQVLHGDNLNLRLVAGRTSRRC

SEQ ID NO: 179773 - protein, 85 aa, Glycine max
  Coding DNA Sequence Number=SeqID_88088
MAQILTKVMMQSYPPRVLDRRLQEAWARATKEGPRVLMNLRGVCVAKALASHLKEVSLAIRGEASQGSFLRKFLKEASQGGDLSY

SEQ ID NO: 179774 - protein, 125 aa, Glycine max
  Coding DNA Sequence Number=SeqID_88089
MATPFKTKDINEEVTSEDIKSLMEQANYTNKYLQILGETIKTKVVPKQKSVEEASPSIPIEKPLFKPFKVFNVSEKAKRKIRELRKTKSLVEGVGDNHSELLNKIGSLLKVIPETPQTSENTSKM

SEQ ID NO: 179775 - protein, 105 aa, Glycine max
  Coding DNA Sequence Number=SeqID_88090
MKMRLIKMVSSDARIHKERFLINYNINMSLSQRALLRASEGEAHRCAFQRRKDARSRHQRLFVENVGKTEGNRSKMKILSSGVVFTFEEGISTSHVCLEGQQPIF

SEQ ID NO: 179776 - protein, 52 aa, Glycine max
  Coding DNA Sequence Number=SeqID_88091
MWGYLPGSLPQRMPLLMLVLVRVPPSGYSWKDVCGGGCGFAMAISGTTARLK

SEQ ID NO: 179777 - protein, 37 aa, Glycine max
  Coding DNA Sequence Number=SeqID_88092
MEAHDVDVGTTVVGVKDGEEEIHYKRMRYIMQIKELH

SEQ ID NO: 179778 - protein, 65 aa, Glycine max
  Coding DNA Sequence Number=SeqID_88093
  Subcellular localization annotation: CTP_CleavageSite=23; ConfidenceScore=5.19e-01
MTYWMTFRSARMHNSSFFQILPRAQPRSVALSGWLTKPEDWLSKRMKVSTSQTCLINLKLRENDY

SEQ ID NO: 179779 - protein, 65 aa, Glycine max
  Coding DNA Sequence Number=SeqID_88094
  Subcellular localization annotation: CTP_CleavageSite=41; ConfidenceScore=5.09e-01
MFAYSPFAKRKPRAKHIFVHALSRKSQALSNQPLHLRLICSAKLAKVELSQLQFDMNSAKLQPDQ

SEQ ID NO: 179780 - protein, 99 aa, Glycine max
  Coding DNA Sequence Number=SeqID_88095
MFLILANRKVLFDTGFCTRQKIIRRFGQGWGKYPREGQKGHFQQFSGPWLTQASLWLAWAPKLLRGEGTSLLQDEASARLGELQVHQVPFFAINKREGG

SEQ ID NO: 179781 - protein, 163 aa, Glycine max
  Coding DNA Sequence Number=SeqID_88096
MVGLNDRAIADALQALAQAIGNPNRGEAGGAIEYQGEIEKIFRVMACPEGQKEQEGDGVLGVKQAMNYQGPMRIKKNGPQHRGKPYLTPPKQYGNCPNNQKTVAMGFAGGSGSKPRHIQRDCPHPMKEKNGGGLNGQTRHPKATGRLFTLNGAEASKSKDLIQ

SEQ ID NO: 179782 - protein, 107 aa, Glycine max
  Coding DNA Sequence Number=SeqID_88097
MDNEEGVQEQMKADLSALKDQMASISEVMLKLQKTIEDKATATASSTVREAEPVLQPALNPGLDRNTAVFGRRKGPITRTMSKRLQEDWARAAEEGPRVLMNLRVDF

SEQ ID NO: 179783 - protein, 112 aa, Glycine max
  Coding DNA Sequence Number=SeqID_88098
MTKGNDGTSKPYTGAMRGTVHEPRVNIGADQKGLHVLALRGLHALTIRGLHVLALRGLHALTLGTSYPHRQRTTRPHLERTTRPHHQRAARPHLQRTINPRLERDTRPHLGY

SEQ ID NO: 179784 - protein, 95 aa, Glycine max
  Coding DNA Sequence Number=SeqID_88099
  Pfam annotation: Domain name=Rick_17kDa_Anti; Domain location=23-61; Score=3.4; E_value=0.084; Accession=PF05433.6; Description =Rickettsia 17 kDa surface antigen
MRNLTSEECSIISGAGDRSGTLTVSAETVGAAIGGGIGSIGGVAGGVVGTIVGGAVGNYVTGDRAPGSVGPSGIPWGGSNGGGTMWGNNNNTDSN

SEQ ID NO: 179785 - protein, 68 aa, Glycine max
  Coding DNA Sequence Number=SeqID_88100
GCSICGGAHESGHCIPIDDSAQEVNYMGGNKPRQANIEKNPKEECKAILTRSRTAVMEDEERRIEDTK

SEQ ID NO: 179786 - protein, 286 aa, Glycine max
  Coding DNA Sequence Number=SeqID_88101
  Homolog annotation: Hit_ID=Q2HW90; Match level="QueryCoverage=87%, HitCoverage=61%, E-value=3e-11, Identity=42%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEEILGCPLGGRKPYLSSGVSLFEQNCNCGQGFSKRFGPHKTDSERHSGPTTEVPRRQGEGYGQSRRLGPVYGCVSFANFWGCPLSKRAKKVAHGSSVACPPSVFGWFHTCSSKTRGIHVRSRAIAREGKEGVLFSCGGYPNIPLIGTRGCINYNPALAIRQLGYPMRGAPTEESMSPFLVRDFGARNFKAIQAIHKAWET

SEQ ID NO: 179787 - protein, 158 aa, Glycine max
  Coding DNA Sequence Number=SeqID_88102
  Gene Ontology: Cellular component=chloroplast
  Homolog annotation: Hit_ID=Q49KT9; Match level="QueryCoverage=34%, HitCoverage=51%, E-value=5e-12, Identity=70%"; Hit description =Putative uncharacterized protein ORF113
MSPHGGDMDGGEKRKERDGVSLAFGIAGPGGRPARRAISSVVERAPDNCVVVPGLHISMAYFSCLNRGLKPNLSSEDRWGDSGEIQCRSNFLFTRGIRRSGGDHHGSSLLENSYIPYQYMDSYLSSTGLGLASMEKNGAPNNVSSQTKNYEIAPFILG

SEQ ID NO: 179788 - protein, 278 aa, Glycine max
  Coding DNA Sequence Number=SeqID_88103
  Gene Ontology: Mol. function=transporter activity; Cellular component= integral to membrane; Biological process=transport
  Homolog annotation: Hit_ID=A8GHR0; Match level="QueryCoverage=100%, HitCoverage=27%, E-value=1e-134, Identity=89%"; Hit description =Multidrug resistance protein mdtC
MASSVATPLERALGRIAGVNEMTSMSSLGSTRVILQFDLDRDINGAARDVQAAINAAQSLLPTGMPSRPSYRKVNPSDAPIMILTLTSDTYSQGQLYDFASTQLAQKISQTEGVGDVSVGGSSLPAVRVELNPSALFNQGVSLDTVRQAIANANVRRPQGAVENPQQRWQIQANDALKTAEAYRPLIVHYNNGSAVRLADVAEVNDSVQDVRNAGMTDAKPAIILAISRAPDANIIETVDRIRAELPALQENIPASIKLSVAQDRSPTIRASLAEVEQ

SEQ ID NO: 179789 - protein, 64 aa, Glycine max
  Coding DNA Sequence Number=SeqID_88104
RCDEDKNKGKDPLEGLGGPLTRARARKAKEALQQVLSILFEYKPKFQGEKSKVVSCIMAQMEED

SEQ ID NO: 179790 - protein, 53 aa, Glycine max
  Coding DNA Sequence Number=SeqID_88105
YFNNVRPLEAERLKALHIQCGSNAFQDYFDDAKESRVKQVPKNQESNKFQESR

SEQ ID NO: 179791 - protein, 113 aa, Glycine max
  Coding DNA Sequence Number=SeqID_88106
MILRGQDIYSSQDEATTSPSSSESEEGKGEESSEEIYPQEEGQPLVVKEKCKEVSVSSKSLTKKETHFTIKTNIKETFPLRQPPHFLFCKKTLVSTATPLGLEVIPQVLREEA

SEQ ID NO: 179792 - protein, 119 aa, Glycine max
  Coding DNA Sequence Number=SeqID_88107
MLSQVPPLPLIFIFLFSPLKTLSFSHSPPNLSQKNDDLGSVHRWIVVKFEHHVRNPISSILTVGNFDIMFEMREIPFAFSWFSSSHLHPWDLRDNSHAERKRNRTKTVQAEASIPSLSL

SEQ ID NO: 179793 - protein, 160 aa, Glycine max
  Coding DNA Sequence Number=SeqID_88108
  Subcellular localization annotation: CTP_CleavageSite=98; ConfidenceScore=5.02e-01
RQASSLTRRNHHGRLHPLPKTQCLSTKTTLVSPFRHPEISESDDTPETTLVSPFVNQRQASSLTRRNHHGHLHPLSKTQCLSTETTLVSPFAIQRKPSLMACKDHGVPFAIQRQASPIACGDKHSRLFPSSKDSTSIDQGYQSTKAFADAPNVFYAPSFD

SEQ ID NO: 179794 - protein, 132 aa, Glycine max
  Coding DNA Sequence Number=SeqID_88109
MYTKAGFRPDYCRETGADHVHQHNHPYTDMDDVTTQQHPAQDGAYETPYGPREVQWGPGVPSFDHGPLPDLRSARRRQQGHSASHYQSLHREVLHPQASAGLGTAAARGGSAASGKCATAATRGGIVFEIPL

SEQ ID NO: 179795 - protein, 434 aa, Glycine max
  Coding DNA Sequence Number=SeqID_88110
  Homolog annotation: Hit_ID=Q2HW90; Match level="QueryCoverage=15%, HitCoverage=14%, E-value=2e-08, Identity=40%"; Hit description =Putative uncharacterized protein
MGSNQTPLLKKRFYQVKIKSLEVTSLQELGQLMGQLQQQAFRKAYGKIWDLATIEVSVEVIASLTQYYDQPLRCFTFEDFQLVPTMEEFEEILGCPLGGRKPYLFSGFYPSIARATKAKALENQGEWTSFIDILALLIFGFILFPNVEGLVDLALLTLSSPFTIARKARSSPFWPTWMTRLTGGPFVRYKVIARAPRKERRIGTNSYLAWRGRPLIGSLAGRKEEPGLCPRAKDFQIGAPSEKSIMPFIARGFSDPNARVLQGVRKAWDAVRRKEKELKGSSNGIIGNYRRWLRVQTQGLDWLPKLKAARDEEAKALEESEEVQALKAELERVWAVKVKFKSTAIKIRREYDELRDINMATTEALERETKRAQKEEHGRNKSKRNLSQQLSKTEGNMWVIINEYKEKLNQAVTHEQRLEDEYTKISAEREARER

SEQ ID NO: 179796 - protein, 182 aa, Glycine max
  Coding DNA Sequence Number=SeqID_88111
  Gene Ontology: Mol. function=helicase activity
  Homolog annotation: Hit_ID=Q94LS7; Match level="QueryCoverage=52%, HitCoverage=6%, E-value=8e-09, Identity=38%"; Hit description =Putative helicase
MIFNNSKGPPTIIIQGQSCHLIDIMLPVFDSAPMFAQLYIYDTENEIQNRIEGSRNRSLDTHIVPHCFQYCRKPLARTYRTPYTALGSVARRNFTYTLGTRVLKHSWVLKAQSFLREVLLLIEVRGKLQVSCHFVRSHCHCHCLGSRLLGAPVAITSDKDPVIVHNKLLTLLVIILKFGALV

SEQ ID NO: 179797 - protein, 389 aa, Glycine max
  Coding DNA Sequence Number=SeqID_88112
  Gene Ontology: Mol. function=protein binding; Cellular component =cytoplasm; Biological process=red or far red light signaling pathway
  Homolog annotation: Hit_ID=A4UV21; Match level="QueryCoverage=78%, HitCoverage=63%, E-value=3e-20, Identity=30%"; Hit description =Putative phytochrome-kinase-substrate
MVMSAATSNNNNIHQLQSFNSQNNNYHLCGTSFSSYLNNKEDILAESGHGYVSSRKDPLGVKKEDDGEIGVFEAEKYFNGEEIESPPRVADNDANKHRPQKDEQTALVTRKYKVQNGTPSVRSESSLNSQSALLQSVVRNSSRNMKSKLHRKSFLAGLGCKCYCSDKNSVDISHHAGEISFSKNSSHGKITSRNMFNADPEANHSVKVTRPHAAEISINKDVYFQSPEKLGVGLSKENSLALSSLNSSPGNNSAKMKLQQVEKSRNSLEVFGSPILSSRSKSLSFDKKLVKTYSSSWDAAPKIEEIDFSANSGGNYNDANSDASSDFNVNIDTEKKKNSLGIKIVAGITPAASALAISAIIIFLISRRNMKYQKKIFRKRMCKCSEALC

SEQ ID NO: 179798 - protein, 65 aa, Glycine max
  Coding DNA Sequence Number=SeqID_88113
MGYKLWVERGGKEVSFSQTPSLPLFSEPVFLLLHEFQSPRGVRAVGRFPSPRMLGIVGDFIEHKV

SEQ ID NO: 179799 - protein, 181 aa, Glycine max
  Coding DNA Sequence Number=SeqID_88114
MSRISRERKVQVPESFERFCYVKICRDQSLKQEPYAFTLITQMYALLGSFNSGNGSDSKVLDSAGLSCRTFTRNRDSLYACSYSHLFLHTKHLFAEIAYQITQVPREFDTRFLLFYTTCAIRCTCRKPNKRIIPRLGLDHFIQEGRGQFGGIWCLWKSNRWNVEIIHHGHQLMRMKVGWKN

SEQ ID NO: 179800 - protein, 45 aa, Glycine max
  Coding DNA Sequence Number=SeqID_88115
MHLRDQGGLVRARALSAIMDRLAHISEFRLSACLSRLTDELKRCA

SEQ ID NO: 179801 - protein, 51 aa, Glycine max
  Coding DNA Sequence Number=SeqID_88116
  Homolog annotation: Hit_ID=A5AMK2; Match level="QueryCoverage=74%, HitCoverage=4%, E-value=3e-08, Identity=73%"; Hit description =Putative uncharacterized protein
MEEVVPMLQVPDEEVKVIQQVEVCFTIGRYNDKVLCDVVPMEATHILLGRP

SEQ ID NO: 179802 - protein, 149 aa, Glycine max
  Coding DNA Sequence Number=SeqID_88117
IYENFLRELNPTASDAQLNQDIPSNFPTWFKQYVDKKYEIVEVSQSNKYTKAYDPFIFAQQAEQVYFTTYPEGHQGWLPVMKTKARRRIIDNIVSETEQEASYQDHELVGLQEVLEVDPDVINESLVVNMKEKINNLFWCRKHVYVSFH

SEQ ID NO: 179803 - protein, 167 aa, Glycine max
  Coding DNA Sequence Number=SeqID_88118
  Homolog annotation: Hit_ID=Q9AVH2; Match level="QueryCoverage=28%, HitCoverage=16%, E-value=5e-20, Identity=97%"; Hit description =Putative senescence-associated protein
MTEGCDEGFCLANLPGDAFSLWGNFFEAKKQMMADAKFAGLLGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 179804 - protein, 59 aa, Glycine max
  Coding DNA Sequence Number=SeqID_88119
MADVYLAPEEAVNTITKHTFRHPYRTHSKTRVMGDIEEVQEQIKADIEALKDQVASVSA

SEQ ID NO: 179805 - protein, 46 aa, Glycine max
  Coding DNA Sequence Number=SeqID_88120
MGAYSCGRKVVGPFLSRQLGQSGTVAWQYPVQYGHGSRSEPAQSID

SEQ ID NO: 179806 - protein, 101 aa, Glycine max
  Coding DNA Sequence Number=SeqID_88121
  Gene Ontology: Mol. function=aspartic-type endopeptidase activity; Biological process=RNA-dependent DNA replication
  Homolog annotation: Hit_ID=Q6VPE8; Match level="QueryCoverage=72%, HitCoverage=8%, E-value=5e-09, Identity=42%"; Hit description =Putative gag-pol polyprotein
MPLYWWTFPCLKERRIHGDPPVEYWNDLKSALRKRHIPSYYERELMDKLQRLRQGIPMEAGHILLGRPWQFDRKIIYRDLTNEITLTHLGTKFVLHSQTPS

SEQ ID NO: 179807 - protein, 253 aa, Glycine max
  Coding DNA Sequence Number=SeqID_88122
  Gene Ontology: Mol. function=transporter activity; Cellular component= outer membrane-bounded periplasmic space; Biological process=sulfur metabolic process
  Homolog annotation: Hit_ID=A8AID6; Match level="QueryCoverage=84%, HitCoverage=65%, E-value=1e-109, Identity=92%"; Hit description =Putative uncharacterized protein
  Pfam annotation: Domain name=NMT1; Domain location=49-251; Score= -51.6; E_value=0.00022; Accession=PF09084.2; Description=NMT1THI5 like
  Pfam annotation: Domain name=OpuAC; Domain location=42-250; Score= -57.2; E_value=0.02; Accession=PF04069.3; Description=Substrate binding domain of ABC-type glycine betaine transport system
  Pfam annotation: Domain name=SBP_bac_3; Domain location=44-250; Score= -81.0; E_value=0.013; Accession=PF00497.11; Description=Bacterial extracellular solute-binding proteins, family 3
  Pfam module annotation: Pfam domain module=NMT1::OpuAC::SBP_bac_3; Domain location=49-251::42-250::44-250
MPVKSSMRWMWKCATGICINFEPERFDGPFTSTGPCRKTAPESLRIGYQKGSVSMVLAKSHQLLEKRFPDTKFSWVEFPAGPQMLEALNVGSIDLGSTGDIPPIFAQAAGADLVYVGVEPPKPKAEVILVPENSDIKSVADLKGHKVAFQKGSSSHNLLLRALQEAGLKFTDIQPVYLTPADARAAFQQKNVDAWAIWDPYYSAALLQGGVRVLKDGTTLKQTGSFYLAARPYAEKNGAFIQGVLDTFTQPMP

SEQ ID NO: 179808 - protein, 63 aa, Glycine max
  Coding DNA Sequence Number=SeqID_88123
EARLTGALSKGGMMHGVTTNEGISTSHVDKSGALAPTHPPSKRKSDLRSSFFKGESSNSFYLE

SEQ ID NO: 179809 - protein, 100 aa, Glycine max
  Coding DNA Sequence Number=SeqID_88124
  Homolog annotation: Hit_ID=B0HC01; Match level="QueryCoverage=31%, HitCoverage=65%, E-value=1e-09, Identity=100%"; Hit description =Putative uncharacterized protein
MLVRGAELWKTPATRPFTVLAFCWPFAHMFFLRYPLILWITVLPPLSELIPLAAAERPSAARNSYDHDYEFELGTLSISKYHGVCQTQGTVIFQSVCLQS

SEQ ID NO: 179810 - protein, 62 aa, Glycine max
  Coding DNA Sequence Number=SeqID_88125
MSHVVKDNRGKWAPNYEGPFVVKRAFSGGALGQDRLELPSGVGTKHGQQKPIKVLRNGCKWG

SEQ ID NO: 179811 - protein, 93 aa, Glycine max
  Coding DNA Sequence Number=SeqID_88126
ELASKLCIPWRGFVLNAEGAPWKLLRKDLTTLAQTLSFLSYSNIAPTSHTSDLNMDRARLVYGLVMKMDMDVGSIISGQISQMVQSNSSRLGC

SEQ ID NO: 179812 - protein, 426 aa, Glycine max
  Coding DNA Sequence Number=SeqID_88127
  Gene Ontology: Mol. function=cation transmembrane transporter activity; Cellular component=membrane; Biological process=cation transport
  Homolog annotation: Hit_ID=A6T9J0; Match level="QueryCoverage=44%, HitCoverage=65%, E-value=1e-81, Identity=79%"; Hit description =Putative uncharacterized protein
  Pfam annotation: Domain name=Cation_efflux; Domain location=249-426; Score=-33.5; E_value=2e-07; Accession=PF01545.12; Description=Cation efflux family
MPAAANGVMLVALRIATGNAMTSIRGMIESQVLGLTGMALKEIDFENPKGEPGLFGPRSAIWQVHGDFTSMLCGGISALLLQMLHPLALAGVWDHSRFREDIFGRLRRTSQFISATTFGTTDDAERLIAKVQGIHQRISGVAPDGTPYRASDPALLTWVHVAECSSFMASHLRYKRTIVTAARQEQYYREAAEVARRLGAEDIPETPRSGAGAAHHPSAGPAKPAGRALDDGCGYRSASRLGAADAGDPHQSAAAANRQSGGQWRGAGTSRLGSQGLIADGIHSHSDLIADFVVLIANKKSRKPSDSDHHYGHWRYENGASLILGAILIVVGVGMLWSAVDKLLHPETIQSVHVTALWVALAALIAKETLFRYMLAVAKRIQSSLLIANAWHARSDAASSVVVAVGIVGNLAGIVWLDPVAALLVG

SEQ ID NO: 179813 - protein, 44 aa, Glycine max
  Coding DNA Sequence Number=SeqID_88128
MGLSGLKEHSNPMTPKAYTPKSPSGSLPPDSGPTPKIILAHRHC

SEQ ID NO: 179814 - protein, 107 aa, Glycine max
  Coding DNA Sequence Number=SeqID_88129
MMTSRKRKSPSTPTQVRFDRSRFTSQEAWERYTDIIVPRKLLPERNVVVYYTKFDEFKEELERHHWDEELTDFGDGNIDVAIVKELYANLYDPKDKSPKQVRVRSSD

SEQ ID NO: 179815 - protein, 245 aa, Glycine max
  Coding DNA Sequence Number=SeqID_88130
MAPKKLFVKRSRRDAAAEGTSAGPEFDSHHFQSAEHQQRFEAIKGWSFHRERRVQLREDEYTDFQEEIARRHWTSLVTPMAKFDSEVVLEFYANAWATEEGSTRHAFMGEGQRRNKADGFDEEAISQLLCTPGQDFRPDHCREAGVDNVHQHDHLDPDVDDIVVQQCLAYKGDAPQAANAPPPPHQADPAGSLGMERYLQHLVRQQGANQRGQGQGFAPFACPTPEQFRAEVARPGDWPEAQAGE

SEQ ID NO: 179816 - protein, 142 aa, Glycine max
  Coding DNA Sequence Number=SeqID_88131
FLIPVVKRKKREKEWAQPHARVFDPKGIENETRICVHYLWSGVTILNLLFPISPLPFFLFLAGRPRRRVPSAARPTDRSSYLYCLSNPKILIHGGVLRVGSDPIPAVKLLPDPAHLPLKLECLSFIEEATRGIDKFEVGCGM

SEQ ID NO: 179817 - protein, 62 aa, Glycine max
  Coding DNA Sequence Number=SeqID_88132
MSARVQPIAFLCFLRTDNNFSSCSSAREADIITGKLLLSSNGRRRWFLSLYLIKKVRGMCTS

SEQ ID NO: 179818 - protein, 69 aa, Glycine max
  Coding DNA Sequence Number=SeqID_88133
MEVEEPWLGLWLPLSYRVDMGSSLAYDNGIWGFVVDLGMAFMDNWVVGKEEVCYGLSNDIVRLVGNLAV

SEQ ID NO: 179819 - protein, 66 aa, Glycine max
  Coding DNA Sequence Number=SeqID_88134
MWMDRFALTLNGSQELPRLIAKAKAMADTYSAPKEIHGLLGYCQHMIDLMAHMKPLGSLYCHSDLD

SEQ ID NO: 179820 - protein, 174 aa, Glycine max
  Coding DNA Sequence Number=SeqID_88135
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSQLRSCSRREETRRKDTVFSPQEGILVSPQTLQ

SEQ ID NO: 179821 - protein, 76 aa, Glycine max
  Coding DNA Sequence Number=SeqID_88136
  Homolog annotation: Hit_ID=A6FJQ2; Match level="QueryCoverage=50%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLDFSIGKCTVSLELDKAGTE

SEQ ID NO: 179822 - protein, 30 aa, Glycine max
  Coding DNA Sequence Number=SeqID_88137
MAPNDTSESSFQRLRQALAGGGFSFSPQGC

SEQ ID NO: 179823 - protein, 249 aa, Glycine max
  Coding DNA Sequence Number=SeqID_88138
  Subcellular localization annotation: CTP_CleavageSite=39; ConfidenceScore=5.54e-01
AAHVSSTNESGVARSYCVVLFANSPFSTFIQRPMNSLPNAVHVSSTTESGAPRIDCLALFANYPFSNLIRRPMNSLPSVVLVSSVIKRGASGDWEICFSVIFRIGSFAKHKKKEGVQTRVVITERAGRTKSVSYLCFPLISDERYLAPFVAQYVKSRDVPGNQKEAGYASVEFRNVNGNQKEVFFRNPPTWAFQILPPEGGCFWRKQPGSPGKSKPRRFRNVSVSNYAKIFNRSSTFIVRSSSFVDLQP

SEQ ID NO: 179824 - protein, 82 aa, Glycine max
  Coding DNA Sequence Number=SeqID_88139
MSEIEEVQEQMKADMEAMKEKMTTLMEAMMSMRKMMEVNTDTVVSASTATEVREAKHWEVRATPILCRSKASIPSHHMAYSQ

SEQ ID NO: 179825 - protein, 68 aa, Glycine max
  Coding DNA Sequence Number=SeqID_88140
  Homolog annotation: Hit_ID=O22102; Match level="QueryCoverage=63%, HitCoverage=14%, E-value=2e-07, Identity=55%"; Hit description =Retrotransposon-like gene
MPTRMTLQLANRSITRPYGVIEDVLVRVKHLIFLTDFVVMDIEEDNVCLQVKEIDEKVLKERTKIDPG

SEQ ID NO: 179826 - protein, 104 aa, Glycine max
  Coding DNA Sequence Number=SeqID_88141
MSHNSCKSISEELSDYYRGRHRSHPRPHSHRREKERKPQEANINLSYFHGKDNVGAYLDWEMKVEKLFAFAIIQVRKGRFPWLPIASKGMPYIGGLPLLGKKDS

SEQ ID NO: 179827 - protein, 73 aa, Glycine max
  Coding DNA Sequence Number=SeqID_88142
MAAEWRRKRERRHHFKEKMSLEEAHCHRRPWIRAWRKKEMMTGKEEKSTNPLIQYQVQDSPLSVLRCHEACKA

SEQ ID NO: 179828 - protein, 100 aa, Glycine max
  Coding DNA Sequence Number=SeqID_88143
MSYADLLPYLLDNAMAVITPTRFLNHCFPEDTTPMLAEIRGGESLVSYDVARQYYITIDTLEPYTGAMRGTMHEPQANLGADQKFSPDRSKTRKGGLGKN

SEQ ID NO: 179829 - protein, 145 aa, Glycine max
  Coding DNA Sequence Number=SeqID_88144
MEQESHGQIQTATLDWNARGYPMVANNTSQCSKSNNEALRNFEQPQLLTRMTNWGPSYIGMLKMELGSLGKFNQPQFFTGMLDWGPSYMAPLEMGQGSLGKIQTAISFDRDARFRSIIYHNSQNETSPAKISIASLLTGMPNEGL

SEQ ID NO: 179830 - protein, 247 aa, Glycine max
  Coding DNA Sequence Number=SeqID_88145
  Homolog annotation: Hit_ID=Q2HW90; Match level="QueryCoverage=76%, HitCoverage=38%, E-value=6e-17, Identity=28%"; Hit description =Putative uncharacterized protein
MGSNQTPLLKKMFYQVKIKSLEDLAMIEVSVEAIASITQYYDQPLRCFTFEDFQLVPIVEEFEEILGCSLGERKSYLFSGFYPSMARVAKVVKISVQELDRVKRNRNGVVGIPRKHLEGKAKALTNQGEWVPFIHTFTLLIFGVVLFPNVEGLVDLAAIDAFLAYQHSKESQAIAILADLYDMFDRRCERSSARIVYCTPALYVCAKGVIALSELNALSVHQRLSPAPAHLASKRESGKASAMQAHA

SEQ ID NO: 179831 - protein, 80 aa, Glycine max
  Coding DNA Sequence Number=SeqID_88146
MVKALQHRHNDVWALSGGADPQGMYPPLFSLNLVDVPSTRTDPQEMYPLLFSVNNPSRCTLYLYHKGCTLQCVKTNISGG

SEQ ID NO: 179832 - protein, 261 aa, Glycine max
  Coding DNA Sequence Number=SeqID_88147
MSRFNNLMQKKQKKKRKGIALKANSSKEDYKESSCNEEEAENFNLMVKKFGKFLKKSKDKKFSKPSKKFESSNNNFTCFECAWEDNASTSSDSSSDEEVANAWQMADSMDDSSTIEEIEVNSEFEEVLEAFNEMHEEAQRLVLNKKLKSDLKLHITKLGSTQTELDKLKQENENLVSSYKAIGWVCISTSLNMDDYKSLQTEFENFKKDHYVERMKLQTEHITNPYLLPLMNTFLVGPNISRCNSSNGLEVETMFLLERKF

SEQ ID NO: 179833 - protein, 309 aa, Glycine max
  Coding DNA Sequence Number=SeqID_88148
MAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPATDHRTLPVAQGDAPQAAGAPPPPHQAGQAGAFGIEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 179834 - protein, 131 aa, Glycine max
  Coding DNA Sequence Number=SeqID_88149
NYGSLGWLLVVVGDGEEAWDVGKGFGKRKEMEIAFFQGYTNHKGCNTQTKFQEDPTVKQCTRTLLPRWVQAASLRSFLGVTPWPLDHLGQRDRWSTSIMRPGRLLDFSCSYFLVQYVQGKSGLPENAPDHQ

SEQ ID NO: 179835 - protein, 118 aa, Glycine max
  Coding DNA Sequence Number=SeqID_88150
DGDLDLNASPKALDKLLGHLLAFKVKIQAQYSNSAVLKCSTDLTLINDVLDMLPAAETCSKIKVTTPFDSNDPVHDESQSISITTYHDPLIGLPLTPTKRQPFHECDDEARNSHISPT

SEQ ID NO: 179836 - protein, 148 aa, Glycine max
  Coding DNA Sequence Number=SeqID_88151
  Subcellular localization annotation: CTP_CleavageSite=23; ConfidenceScore=5.22e-01
MRRPSWSSTFVVFLATYPSAGGRCRARGCVFHERKMRGVTTNVYSRKTSEKLEKVWSTNFKCERFGSCIYARGRSLSQPNLLRASEARLMGASSKGGKCLESPPTFICGKRQKNRRKPVMKNIPDSRVVFTFEEGISTSHVCPKGQQP

SEQ ID NO: 179837 - protein, 97 aa, Glycine max
  Coding DNA Sequence Number=SeqID_88152
MGEKLATQLAQASKVASSRSNSLLEESSGGPKWAWLLFAPPFLLNTPPAFFLNLADYIIITFLTYGMLRNLTNCATMLPFDFRCVTEPYGLCINIFF

SEQ ID NO: 179838 - protein, 173 aa, Glycine max
  Coding DNA Sequence Number=SeqID_88153
  Subcellular localization annotation: CTP_CleavageSite=56; ConfidenceScore=5.13e-01
MDHFKVLIPSSNVNTTLESGIFFMTGFLRFFRRFPQINVGGDFAHFPPLEEAPVSLASLARQRVGCDKANPAGSLGMERYLQHLVRQQAANHRGQVQIHECLYRFSLSQQGQGFAPFACPTPEQFGAEVAWPGDFPEAQAREEPTGSPGEAEEAHMDEEMTDLLGFLGGSGAT

SEQ ID NO: 179839 - protein, 209 aa, Glycine max
  Coding DNA Sequence Number=SeqID_88154
  Homolog annotation: Hit_ID=A7Q8B9; Match level="QueryCoverage=19%, HitCoverage=10%, E-value=6e-11, Identity=80%"; Hit description =Chromosome chr14 scaffold_63, whole genome shotgun sequence
MVGAGLKKDLRVSRVVPGGSLNAFLFLLIGVISQRLAMESIDSLPIGWTVGAMIYFTGEVSGSSPGWPSCVKEKIETDLTLHACSLGSGGYSSVGRAPLLQLGRCDYGNGKEDRNMPLKDSTETKTGCQERRGGRMGSWSDLGFLIWDPGEEDQAGPCEQLDALSPFNPLSEMWQKEKESMDRPHRLHPVGTTRSPQGRLRHPGVADRP

SEQ ID NO: 179840 - protein, 199 aa, Glycine max
  Coding DNA Sequence Number=SeqID_88155
  Homolog annotation: Hit_ID=Q6WAY6; Match level="QueryCoverage=98%, HitCoverage=35%, E-value=2e-08, Identity=25%"; Hit description =Putative uncharacterized protein
MGMRGCISYNPVLAIRQLGYPMRRAPLEEELAPVISRGFSETNMEMLRKVHKAWEVVQKKDKELRGSNNGPIGDYHKWLKAHVQGLDWLPSLRTAKREEVEAPEEDEEVQALRTELEQAQTVKERFKSAALKIQKENAELRDINTTTARALEQETKRDRKEEHVRDKLCGALWGSNSELKLRREERDQSRVDSSIRKMS

SEQ ID NO: 179841 - protein, 146 aa, Glycine max
  Coding DNA Sequence Number=SeqID_88156
  Subcellular localization annotation: CTP_CleavageSite=60; ConfidenceScore=5.52e-01
MDHSSSLQVVLRIPSPCPLGNSDQNVRVVPSSPPNSPKVVPPPLITYQHRTRQVGSIMPEASSRDPHPSSTNPQPIDPSSPSTSSHHSDSDWSIVIKKDTCSTRNPYLIYNFLSYHHLSPSYVSFVFSLSSLTIPSNVHEALDHLG

SEQ ID NO: 179842 - protein, 187 aa, Glycine max
  Coding DNA Sequence Number=SeqID_88157
MAPTRHPLDPDKSNRALGFPALITGLCQSFGVPVAPTKVIRPPITRAFIEKYGIQRQAQGDAPQAAGTPPPPHQAGPARSFDMEQYLRHLVRQQAANHRAHVQTHDCLYQLSLSMQSQGFASFSCPTPDQFKAEVTWPGDWPEAQAGEAPPEAPGDGEEAHEDEEMADLLDFLGREWSYVTGRSPDH

SEQ ID NO: 179843 - protein, 299 aa, Glycine max
  Coding DNA Sequence Number=SeqID_88158
TTRPRLQRTTGPRLRGLHILIFRGLNALSFRGLHVLTFRGLHALAFKGSSALKCLTETCAPGYGASSFLLSVPGPPLDIGGRPTVRAQPERKAITQLLCIPRQDFTCAAAKRQVRIMRTNMTTLTQIWMTLLLSNIPPGDRNADLPLGSAHKTPGGAQQGPGVSSSGYRPLSVLQGARPPQQGIAPTKTPSGPRDVQQGPGVSISGIVPARHPVDPKKANRVLELPTLITGLCQFYGVPVAPSKVIRAKHHSSLGMAGSRRTTISSRVHLSSSTKRSVTDKVIRRPAQDVKEALLGGNL

SEQ ID NO: 179844 - protein, 54 aa, Glycine max
  Coding DNA Sequence Number=SeqID_88159
MVNESKRRECYWGIRVRKAVLGGVDGDPVPRGTRIRATVVPGDMLWGSGDLGDV

SEQ ID NO: 179845 - protein, 98 aa, Glycine max
  Coding DNA Sequence Number=SeqID_88160
  Subcellular localization annotation: CTP_CleavageSite=49; ConfidenceScore=5.01e-01
MSRGSGDLGDARWGAISQNQAWSIPTQPGHSQSVRTCDVPKEASFLAVNQLKEQSPRSKEACVATGQLCILVVLKITLGNRLSFMGNRLQGLKMETGC

SEQ ID NO: 179846 - protein, 142 aa, Glycine max
  Coding DNA Sequence Number=SeqID_88161
  Gene Ontology: Mol. function=structural constituent of ribosome; Cellular component=ribonucleoprotein complex; Biological process =translation
  Homolog annotation: Hit_ID=P56791; Match level="QueryCoverage=82%, HitCoverage=42%, E-value=1e-43, Identity=78%"; Hit description =Chloroplast 50S ribosomal protein L2
  Pfam annotation: Domain name=Ribosomal_L2_C; Domain location=34-140; Score=178.6; E_value=1.6e-50; Accession=PF03947.9; Description =Ribosomal Proteins L2, C-terminal domain
MSDSADLDSYIPTRAVLHFWEEVLIDQKEESTSTDMPLGTAIHNIEITLGKGGQLARAAGAVAKLIAKEGKSATLKLPSGEVRLISKNCSATVGQVGNVGVNQKNLGRAGSKCWLGKRPVVRGVVMNPVDHPHGVVKGGPNW

SEQ ID NO: 179847 - protein, 121 aa, Glycine max
  Coding DNA Sequence Number=SeqID_88162
MGIAPTKTPNGPEEVQQGPGISSSGYGPLSVLQGARTPPARSCHPDIGIAPAGHPVDPKKSDRVLGFPALITGLCQFYGVPVAPTRSLGPVPIELSSRSTVPPGRRRAKHHSSIGMTGSGQ

SEQ ID NO: 179848 - protein, 344 aa, Glycine max
  Coding DNA Sequence Number=SeqID_88163
MEVLRADHALFDQVPAFGQRRGQVGHVPVADIRGPDGVDLHAQRVDLVVEGRRHGAVVGFRAEVEAVDPALADVLDRFDAGGGEVVQLVRVRVAAVRQGRDAQAVAQQLLRVDVAAADEVGAVALEQLVQQRHVGVGRVVVLHRGAVALFPAVHQVRVDVRAPVGAAFQQRHAQVREAPRDAAEEQRLGEGLRAIGEVADVVEHVVADGMAPGPALAAVVRGDRHAQLDHLGPERVVVVLAVDAVEVDVAGVPGDLGMVGGGILARDRLDRPLDAAGDVDDLQSQRLDRELQFLDAFLRRVQRNAGHRGQAVAVLAVLVRMEVVDGAVQRLAELIAGAQRRQHV

SEQ ID NO: 179849 - protein, 81 aa, Glycine max
  Coding DNA Sequence Number=SeqID_88164
KRLQCERYFSQLKDVIKIPNGENARNWAANLLLDFHDDPTVNESEIVVFLRQVRWLARKREGFERREKKRNCEAEEVEESA

SEQ ID NO: 179850 - protein, 93 aa, Glycine max
  Coding DNA Sequence Number=SeqID_88165
  Homolog annotation: Hit_ID=A5AU60; Match level="QueryCoverage=95%, HitCoverage=10%, E-value=1e-10, Identity=33%"; Hit description =Putative uncharacterized protein
MFTCAWILRFIGGVLFVDKSSSKISLRWLRRENQHIGNDDLIIFRHKLDIMKRHEFLWEPYTTTVMSALPPICLVGSVAWCAVVPLICFHVVE

SEQ ID NO: 179851 - protein, 128 aa, Glycine max
  Coding DNA Sequence Number=SeqID_88166
STLEHPLYDDAPQAAGAPPPPHQAGQAGAFDMEQYLRHLVRQQAANHRAHVQTHDCLYQMSLSMQSQGFASFSCPTPNQFRAEVAWPGDWPEAQAGEAPPEAPGGGEEAHEDEEMADLLDFLGGSGDT

SEQ ID NO: 179852 - protein, 259 aa, Glycine max
  Coding DNA Sequence Number=SeqID_88167
  Gene Ontology: Mol. function=phosphoprotein phosphatase activity; Biological process=intracellular signaling cascade
  Homolog annotation: Hit_ID=A5BXI2; Match level="QueryCoverage=46%, HitCoverage=8%, E-value=3e-18, Identity=41%"; Hit description =Putative uncharacterized protein
MIVRAKVPLICFAIVEWHPIDRVMRQFGLRQIIPDDPPNLDQIHNIDMRGRTYIFWPHHHRQWILKWNHWNNYIVHGEMDQGLLHENSEYMQWYIRRTRRYISREGAVSTEVYYPGHHQHQSYAEPNVPPVHVPKFMSQHHPSQAQYQSTSFSGHTSQGCQQSFQPLGFSSYIPQYSFQVPSTSNVFYGSSQMFATTFNTPSSAYNLAPSSSCYRPSLPTQIRDMSHEDEDEDEDNNNNNDDDDDVDDDDNSGHHVPQL

SEQ ID NO: 179853 - protein, 199 aa, Glycine max
  Coding DNA Sequence Number=SeqID_88168
MPLQKDECGPCAANMTTLTWMTLLLSTILPSDHNANLPLQMYQLGLRPQDTQLAPKKSNRAPGVSSSGYGPSISSTGCPVPPSENRTHKRHPADPEKSSRALGFPALGSRLQDTQWTRRSPTGSWSCQALITGLCQFYRVPVTSSKGIRPPTNRAFIKKYYVSRQAQGETPQQPGDGQQRATDAPPSPLEFTSAHPQKG

SEQ ID NO: 179854 - protein, 123 aa, Glycine max
  Coding DNA Sequence Number=SeqID_88169
MHSALHAGETCMGATRGGHFAIAKLATKAKLGAAGLGVRAHVVGMQCSCRVAGCSRFRKEGWRNRPCGPFPLAKQPMLCWILLFNACRWWCCVLKIFSIACFVKGDSEILEAAGTHTHSSGGG

SEQ ID NO: 179855 - protein, 77 aa, Glycine max
  Coding DNA Sequence Number=SeqID_88170
MHARISPCMLAIYAWDRTRGCSASATGEIVGIVVFATLTGDLGAEGTYMMNSVITVLYFNGRENMLLCKFVMTKGIL

SEQ ID NO: 179856 - protein, 51 aa, Glycine max
  Coding DNA Sequence Number=SeqID_88171
MTIDSPPLPMFPWTRWSRQLSQPTLQQEGDARLTGASSKEGKHTELPPTFN

SEQ ID NO: 179857 - protein, 107 aa, Glycine max
  Coding DNA Sequence Number=SeqID_88172
  Homolog annotation: Hit_ID=A5BSR3; Match level="QueryCoverage=75%, HitCoverage=25%, E-value=2e-09, Identity=44%"; Hit description =Putative uncharacterized protein
HKLLAEKTKKKLEEAAQSGSIDGVIDPPSPVRRHAKWKMARTKETGEMTTEAAKKIVEKIDSFEEQATQGSFVPCGCQDVLIAAIGRPKHPGRVRVAGAGVTIKQYF

SEQ ID NO: 179858 - protein, 206 aa, Glycine max
  Coding DNA Sequence Number=SeqID_88173
PVVSSAKPPQKPDPEVDDPLYLRTWTIPEFFLRPYQVIWDATVFGVFNPDFPFYIKHEDLSEIAHGGQCLSISVLQLHLTETSMRAGNSDMYGFLEPQSIQRLGNHSLRLKRTLADGGHRAQGTPSCLCFKSLDDAPQPKSKAHARWIIAKCNRQKRSTEYGYYVMHWMSTIILESFRNNWEAFFKTDVNNNTFNIDFKTDVECHK

SEQ ID NO: 179859 - protein, 189 aa, Glycine max
  Coding DNA Sequence Number=SeqID_88174
MYIASMHGKIRPHRTRGCSANVTGKIVGTVFATLTGDFGAEGASKVYDKFSYNNLVFQWKGKYVALQICDDEDVETMIESFQQQDQMSILELYIEKDVVGGYMFHCVNSLTSCENNLSNNEAEPPRIISNLHGDEDDDYLVSNSYVEESLDEDDGVDGISNIDDEVTNMIQPVRIVHPTEGVEGIQNPF

SEQ ID NO: 179860 - protein, 178 aa, Glycine max
  Coding DNA Sequence Number=SeqID_88175
MNLGIPRLCGSACHRTLGSRGNTGSNKDRRKSLKVYQSHTMRGEKVASAQDFDGNQSDRTTLGCGFLFLVYLVTILYCSDIVWSKDLSGCFFCFLPILDREFSFLFLLSPTFDWEFFFLFVVFRGQGLTFSPWVKVYDKLGFWLKACRTAGHDICQGLASGSGIKGTSYIISMIHMQQ

SEQ ID NO: 179861 - protein, 194 aa, Glycine max
  Coding DNA Sequence Number=SeqID_88176
  Gene Ontology: Mol. function=structural constituent of ribosome; Cellular component=ribonucleoprotein complex; Biological process =translation
  Homolog annotation: Hit_ID=Q2PMT2; Match level="QueryCoverage=100%, HitCoverage=100%, E-value=4e-89, Identity=73%"; Hit description =Chloroplast 30S ribosomal protein S2
  Pfam annotation: Domain name=Ribosomal_S2; Domain location=2-187; Score=298.8; E_value=1.1e-86; Accession=PF00318.11; Description =Ribosomal protein S2
MTKRYWNIILEEMMEAGVILATASEGKQFLIVGTKKKAADSVARAAIRARCHYVNKKWLGGMLTNWYTTETRLQKFRDLRMQQKTGRLNSFPKRDAAILKRHLAHLETYLGGIKYMTGLPDIVIIVDQQEEYTALRECITLEIPTICLIDTNCDPDLADISIPANDDAIASIRLILNKLVFAICEGRSSYIRNS

SEQ ID NO: 179862 - protein, 165 aa, Glycine max
  Coding DNA Sequence Number=SeqID_88177
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=9e-13, Identity=30%"; Hit description= UPI00006A17C9 related cluster
  Subcellular localization annotation: CTP_CleavageSite=68; ConfidenceScore=5.49e-01
MLVRMIRTRLFAAARVKSCPGMHSSCVTASLSGCARTVGPPPISGGGLGTVRACSPLMARTCSPLKVRACSPLKPYEGEDSSPLMARAYSPLKVRACGPLKVSACSPMKVRTCSPLIARACSPLMLRTCSPLMARACSPLKVRTCGPLKVRACSPFKARTCSPLK

SEQ ID NO: 179863 - protein, 50 aa, Glycine max
  Coding DNA Sequence Number=SeqID_88178
MLAIISKYQAELNLAMAHEHKVVDEYAQVSQELPRLLAKAKAMADTYSTA

SEQ ID NO: 179864 - protein, 86 aa, Glycine max
  Coding DNA Sequence Number=SeqID_88179
MDVKYLKDVKRRLHAIKRWSPDEIRARMTIRYLCMSSGLPPLDDKRCKMTIICLCVPSDSIVFGWQKGVRNGHNLSPHVIGLAAFG

SEQ ID NO: 179865 - protein, 206 aa, Glycine max
  Coding DNA Sequence Number=SeqID_88180
EIAKEKFKLAATHIRKECAGLREENATTARALEQETKRARKEEYGRNKFRGALWGSNSELKLRREERDQPRAHSMVLKEELVACSRSKRSLSQRLCETETNMLAIIAKYQEELRLATAHEHRVADEYAQVYTEKEARGRVIDSLHQEATMWMDRFALTLNGSQELPRLLAKAKAMADTYSAPEEIHGLIGYCQHMIDLMAHIIRNR

SEQ ID NO: 179866 - protein, 136 aa, Glycine max
  Coding DNA Sequence Number=SeqID_88181
MVGKDLGSVGGPHYVQIQNKHACPSYDLPPNYTPPNVAYTPVEDTHEIPYHNLADFEPCLGYASEGQAVGGIPLQNTLEGPPFRPQPQPLHSTAGKIPHIMEGMGKVPDFDSYKGTTCSKNHLKMYCRKMGAYAKD

SEQ ID NO: 179867 - protein, 82 aa, Glycine max
  Coding DNA Sequence Number=SeqID_88182
MDEYNGHGICLSERLLSFTAVATYPSAGGRRVTRGMRIPRKEYARSRHQRLFEENVGKTGKDAIYELFSERFGSCIYARGRY

SEQ ID NO: 179868 - protein, 239 aa, Glycine max
  Coding DNA Sequence Number=SeqID_88183
  Homolog annotation: Hit_ID=A1FXU9; Match level="QueryCoverage=21%, HitCoverage=23%, E-value=1e-21, Identity=90%"; Hit description =Dienelactone hydrolase
MARSARWATAGAARCRCCRPCAWACPRPATTVRAKVQFLDETPKAPVIFHFGAQDRSIPPETVQAHREKLPQMATFVYPADHAFNRERAGGGRTVVASAADERRTIPLAGAGTAPCRGDRVDRAGRRAAGQAAHRAQPRLQGPEGLPTGWRRSISRPRAPLRAGCTGPTCRLLEGTARISSPVLSVCRPDAIQPRCRRPADPDRPVHARQQPGLDAPEPVQAAADLVAGGIGGCRHRDA

SEQ ID NO: 179869 - protein, 29 aa, Glycine max
  Coding DNA Sequence Number=SeqID_88184
MEEKNSARASTNSKHQQQARRTLKNGEKK

SEQ ID NO: 179870 - protein, 165 aa, Glycine max
  Coding DNA Sequence Number=SeqID_88185
MASRKHKSIGSRPTTQYDTRRFHSLDAWNWYTDNVLGRNILPVELYHIEFDDFKTELERRNLHKCLTNLVDGSIDVALVKEYYANLYNSESPSPKQARVRGHLVKIDTNSLNTFLETHVVLARGETLPTYSRYYRLPSDPREIEATLCIPGRGFILNAEGHSGRT

SEQ ID NO: 179871 - protein, 84 aa, Glycine max
  Coding DNA Sequence Number=SeqID_88186
MVIIVNAEGILRFTIHVHTLLQFVVMSNHLSTDKNVVDVEPKGIIGITVQCNQSVGVVQIVDLFKGIQIDTNGELSTMMNYGLS

SEQ ID NO: 179872 - protein, 120 aa, Glycine max
  Coding DNA Sequence Number=SeqID_88187
MTSSKRFVEAEDEDSVVSKKKAAEKKGTDEKKNDMREKEKEVEKEKEKEKGKNEKDEKNKNEERSRSEQAREKKREKVVNEGAEVPYPVVPSKKEKDRHLARFLDIFRKLEITMPFGEAL

SEQ ID NO: 179873 - protein, 152 aa, Glycine max
  Coding DNA Sequence Number=SeqID_88188
  Homolog annotation: Hit_ID=Q6WAY4; Match level="QueryCoverage=94%, HitCoverage=26%, E-value=3e-13, Identity=33%"; Hit description =Putative uncharacterized protein
MGSSQVPSLKNRFYQVKVRSLGVTSLKELGQLMGQLQRQAFRKAYGKIWDLAMAEVSTEAIASLAQYYDQLLRCFTFGDFQLSPTVEEFEEILGCPLGERKPYLFSGFYPSLARISKIVQISMQELDHRKQVENGVVGVPRKCLEAKARVLA

SEQ ID NO: 179874 - protein, 111 aa, Glycine max
  Coding DNA Sequence Number=SeqID_88189
  Gene Ontology: Mol. function=catalytic activity; Biological process =cellular metabolic process
  Homolog annotation: Hit_ID=A7Q5D6; Match level="QueryCoverage=81%, HitCoverage=57%, E-value=5e-25, Identity=64%"; Hit description =Chromosome undetermined scaffold_53, whole genome shotgun sequence
  Pfam annotation: Domain name=RNA_pol_III_C17; Domain location=5-107; Score=44.7; E_value=3.3e-10; Accession=PF09417.1; Description=RNA polymerase III subunit C17
LCHSLEGNAGALTNFEVLHFLRAKGASKDPTRVNAKVAQFEYKVYDYLVDTAASIQTRESINELLTSVKQHDLAKTEVLNILNIGLAADFELYPLEVFSSQDIIKSTYVEA

SEQ ID NO: 179875 - protein, 144 aa, Glycine max
  Coding DNA Sequence Number=SeqID_88190
  Homolog annotation: Hit_ID=A5AK77; Match level="QueryCoverage=43%, HitCoverage=7%, E-value=6e-07, Identity=41%"; Hit description =Putative uncharacterized protein
MTRGNPDDLQPFDLEIDRTFHILVRHSMHPSHFVHFEHSEYFVAGDSEYFDFEHSTTNFHTENMAQPPPRERTLREMAAPDFTYENVCIQYPDEGVAYVLKTGLIHLLPKFHGLAGEDPHKHLKEFHIVCSTMKPPNVQEIISF

SEQ ID NO: 179876 - protein, 160 aa, Glycine max
  Coding DNA Sequence Number=SeqID_88191
VTLKVVAVRLFPAADHPNAAVVFRPAPVWGAVLLDESSINRGPDALAGGDRHSLELTETRPTEARNQSWKPQGPVGLLQVHWVSWGRLALRSLGRMLLSGNVIYICVRVIMFVRMIRTRLFAVARVKSCPGMHSSCVIASLSGCARTVGRPPISGGGPGT

SEQ ID NO: 179877 - protein, 240 aa, Glycine max
  Coding DNA Sequence Number=SeqID_88192
  Gene Ontology: Mol. function=motor activity; Cellular component=cell projection
  Homolog annotation: Hit_ID=UPI00006A2D9E; Match level="QueryCoverage =75%, HitCoverage=86%, E-value=1e-14, Identity=18%"; Hit description =UPI00006A2D9E related cluster
GGPLGTSTLTFRGLHVLTFRGLHALTFRGLHALALRGLHILAIRGLHALTFRGLHALTFIGLHALTFRGLHILSIKGQHVLSFRGLHALAFRGLHAFRGLHALRGLHVLAIRGLHALNFRRLHILAFRGLHILAIRGLHGYMHALRGLWVLIFRGLHALVFRGLHILTFRELHVLTFRGLHALALSEDSVCHQRTPVLAIRGLHAIAFRGLRVLTFRGLTCPHLQRATRPHLQRTTRPHL

SEQ ID NO: 179878 - protein, 74 aa, Glycine max
  Coding DNA Sequence Number=SeqID_88193
AGLREEERSSIARFLSGLNMEVRDKVELLPYGDLDELVNRCDENPKTGQIQAKGPSGEGRRSKWRRTKPPSGEG

SEQ ID NO: 179879 - protein, 250 aa, Glycine max
  Coding DNA Sequence Number=SeqID_88194
MSRGARRCKTQGASPGGAVVGADLGGSSKYSNENFEGRRGESLPTLETAQPEVGSSGLEEHRTSRPGVAVAPFGPLETRTRSLTCVESTGDRVRAYLSGPKEEYALSGGPVPNPRNSGLLELPAAILSGQIVRLIGSRGRKISGTGRLVLGPLPRASEQFNSGSWTDGESDVLSGRCGCSVEPRHGIESSKWAIFGKQNWRCGMNRKLGYGAQLRANLDPTKGVGRLRQQDGGHGSRNPLRVCTLTCRIN

SEQ ID NO: 179880 - protein, 144 aa, Glycine max
  Coding DNA Sequence Number=SeqID_88195
NVYTDNHSGISARQRDSNVSMTDLVSTEDDLNLRVSMGLSAAIDEGMTDLVSAEDDVNLRVSTGLSAVIDEGYFRPSHDSSVSMTDLVSTEDDVNLRMSTGLLGRLTKGTEDNRDSNVSMKGLVSAEDDVNLRVSMGLSTAIDE

SEQ ID NO: 179881 - protein, 189 aa, Glycine max
  Coding DNA Sequence Number=SeqID_88196
MGAITAGYGRRNCDEHHSKRCYKTAVTGNVMQRGEKQTAAIPDRLKEGLAARHQVVAVFKQFRIRAQAELFQRRLLLSAHGFAAAFKLHGNLRHAKSIQKTAHHFYFARTEGFDLLIHIAFAGEIERFSTSYATSCDRNSRPCATWRIAWTISCILWLFPIKPLTPALSTILTIAGLSMDDEINIFCCG

SEQ ID NO: 179882 - protein, 73 aa, Glycine max
  Coding DNA Sequence Number=SeqID_88197
MTWCRGLIVLLKKWRASDDGEPKRLKATVCFKDWVGLNWYMAQAIRSVQATIGVTKTFLSSKPPSTISPSRAT

SEQ ID NO: 179883 - protein, 48 aa, Glycine max
  Coding DNA Sequence Number=SeqID_88198
MKLVWVRLQRSKVEGLGRFGLAPIVSVEAQLQTQHQQVNPKFPLSDLP

SEQ ID NO: 179884 - protein, 199 aa, Glycine max
  Coding DNA Sequence Number=SeqID_88199
MNELSEEENKKKLVEDAKLAALVGKVSREIQDDVILESLKTLSIEEEQRKSVEKATMMEIDGEPLPKGSIVQSIHAQSEQERKKAQMEDLRKFMEKVQSAVEHATHILFLDATHRQVELEATTTLADMGPIKKEALKVAMLQPAIEEVLVEAEDDVIETNLRIDEDILKRLEEIYGALKFVSIEVMMEHLDVRKIMVTS

SEQ ID NO: 179885 - protein, 26 aa, Glycine max
  Coding DNA Sequence Number=SeqID_88200
MAGTPQNALLHKNQNLPMMVNDPLIA

SEQ ID NO: 179886 - protein, 78 aa, Glycine max
  Coding DNA Sequence Number=SeqID_88201
MDRAHKTPSGPGEIQQGLRVSSFGYGPLSVLQGARSPQQGIAPAGHPVDPKKSNRVLGLPTLITGLCQFYGVVRHPSK

SEQ ID NO: 179887 - protein, 342 aa, Glycine max
  Coding DNA Sequence Number=SeqID_88202
MGIMVSVSYALRLVESCAYGPEDDSIGCLCLAIGLRMLDRCDKWSKYVHSPYGKGPMGAQTMEIVKRGGKNDCKLLTLPAFLCEVRLSDFLDASRTVHLQNSSAFVEVHVVFVELFEDLFQICHVLGYALRLDDHDINDMSMLMVGEVPVELCSLPRFSVIAWIYIEFNVKAVLVDNQGSDWRPFVNTHDLSNAIRCGVRFGRLPSGRIRCHLQSFCVALSCLLLIYLNNHDLSHQAPEELALNEGGHKVDVASGLYSFPCEGEEWADVRLDDVGGSILVDEDLGHHEVGDYDGDNHAVILVDRVDTLEVSISEIDVDVLDGVEVALVRLARLSSIGESACN

SEQ ID NO: 179888 - protein, 221 aa, Glycine max
  Coding DNA Sequence Number=SeqID_88203
MEGWHYISPLSSEPAYEQRRLSNVGGSNLDKLEGKESVKPPRIDKVDMLLVLQARSDMLGEGDLCIWKLCPFLIVGECIEADVMSCSLRHACVAHAQYSCIHVTNGVSTYKRLNASVSEVVSCGSSTEYTRHGASDSESSSLDKLRVSCRNGGGTSCLCKRVRPFITSLSREPILVTMILPPSISGEQEETVGTLGRLPTCDIAIVLGRHRPHLSLLAMSG

SEQ ID NO: 179889 - protein, 97 aa, Glycine max
  Coding DNA Sequence Number=SeqID_88204
  Homolog annotation: Hit_ID=Q84VH5; Match level="QueryCoverage=54%, HitCoverage=7%, E-value=2e-20, Identity=98%"; Hit description =Envelope-like protein
KAAASGAVSKDALIAELKDTCKVLEATIKATTEKKMELERLIKRLSESGIDDGEAAEQEDEAAEEEVEAAEEEEEVAEEEEDAAEDTESDDDSEATP

SEQ ID NO: 179890 - protein, 205 aa, Glycine max
  Coding DNA Sequence Number=SeqID_88205
  Gene Ontology: Mol. function=peptidase activity
  Homolog annotation: Hit_ID=A2Q3H3; Match level="QueryCoverage=46%, HitCoverage=29%, E-value=2e-37, Identity=81%"; Hit description =Peptidase, cysteine peptidase active site
MGLSLLLMERAAALAEGLPAPTLCSSGDVRDLNIEYFKYAHQHRITEGQNKVVITYRMWARLMSSTNQPSFTIAKTISEEKREEEANGHVPKAWSWSKAFIKEFDPSLYTLNKFSCIALAGVSTEYLIYGFSEGGLDDIRKGLGFTQKKADSHVRWPLLNTVLVLWRHEAARGKVAEALSMGKSIGSCIDIIENSINVSDLLLKL

SEQ ID NO: 179891 - protein, 181 aa, Glycine max
  Coding DNA Sequence Number=SeqID_88206
MVIDAKVWKKVVDLDMGGVHKFKETVDGYNKMPTYRGMLINPVRNLKNRLGVGGWTAKDRMLVYLITYIFTLRSSIKMNWLLLIEDDMLKSRQLMDYEFLYVVLVSRFIDYFNVNVSNEIVDFTKASSEITERYLKKLGMRFVNHEWIMTRGPMAGNLEQMDEDAKVEAPQEPAHQWSPFE

SEQ ID NO: 179892 - protein, 294 aa, Glycine max
  Coding DNA Sequence Number=SeqID_88207
  Pfam annotation: Domain name=Retrotrans_gag; Domain location=30-104; Score=2.8; E_value=0.029; Accession=PF03732.8; Description =Retrotransposon gag protein
MEEAQIWDKKVELPAFMGTDPIGWIAGAEKLFEGVATHWFYIWSQNNPDSHWESFSTALIKRFEDHHGNHIFERLSILKQENSTKTKTHIKKWETSTKFLKGRTDISEWKHMLCKILNEEVDSHASQQDKNSMEGNGTKFSEAKASSWARKEEVDPPIKREKHKENKVTNVDCEDDFLDNPITNLIKKELEAGDSTKPHCFQHSDFHTKIVMVKQKSFMKVVGTTMVLKPWSVNLLGEPLALNFVASMVESLAMELRQKECTEPVKLIKVIWSPPLSLPPSKPSDLNLHASDLS

SEQ ID NO: 179893 - protein, 148 aa, Glycine max
  Coding DNA Sequence Number=SeqID_88208
SFGVPVAPTKLIRPPITRAFIEKYCTQRQAQGDAPQAAGAPPPPHQAGSFDMEQYLRHLVRQQAANHRAHVQTHDCLYQMSLSMQSQGFASFSCPTPDQFRAEVAWPGDWPEAQAGEAPPEVPGDGEEVHEDEEMADLLDFLGGSGAT

SEQ ID NO: 179894 - protein, 107 aa, Glycine max
  Coding DNA Sequence Number=SeqID_88209
MLGEKDSVGDSLDITLVALFQKQARYPSGISLTPQCNPLHEPTRWDGSEAGIFHQLKVFQIVLRSRFAKGVPSLAHTLELDQRFHGKTRQDFFDEFVTEEWLPWFLL

SEQ ID NO: 179895 - protein, 93 aa, Glycine max
  Coding DNA Sequence Number=SeqID_88210
MEANAVIVAAISTVAKVNPMLPSSLKQMNHPTSNMLGKDLGRQAVGGIPLQNPLEGPQYHPQLHLLHSTTVKNPHDYGRNGKVGSSRGKAQGH

SEQ ID NO: 179896 - protein, 152 aa, Glycine max
  Coding DNA Sequence Number=SeqID_88211
  Pfam annotation: Domain name=Transposase_23; Domain location=51-121; Score=-0.3; E_value=0.0013; Accession=PF03017.5; Description =TNP1ENSPM transposase
MASFSQMQSQFQSQMQSQELALPLEPEVGPSSAHVSTKESCVDPSRNDPQMGDSEKCRLYIEENPSCLVALGRLYEVSTMVHNIPLLHGQVKVGVEEVKDAKALVPVPTNEVTLVGQALNTFLAWLTHLVKRLSEQLCLQHPPEAQLEIGGL

SEQ ID NO: 179897 - protein, 18 aa, Glycine max
  Coding DNA Sequence Number=SeqID_88212
ELQSDCEMLRRGGGIPLL

SEQ ID NO: 179898 - protein, 272 aa, Glycine max
  Coding DNA Sequence Number=SeqID_88213
  Gene Ontology: Mol. function=oxidoreductase activity; Cellular component=chloroplast; Biological process=metabolic process
  Homolog annotation: Hit_ID=A8GDH6; Match level="QueryCoverage=92%, HitCoverage=100%, E-value=1e-131, Identity=93%"; Hit description =Short-chain dehydrogenase/reductase SDR
  Pfam annotation: Domain name=KR; Domain location=28-192; Score=-69.8; E_value=0.0027; Accession=PF08659.1; Description=KR domain
  Pfam annotation: Domain name=adh_short; Domain location=27-191; Score= 81.3; E_value=3.1e-21; Accession=PF00106.16; Description=short chain dehydrogenase
  Pfam module annotation: Pfam domain module=KR::adh_short; Domain location=28-192::27-191
PTGLFGASGDQRAERRSAGGLMRFDNKVVVITGAGNGMGEAAARRFSAEGAIVVLADWAKEAVDKVAASLPKGRAMAVHIDVSDHVAVEKMMNEVAEKLGRIDVLLNNAGVHVAGSVLETSVDDWRRIAGVDIDGVVFCSKFALPHLLKTKGCIVNTASVSGLGGDWGAAYYCAAKGAVVNLTRAMALDHGGDGVRINSVCPSLVKTNMTNGWPQEIRDKFNERIALGRAAEPEEVATVMAFLASDDASFINGANIPVDGGGDRLGRPPKIV

SEQ ID NO: 179899 - protein, 122 aa, Glycine max
  Coding DNA Sequence Number=SeqID_88214
  Homolog annotation: Hit_ID=Q6WAY6; Match level="QueryCoverage=57%, HitCoverage=12%, E-value=2e-08, Identity=38%"; Hit description =Putative uncharacterized protein
RCKKSSARIVCCTLSLDVWLVSHSFRHESSLVCHLQGHHMCAEKGKANWEKLLAGMVGASVNWFPRWKEGRARVLSSCEGFPNIPLMGMRDCISYNHVLATRQLGYPMRGAPLKESIAPFNA

SEQ ID NO: 179900 - protein, 48 aa, Glycine max
  Coding DNA Sequence Number=SeqID_88215
MLATHSGYQSMAKKLALNCFFTSSFIFRDISGFILLNFCFTGEHSGFR

SEQ ID NO: 179901 - protein, 67 aa, Glycine max
  Coding DNA Sequence Number=SeqID_88216
MKTVMLVNSIVTLVTWLRSLPRNRAGQSSLHPYGIHLPHQGILQAPPLPRPRASLQAMRPQPQTASE

SEQ ID NO: 179902 - protein, 90 aa, Glycine max
  Coding DNA Sequence Number=SeqID_88217
MSSPSEGHTPSPLDIYMSSPLDDYTSSPSEDYTSSPLEDFTSSPSEDYTSSTSEGYTSSTSEDYRSSPSEDYTYSLSEGHTSTPLEDYTS

SEQ ID NO: 179903 - protein, 63 aa, Glycine max
  Coding DNA Sequence Number=SeqID_88218
MEPNLRWEALNGNFSNMLLGITFRLKPLSMSTLVITCSMHLTDTCKALLCPLPSAGISSSVKI

SEQ ID NO: 179904 - protein, 154 aa, Glycine max
  Coding DNA Sequence Number=SeqID_88219
PKEILPRVQDCGRESCSSFHQFPDESLSEALPPFRGEKIKLKTSEELAELIENMSANDHAILRDRTHQPAKKSFCTICGEAHETGQCIPMEENTREIHYMGNQQRQGYTQGGFSGFQQGLYNQQGQWRTHPGNQFNKDQSGPSNRPIQQGPNIF

SEQ ID NO: 179905 - protein, 78 aa, Glycine max
  Coding DNA Sequence Number=SeqID_88220
MRACSPLKARTYSPLEVRACSPLMVRTCSPLKARTYSPLETRIDCPFERGDNSCNLILSFANLSGNPLKVYVLFDLVT

SEQ ID NO: 179906 - protein, 84 aa, Glycine max
  Coding DNA Sequence Number=SeqID_88221
MTPSGPGGVQQGPRVSSSGYGPLSVLQGTCPPQQGHAIVTYDRARKTPSGPGKLQQGHGVSNSDCGLIEAVPESNKHENAVTRK

SEQ ID NO: 179907 - protein, 87 aa, Glycine max
  Coding DNA Sequence Number=SeqID_88222
GDGEGVDLGIGDGPRASTEDGDGVNAGTVDGPASVGGGDGVAATSRGLTGIDIEDGDGVVDGRLSRGGNNLTTYRFFFSILPFPLES

SEQ ID NO: 179908 - protein, 146 aa, Glycine max
  Coding DNA Sequence Number=SeqID_88223
  Homolog annotation: Hit_ID=A5AJT7; Match level="QueryCoverage=85%, HitCoverage=12%, E-value=2e-16, Identity=37%"; Hit description =Putative uncharacterized protein
MFLLLESGHTQDTCYPIHGFLEKSVNISKFETSEIKFLKTDYQEYLQLKAAKESQTSSAISGHNSTVCISQSDAFDHIAGNSSLFSPLSPPKIPYFITLADGSRVVATGIGHECGTGWTIGVGIESHGLYYLKPNLSWGFLNERTI

SEQ ID NO: 179909 - protein, 228 aa, Glycine max
  Coding DNA Sequence Number=SeqID_88224
  Homolog annotation: Hit_ID=UPI00016621D1; Match level="QueryCoverage =67%, HitCoverage=42%, E-value=4e-09, Identity=30%"; Hit description =UPI00016621D1 related cluster
GVSSLSLSFSIPLPFIFQEAKESIDEEDPRPTSSNGACINMSLPSEDNTSSPSEDYMSSSLEGYMPLPSEYYTGLHALAFRGLHVLAFEEDYMSTPSEGYMSFRGLHVLALRGLHPLAFRGLHALAFRGLLVLTFRGLPVLTFRGLHAFSFRGLHVLAFKGLHVLAFKGLHVFAFKRLHALAFKGGLDALAFRGLNTLAFRGLHVLAFTGLHVLTFRGLHICAFRGLK

SEQ ID NO: 179910 - protein, 69 aa, Glycine max
  Coding DNA Sequence Number=SeqID_88225
MHICKAFSYLFNIHMYMVNGIFTLSRHKENMVQPKPSVGLKEKPHQHALTHHAFLYFNKQKLGPPRPRS

SEQ ID NO: 179911 - protein, 124 aa, Glycine max
  Coding DNA Sequence Number=SeqID_88226
MPPTRHPLDPDKSNRALGFLALITGLCQSFGVPVAPSKQTANHRVHVQTHDSLYQLSLSLQSQGFASFPCPTPDQFRAEVAWPGDWLEAQAGEASAEAPDEADEAHEDEEMTDLLDFLGGSGAT

SEQ ID NO: 179912 - protein, 99 aa, Glycine max
  Coding DNA Sequence Number=SeqID_88227
MTNYYPPDLPSSIRVPRGSQGAVLKKVLHRIAVQSSNFLDPGIKFPPQRHYFMTREKKVGCRFNLTLAEGAEVILKDNLPPNKVFLRWKPIPEKSPSKS

SEQ ID NO: 179913 - protein, 43 aa, Glycine max
  Coding DNA Sequence Number=SeqID_88228
PLGPSRMFQQKAVPSGGSNPARLGELSSARRAGGNHLPLFPFK

SEQ ID NO: 179914 - protein, 120 aa, Glycine max
  Coding DNA Sequence Number=SeqID_88229
AVHVSSTFEFGAEFHDCLSADPQGNPSYSTFVPEPYECYCLALFMCPPLSSAKSLKKKKKEWRRESSSQKGPTWALQKIPPEAVASGGSNLARLGELGGKLLPYFAINRGKSEEEKGSAP

SEQ ID NO: 179915 - protein, 104 aa, Glycine max
  Coding DNA Sequence Number=SeqID_88230
MFNHEHAYASLLSCESKDRRRFASRVGRYHTKSKAKVSKGSKNTLDMHVCSKTPRIRMHEMAPKKLPVKRSGKGTTEEGSSAVPQGDTNFDKHRFRRWERSPGG

SEQ ID NO: 179916 - protein, 116 aa, Glycine max
  Coding DNA Sequence Number=SeqID_88231
  Subcellular localization annotation: CTP_CleavageSite=56; ConfidenceScore=5.06e-01
MDSKSTLRLMRTLGPSLGSLAQSTWSLLSNALAGRTFYFEVPLNELRNNQVKLKLKSTHKSNICPQKGHLKIVSGSNTLNDREELRRSDFLIAIEDTWEQEPRFCRPHEIVKGPTP

SEQ ID NO: 179917 - protein, 55 aa, Glycine max
  Coding DNA Sequence Number=SeqID_88232
MDEDQWMYDTIMSEEVDMDDQNEQECGVNEPQVDCSDPFNTSQVFGSQDDVLQWA

SEQ ID NO: 179918 - protein, 65 aa, Glycine max
  Coding DNA Sequence Number=SeqID_88233
MESSQVPIDSNSNSSANKIEEKAGDGNTQAILLMKLSNDMQHNIIVRSQELDRSIMKPKLLNLDP

SEQ ID NO: 179919 - protein, 80 aa, Glycine max
  Coding DNA Sequence Number=SeqID_88234
MEKAERSREETERLSERVKDEESRDREVEMSLYMCHTLISSGDDPLLGCDPRLTTSRYLEPIVRQFVKFRDMPEAKRKAS

SEQ ID NO: 179920 - protein, 254 aa, Glycine max
  Coding DNA Sequence Number=SeqID_88235
  Homolog annotation: Hit_ID=Q6WAY6; Match level="QueryCoverage=36%, HitCoverage=16%, E-value=1e-08, Identity=36%"; Hit description =Putative uncharacterized protein
ALFIDVLALLVFGVVLFPNMDGLVDLAAIDAFVTYHHSKESPLFMYDWSRTSFIMKVDPPVPCKVTAYASRKGRPIGSSSWLGFSNVPLMETKGCINYNLVLAIRQLGYPTRGAPSEESITPFIARGFSDPNARIFQGVRKAWSAVQRKDKELRGSSNGIINGYHKWLKAQTQELDWLPKLKTSSEEEAETPKESEEVQALKAGLERAQAVKEKFKMMAIKVVPQPTLPREGDARLTGASSKEGKCAELPPTFI

SEQ ID NO: 179921 - protein, 294 aa, Glycine max
  Coding DNA Sequence Number=SeqID_88236
MEEQSKMQKGSSSQSQWNYETQETPIPSSIPSASLFSSEEQWIRYTNLFSSRSIVDSFECIQAFENSNLIPFMSLKLPVYSDLVKAFYSNLEIQEGTLISKVYGIKMYVHPPHGKRLRGAQAIEVARVFGWNTYEFLASSTPLHEVEGIYLECQPIVVGGHYLGCQEASLGMKTTHSFMQISHDVVFFWCLECHLDDGLEVSSLLRAFQLGEQVFPSVAFPWYVLKLSQQFPDGVIHLDNDLVTLIVWPEVSSKGYRLPERRLSLWPPQLLKDKGARVLLALVYLGLAIWQWFS

SEQ ID NO: 179922 - protein, 144 aa, Glycine max
  Coding DNA Sequence Number=SeqID_88237
QDEATSSPSPSESEEAKGEESSKEIYPKEEGKPLMVKEECKETLVSIAIPLRLEFIPQVKELLDEGATLFCKITRAPNIFMICVHRDSLAPLIELVRNHVPSWEDAQEMGVEKKSPEFQEPRDLRSNPFQGGGNDAILPRKGIG

SEQ ID NO: 179923 - protein, 136 aa, Glycine max
  Coding DNA Sequence Number=SeqID_88238
MTTLVHTWSILSFSNLIPTSHTSDVTLDRAKLIYGVIMKMDMNLGTAQPSPSGGGGASVAQEPELEQPAAAAAEGEDELTPPKPFYFDADIHMAQEEETSTDQILKPSPAPIPNDAIPSAPASELEQPISHDSPAD

SEQ ID NO: 179924 - protein, 85 aa, Glycine max
  Coding DNA Sequence Number=SeqID_88239
ARVTGALSKGGKMRGVTTNEGISTSHVDKSGAFAPTYPPSKRKLDLRSSFLKGEELATQLAQASKVASSRSNSLLEEESGRPKWV

SEQ ID NO: 179925 - protein, 185 aa, Glycine max
  Coding DNA Sequence Number=SeqID_88240
  Homolog annotation: Hit_ID=Q5NRP4; Match level="QueryCoverage=49%, HitCoverage=5%, E-value=6e-07, Identity=29%"; Hit description =Putative gag-pol polyprotein, identical
  Pfam annotation: Domain name=zf-CCHC; Domain location=80-97; Score =22.6; E_value=0.00058; Accession=PF00098.14; Description=Zinc knuckle
MSLHSSSSVNGEGSTPKDPLYKILDELRSLKLWKEKPERKEKDQGQGILGVTPSKPKGDKGKTIENQAPKASMQEKTSSIKCFKCLGRGHITSQCPTTKTMIMRSQYIYSSQDEATTSPSSSESEEAKREESSEEIYPQEEGQPLMVMEECKEVSVSSKRLVKKESHFEIKTNIKETSPLRQGIL

SEQ ID NO: 179926 - protein, 137 aa, Glycine max
  Coding DNA Sequence Number=SeqID_88241
  Homolog annotation: Hit_ID=Q84VH5; Match level="QueryCoverage=67%, HitCoverage=13%, E-value=3e-33, Identity=81%"; Hit description =Envelope-like protein
MLSQHPNILNYTDSVKKRESALSLHYKLFEGTHVPDIVSTSGKAAASGAVSKDALIAELKDTCKVLEATIKATTEKKMELERLIKRLSDSGIDDAEEEEEAAEEEEEATEEEDEAAGEEEDATEDTESNDDDSEATP

SEQ ID NO: 179927 - protein, 38 aa, Glycine max
  Coding DNA Sequence Number=SeqID_88242
MSALYSDFPRASGSTAETAMGSLPQRGWSERSFENSRE

SEQ ID NO: 179928 - protein, 121 aa, Glycine max
  Coding DNA Sequence Number=SeqID_88243
MARTRGLGRVIGVFIGRDRRDDHDAADVPERRRPTASARRQWVYQMTADAPDMAEDVADMTEDIPDLAEEAPEMTADVQGADGAKGSDADDSEGFPGGPRDPGGAIADGSVRARQRPRTKH

SEQ ID NO: 179929 - protein, 155 aa, Glycine max
  Coding DNA Sequence Number=SeqID_88244
MHTRARFHPATIMPISPCGGITPTRHPVDPEKSNRALRFPALVTGLWIEPARHPVDPEKSNRVLGFPALITGLCQFYGVPVTPSKVIRPPTNRAFIKKCAPRQAQGETPQQSGDGRQRAIDAPPPPPEPLSSSKKVGAWPTTRGRPTGDQVQSQR

SEQ ID NO: 179930 - protein, 94 aa, Glycine max
  Coding DNA Sequence Number=SeqID_88245
MGPKSILRLMRILGPSLDCINSFEEQATQGSFVPHVRQDVLTAAIGRPEHPGRVRATEADFTIKQYFGSAPWTSRSSSSLPPEELQQLTEQIRD

SEQ ID NO: 179931 - protein, 458 aa, Glycine max
  Coding DNA Sequence Number=SeqID_88246
  Gene Ontology: Mol. function=translation elongation factor activity; Cellular component=cytoplasm; Biological process=selenocysteine incorporation
  Homolog annotation: Hit_ID=A6TFJ0; Match level="QueryCoverage=98%, HitCoverage=77%, E-value=0.0, Identity=78%"; Hit description =Selenocysteinyl-tRNA-specific translation factor
  Pfam annotation: Domain name=SelB-wing_2; Domain location=263-320; Score=83.5; E_value=6.9e-22; Accession=PF09106.2; Description =Elongation factor SelB, winged helix
  Pfam annotation: Domain name=SelB-wing_3; Domain location=397-446; Score=89.3; E_value=1.2e-23; Accession=PF09107.2; Description =Elongation factor SelB, winged helix
  Pfam module annotation: Pfam domain module=SelB-wing_2::SelB-wing_3; Domain location=263-320::397-446
FDDVAFFATAATENLGIAELRSHLLQLTERAHPQQQRFRLALDRAFTVKGAGLVVTGTALSGENQPVEQARAGQRIALNIVGDAQKEDLSRGDWLLSAQPAEPCERAIVELTCHAPLSQWQSLHIHHAASHITGRVSLLEGNLAELVLDTPLWLADNDRLVLRDISARLTLAGARVVTLNPPRRGKRKPEYLQWLYALAAARGDDAQALDIHLQRDAVRLDEFAWARQLSADGLTALINRPDYLQAGNSLLSAPLAARWQKKLLDALARYHDQHRDEPGPGRERLRRIALPMEDEALVLLLIEQMRSSGVIQSHHGWLHLPEHKAGFTDEQQAIWQRAESLFADEPWWVRDLARDLNVEESLMRAVLRQAAQQGMITAIVKDRYYRNDRIVEFAQLIRRLDLQRGSTCAADFRDTLNIGRKLAIQILEYFDRIGFTRRRGNDHLLRDALLFPENKNGE

SEQ ID NO: 179932 - protein, 107 aa, Glycine max
  Coding DNA Sequence Number=SeqID_88247
  Subcellular localization annotation: CTP_CleavageSite=89; ConfidenceScore=5.61e-01
MNLLPSAVHVSSTFESGAPRSYCVALFVNSPFSTSFSETHEFIPSVVHVSSTESGAPRSYCRSAVRQFSILHFFRSPMNLLPSPLFMSSTNRVWSPAKLLRSAICQS

SEQ ID NO: 179933 - protein, 205 aa, Glycine max
  Coding DNA Sequence Number=SeqID_88248
  Homolog annotation: Hit_ID=A5BUF0; Match level="QueryCoverage=90%, HitCoverage=50%, E-value=9e-08, Identity=24%"; Hit description =Putative uncharacterized protein
MIPFMSLKLPYYPELVRVFYSNLKIQDGTLISEVHGIPMIIDESLFFSLTQLPSQGAPFKGTLVDDRKFDYSSHDTRRMVCIDQTDMTGILLVGSLTFDCRIMHYIIVKILMPRSSNLAQASEEDLILMWAFLTGLPIDWAHLVRYRMHKALRSGAPLPYPQLVTLFLRHFEIPMDSKPFVLVKSSFSIGVGAVTSFGYRKDVDG

SEQ ID NO: 179934 - protein, 392 aa, Glycine max
  Coding DNA Sequence Number=SeqID_88249
  Homolog annotation: Hit_ID=Q6WAY4; Match level="QueryCoverage=78%, HitCoverage=63%, E-value=7e-36, Identity=31%"; Hit description =Putative uncharacterized protein
MGTNQNGKRFYQVKVKSLDVTSLKELGRLMGPLQRQAFRKVYGKILDLAAAEVFTEAVISLAQYYDQPLRCFTFGDFQMVPTIEEFEEILGCPLGGRKPYLFSGFLPSLSKIAAVVGDSAKELDRTKQTRNGVVGLPRKYLEGKARDMASQEKWGPFADILALLIFGVVLFPNVDGLVDLAAIDAFLAYHHSKESPVVAILADLFDTFDRRIGGSAINWLPRWKEGKEGVLFSCGDYPNVPLIGTRGCINYNLALAIRQLGYPMRGAPTEESLLPFLVRDLGAQGLKVIQRIHKAWRSPLRKDKELRGIRNGVIGGYHGWLRIHAQGLDWLSKLKVIDEENFEAPEEDEEVRALKLELRKAKLAKEKFKSAATHIRKECTELQRKTRPLQEP

SEQ ID NO: 179935 - protein, 29 aa, Glycine max
  Coding DNA Sequence Number=SeqID_88250
EKALRALLRRLFNYMAAFWEIDLHRKLSN

SEQ ID NO: 179936 - protein, 317 aa, Glycine max
  Coding DNA Sequence Number=SeqID_88251
  Homolog annotation: Hit_ID=Q6WAY6; Match level="QueryCoverage=33%, HitCoverage=19%, E-value=4e-12, Identity=35%"; Hit description =Putative uncharacterized protein
LLAGIGGRTISWFPRWKEGKEGVLFSCGRYPNIPLVGTRGCINYNPALAIRQLGYPMRGAPTEESMSPFLVRDFGAQNSKTIQRIHKAWETPLRKDQELRGIRNGIIGGYHEWMKVHIRGLDWLAKLKVVSEESFEAPEEDEEVQTLKSELGKAKLAKEKFKARKEEYGRNKFRGALWGSNSELKLRREERDQSRAHSMVLKEEFDCLFKTNMLAIVAKYEEELGLATAHEHRIADEYAQVYAEKEARGRVIDSLHQEATMWMDRFALTLNGSQELPRLLAKAKAMTDTYSAPEEIHGLLGYCQHMIDLMAHIIRNR

SEQ ID NO: 179937 - protein, 244 aa, Glycine max
  Coding DNA Sequence Number=SeqID_88252
MGGRGDGRGRRAGHRALVMGPDPRLGHRAARRHAAKRPAAPRHRAGAGRRRWPDRRPARMAGRARPLRGDRVAGHGASARQRFLQGQAGAYRGLVACDGGDPGRAVSAAARGLNRRRRRRAGPDRCSASRPAHPAPSRAGSGSSRAHTGIPAPGSRARPGGTARSARRPGPPGPARRQAVAFDRVGRHPYQPPGFIGNLGGDDRGSAGRHRQDPVFLGGRCTSVPSGPARWSMVRSRAPASSRT

SEQ ID NO: 179938 - protein, 267 aa, Glycine max
  Coding DNA Sequence Number=SeqID_88253
MASRKRKSIGTRPTSQYDTRRFSSLDAWTRYVDNVLGRNILPKRKVELYHTELDDFKVELETHNFHKRLTNLADGSIDLALVKEFYANLFNSKDRPPKQSRVRGHLVKIDVDSLNAFLETPVVLAEGEHRSADFWPILSLGSQSNTSRLGFPTLITALCGARGVVSDSLTFERLSPVINLAYIRKNCWNPEDLTIFIRGARRARARLTELPSTSIAPTPASTSVAPSVPAKTNSQCFKAMLQSIHQGQIILLQSLQMMAPPDSIPIV

SEQ ID NO: 179939 - protein, 85 aa, Glycine max
  Coding DNA Sequence Number=SeqID_88254
MVTTKELETRMDSYEKIFSDLQESMENSFEMMQKSIEELMVSIATQHKGPKITTEDENHSGTHEPIVSVVDRAQIPFPSFDGSNY

SEQ ID NO: 179940 - protein, 109 aa, Glycine max
  Coding DNA Sequence Number=SeqID_88255
MVIDYQQLLNILFQFLNPVIDYTMSYFDDIKKNLLEKEGDVNHASFDGVEKKSHVCHHQKAGECESLFQDSLKTKPCLKTKCFQDMQGSGNRLPGSVIDYPKTGLRNSC

SEQ ID NO: 179941 - protein, 141 aa, Glycine max
  Coding DNA Sequence Number=SeqID_88256
MGLNQAHDLRKGSSSQGQVWKKERALQCPYRTRTRARVMSEIEEVQEQMKADMEAMKDQMAAMMEAMLSMKKIIEVNVATVVTASTATEVDSTHPSGLNQVNPPVSDIVRQGGEALGSTGGTHFVQVQNKYSFPPYGLPPN

SEQ ID NO: 179942 - protein, 74 aa, Glycine max
  Coding DNA Sequence Number=SeqID_88257
  Subcellular localization annotation: CTP_CleavageSite=35; ConfidenceScore=5.14e-01
MVPLTVPVQGSKGHTMLNGMPRNSSMISSCCIQVVSSEKWRLLFWKIPSSVGVSVCVKDGVWYWMYVRKALWLI

SEQ ID NO: 179943 - protein, 59 aa, Glycine max
  Coding DNA Sequence Number=SeqID_88258
MHNSNNNLGNTDQHPAKEREPKEELEPPTTSTMQMVACRRLFVRRKMHLVFGNVVCKPY

SEQ ID NO: 179944 - protein, 171 aa, Glycine max
  Coding DNA Sequence Number=SeqID_88259
MIYTWTPTSKAKRVVRGEEAAGLAGLAEKKKHTGRRKEAARSDLLGGGGGAPFLNFYDWILTNITDWRFNSHHAGSFRCCIGSDSPIESPSASVSTRMLQKDSINLSSKWETNKHRKAYGFISIPFLILFKYLATDRASFVALQLGPAVSQMMPVVEATPFYSIARNASAS

SEQ ID NO: 179945 - protein, 246 aa, Glycine max
  Coding DNA Sequence Number=SeqID_88260
  Homolog annotation: Hit_ID=Q6WAY4; Match level="QueryCoverage=86%, HitCoverage=38%, E-value=2e-20, Identity=33%"; Hit description =Putative uncharacterized protein
MGSNQTPLLKKRFYQVKIKSLEVTSLRELGQLMGQLQWQAFRKAYGKIWDLARVEVSMEPIASLAQYYDQPLRCFTFEDFQLMPTVEEFEEILGCPLGGRKPYLFSGFYPSTTRVAKVVKISAQELDQVKQNRNGVVGVPRKCLEERAKALANQGEWASFIEILVLLIFGVILFPNMEGLVDLAAIDAFLAFHHGKESPVVAILAMYDTFDLRCEKRGARIVCCTRALYVWLVSHLFLQEGRPVYL

SEQ ID NO: 179946 - protein, 174 aa, Glycine max
  Coding DNA Sequence Number=SeqID_88261
MTRGNPSDLQPFDPEIDRTFHRLLRHHLVPFEHPGHSVIGDFEHYCFEHSDFGHSENMTQPPPRERTLREMAAPDFTYEILCIQYPDEDVPYVLKTGLIHLLPKFHGLAGEDLHKHLKEFHIVYSTMKTPRCSRRITYFLRPFPHSLKGSGKGPSYITLLQGPSRAGMTSREYS

SEQ ID NO: 179947 - protein, 181 aa, Glycine max
  Coding DNA Sequence Number=SeqID_88262
  Subcellular localization annotation: CTP_CleavageSite=36; ConfidenceScore=5.25e-01
MKSKRRPESKKRPPSSKHHEDTIQRGLSNPRSTLLSLASPKASQTQGLPLVSLVFSMARQTQGSSLVSLASPKARQTHSLPLARQTQGSPLVNLTSPKAHQTQGPPLVSLVSSSNLRFSLGEPRPGSKLVKPKEYKKPKVEIKPEIILCHLTLYGKVLHPTSSRPHYRPILNTTRNEASHK

SEQ ID NO: 179948 - protein, 71 aa, Glycine max
  Coding DNA Sequence Number=SeqID_88263
MRSRETLGREEEDEGDPDTRVAKEGAGEVEEEGGGIFRALIVITPVLNKCVSMVDGGVTAGPAKAVEAMSS

SEQ ID NO: 179949 - protein, 77 aa, Glycine max
  Coding DNA Sequence Number=SeqID_88264
MGKGSLRWHLPEDPFGVLPEIPEEGLPKDFWKKGSSGSNKTYSERTGLPENSRNTSSGKFPEEVVFPKTFRKKGSSG

SEQ ID NO: 179950 - protein, 126 aa, Glycine max
  Coding DNA Sequence Number=SeqID_88265
MPFREDHFWKNLLPEKDFVIPEELMNTFWKNVIRNISGRRFFRKITFYFRKKALKIWWSREVFEVLVVPVKQFLEKKNSKKLYPEEILSTGGRSSGMRMLNFRKNFFRKLLRLILEEVLPEVLLPE

SEQ ID NO: 179951 - protein, 256 aa, Glycine max
  Coding DNA Sequence Number=SeqID_88266
PWQIKANGLSFIYILALLIFGVVLFPNMEGLVDLAAIDAFLASHHGKESPVVAILAMILSSCEGYPMRGVPSDESITPFIARGFSDHNARSEHKDWDWLPNLKTVRDDEVKASEESDEVQALKAELERAWVVEEKFKAAIVSSSSEEVKGIITGQRHDLEGRAKGNMWAVIDECKEKLNLAATHEQRLEDEYTKISVEREARERVIDSLHQEATMWTDRFALTLNRSQELPRLLAKAKAMADTYSAPKEIHGLLSY

SEQ ID NO: 179952 - protein, 163 aa, Glycine max
  Coding DNA Sequence Number=SeqID_88267
  Gene Ontology: Mol. function=aspartic-type endopeptidase activity; Biological process=proteolysis
  Homolog annotation: Hit_ID=Q7XG75; Match level="QueryCoverage=33%, HitCoverage=9%, E-value=1e-08, Identity=50%"; Hit description=Zinc knuckle family protein
MSGHGVRSYAGELVPLDLEIEATFSRNNTERKRKLLHDRTVASILEEAHFSESSSSNSPTSRESQTVEFEAKVMSKEQPRRVTLEDYSSTSVLQFFTSIARPELIKNNLFHGLPKEDLYAHLATYIEICNTVRLAGVPEDAVRLSLFSFSMSGEAKRWLHLFK

SEQ ID NO: 179953 - protein, 64 aa, Glycine max
  Coding DNA Sequence Number=SeqID_88268
MLVSSRQRARLPLADKRYLCMSSDMPSLDDKGADDDVSLCMLPGPRVMIAEGGVVDKNEAFALM

SEQ ID NO: 179954 - protein, 110 aa, Glycine max
  Coding DNA Sequence Number=SeqID_88269
MAPKKLSMKRSRRDAAAEGPSAIPEFDSQRFQSAEHQQRFEAIKGWSFHRERRVQLREDEYTDLQEEMARRCWTSLVTPMAKFDLEIVLEFYANAWPTEEGLRDMCTWVR

SEQ ID NO: 179955 - protein, 144 aa, Glycine max
  Coding DNA Sequence Number=SeqID_88270
  Gene Ontology: Mol. function=RNA-directed DNA polymerase activity; Biological process=RNA-dependent DNA replication
  Homolog annotation: Hit_ID=Q2HSY1; Match level="QueryCoverage=100%, HitCoverage=94%, E-value=2e-14, Identity=30%"; Hit description =Putative uncharacterized protein
MSLNQVLVKRDALSHRGVLRDDADRRCVLCSSEDETVKHIFLDCRVAKKIWQQVCLWLDDPVVEGEDIQAHFMAFGKLIIGKKQKRVKHLIWMAVIWNIWLTRNKVIFKEEAAAIPVMISGIKDCAWAWFMARQGKTCWDGWSD

SEQ ID NO: 179956 - protein, 92 aa, Glycine max
  Coding DNA Sequence Number=SeqID_88271
MGIQKNSQAGEERHKKNSGGYSLANSFRKREKGMKKMNSTSFQGLENQKTSESFWYKEEEEVQRDSRLVKDCKRLIGKVFKMLEMQNKALLL

SEQ ID NO: 179957 - protein, 218 aa, Glycine max
  Coding DNA Sequence Number=SeqID_88272
  Subcellular localization annotation: CTP_CleavageSite=36; ConfidenceScore=5.51e-01
MSTRKPSRTRRASTRTTGRAWPTRRGRATCTSTTTRTSTGKERLPRPAAGISACADLPAGPGAAAASAGVDPAAEVWPHLLARAATPHLLIVQPRGARGIDIESDAQRAGHAGILDGQLPRQEHLRQVAARREVGLVEHAGTPRHHAMRLAGVEQHRGAARQRDALAAVGEQQVQSLVLAQEQIAEGRAAILVAVVVVARAAAGHQGDIAFGQRVAQA

SEQ ID NO: 179958 - protein, 195 aa, Glycine max
  Coding DNA Sequence Number=SeqID_88273
  Homolog annotation: Hit_ID=A5C7Z4; Match level="QueryCoverage=54%, HitCoverage=41%, E-value=2e-08, Identity=30%"; Hit description =Putative uncharacterized protein
  Pfam annotation: Domain name=Peptidase_C48; Domain location=24-195; Score=-35.0; E_value=0.086; Accession=PF02902.10; Description=Ulp1 protease family, C-terminal catalytic domain
MSQHISVTVVDSVSLYIKGFYLPRHLTETCMRAGNYDIYGFLEPQSIQRSGQSQFESESYIKSWMQSSQRDVYLGAYLNGFHCSGHWQMVVILPKDHLVVWFCSLHNRPDNYLKGIINSLKSKAPARWIVVKCNRQKRTTECGYYVMHWMSTIILGTFRNNWEAYFNDPRPLEPMRLKALRIQWAQFYLRVRDQA

SEQ ID NO: 179959 - protein, 52 aa, Glycine max
  Coding DNA Sequence Number=SeqID_88274
  Homolog annotation: Hit_ID=A7PP42; Match level="QueryCoverage=67%, HitCoverage=7%, E-value=2e-09, Identity=88%"; Hit description =Chromosome chr8 scaffold_23, whole genome shotgun sequence
AVARGLKDPSFRVIQNHFAISGNLGEVAAKVRWEIQHHNLLNSRRKYSGNSR

SEQ ID NO: 179960 - protein, 149 aa, Glycine max
  Coding DNA Sequence Number=SeqID_88275
  Gene Ontology: Mol. function=protein binding
  Homolog annotation: Hit_ID=Q9SDM7; Match level="QueryCoverage=89%, HitCoverage=32%, E-value=5e-51, Identity=59%"; Hit description =Putative uncharacterized protein
MAGEDDFFANPSSYSYGSDFSYNHYKETLVLVPKGDELEYRDNLILVRMIDLSSQIPQSLSDLSFLSFLNLSYHNLSGRIPTSTQLQSFEELSYTGNPELCGPPVTKNCTSKEWLRESASVGHGDGNFFGTSELSLVLNVLNVKRTRRA

SEQ ID NO: 179961 - protein, 110 aa, Glycine max
  Coding DNA Sequence Number=SeqID_88276
VAWPRAQPSPSRGGWASAAQEPASEEPVAAKEEGEDELTPPKPFYFDADAHMAQEEGTSIDKIPEPSSAPTPEETQPSTPVTEPEQPIQDSSAAPALDLNEDQPQDEQDI

SEQ ID NO: 179962 - protein, 228 aa, Glycine max
  Coding DNA Sequence Number=SeqID_88277
MSLNLPYFLEFVKVFYNNLKIQDGVLYSEVHNIPIVVDQSLFYSLTKLPSQGVPFEGTLVDDWKFDYSSHDARRMICNDQADMTSRLLVGSFTFDYRIMHNIIIRILLPRSSNLAQASEEDLILLSFSIGVGVVTSFGYRKDVDGQWVCKQDLPPPIPDELTPSPPPERDASSSLLTKFLTELRDLQAFVGERFDAIDTRFDGMDTRITRIEDDMSFIRRCFDPTADS

SEQ ID NO: 179963 - protein, 392 aa, Glycine max
  Coding DNA Sequence Number=SeqID_88278
  Homolog annotation: Hit_ID=Q84VH5; Match level="QueryCoverage=100%, HitCoverage=57%, E-value=1e-143, Identity=68%"; Hit description =Envelope-like protein
  Subcellular localization annotation: CTP_CleavageSite=21; ConfidenceScore=5.13e-01
MATSPKETSSPGSPSVPSSPSSTKAPSNQEQPEFHIQPIQMIPGQAPVPEKLVPKRQQGVKISENPSLATSPREVDTEMDKKIRSIVSSILKNASVPDADKDVPTSSTPNAEVLSSSSKEESTEEEDQATEETPAPRAPEPAPSDLIDLEEVESDEEPIANKLAPGIAERLQSKKGKTPITRSGRIKTMAQKKSTPITPTTSRWSKVAIPSKKRKEISSSDSDDDVELDVLDIKRAKKSGKKVPGNVPDAPLDNISFHSIGNVERWKFVYQRRLAVEKWKYVYQRRLALERELGRAAMDCKEIMDLIKAAGLLKTVSKLGDCYEGLVREFIVNIPSDISNRKSDEYQRVFVRGKCVRFSPAVINKYLGRPTEGVVDIAVSEHQIAKEITVKQ

SEQ ID NO: 179964 - protein, 102 aa, Glycine max
  Coding DNA Sequence Number=SeqID_88279
MGLVDLATIDAFLAYHHSKESPVVAVLADAYNTFDRRCEKSGARIVCYTPALYVWLVSHLFRHESRPVYPLQGHHICVEKGKANWEQLLASMVGVSVNWFPQ

SEQ ID NO: 179965 - protein, 374 aa, Glycine max
  Coding DNA Sequence Number=SeqID_88280
VALEDPGRIKGGGNQIQAVLRAGHAEAYQEHDGGQRVDVAHQIPGRADHQRGAQVGDGQHAVGPDPVHQQRHQDGAQGAAERHHRPDARGVGDIVTGVFKYRRQPTGEQVEHEQRAEERRPQQQGAHGASFDKQVRDRRLGLRRALVIDNGYPRPTLAGDTLDHPAQPIGMPGAGGHKAHRFGHLPGQQRQQRQWRDAADQQHAAPAKCRNDLPGQQAAQGQAGGKAAPAQGRYRAPEANAGDEAQQGQGFDRMRIGRSQGAAAKYQHRDEQHAFAADGVGDRPEQQAADQQAEQPRAEGGGELRGLQTPLFAQRRGDIADDGGIEPVQQGDQETQGEDEDLIRRDPGAIDNFADASGIWAHEGSTVIKLVWAG

SEQ ID NO: 179966 - protein, 81 aa, Glycine max
  Coding DNA Sequence Number=SeqID_88281
MAQPPPCERTLREMAAPDFTYESLCIQYPNQAFPYVLKTGLIHLLPKFHGLAARDKSLHSESDKSDGADGYSVEPSSVPKF

SEQ ID NO: 179967 - protein, 65 aa, Glycine max
  Coding DNA Sequence Number=SeqID_88282
MKFNDTESDKDLSELDESIAYLRLDNGIKEKVSSSQSSEAGAPTQHMDDHIQPRSSLRPQGNTAR

SEQ ID NO: 179968 - protein, 45 aa, Glycine max
  Coding DNA Sequence Number=SeqID_88283
MWRSNITMEHGAGYGSYKWARTSISTYKAIVYGGKGYGGGQKDGK

SEQ ID NO: 179969 - protein, 159 aa, Glycine max
  Coding DNA Sequence Number=SeqID_88284
MSELGQFCSKHSTENTPRGTPEHPPKKRQNKNTVNLNKDDVIENHMTNAARGPLDVNQKWICECHVWLSRICDNNSSLRQRTLHASIGRRSDIPRWSRSRPLYLIGLRQQMLKEAPPPLLGTRSMATEWRRRKGDWKRHFKEKMSQEQAHHHRKSWIRV

SEQ ID NO: 179970 - protein, 72 aa, Glycine max
  Coding DNA Sequence Number=SeqID_88285
MEKDALHVGPWNGGFNPFFSLMLGTLSEQSEEKIEESQEFSKDAAIFVERQVNPLRVDVPMRNFYEIDVFFC

SEQ ID NO: 179971 - protein, 104 aa, Glycine max
  Coding DNA Sequence Number=SeqID_88286
MRLTCQALKHLINERKGKMMFFGYLVQPPIINADSPAVLHFGGDEFIPFILNHCEAYLLRNHLDWTHSLAIRNGVDDSSLMTGLSHRCGCLTGLAPSSKSILCM

SEQ ID NO: 179972 - protein, 61 aa, Glycine max
  Coding DNA Sequence Number=SeqID_88287
MKAPVTLAQPEGEDGALSKLAFAQRLYSTHLSSRIVHALSHQMGHFVDDALSQKISGLASS

SEQ ID NO: 179973 - protein, 100 aa, Glycine max
  Coding DNA Sequence Number=SeqID_88288
MINAGMICPLRCREEMHDGIKEQARVIHCGDRDYKRQCITKRGKLYMRFHCYQASQRPSMTTDRPPLLMANIDPGIGPNISTCMQRCRCHVCIEQKYFQL

SEQ ID NO: 179974 - protein, 102 aa, Glycine max
  Coding DNA Sequence Number=SeqID_88289
  Subcellular localization annotation: CTP_CleavageSite=57; ConfidenceScore=5.03e-01
ITRHPVDPKQGIAPARHPVDPKKSNRVLGFPALITGLCQFYGVPVAPSKFIRPPTNRAFIKKYCAPRQAQGKTPQQSRDGRQRATDAPPPPLEFTSAHLQKG

SEQ ID NO: 179975 - protein, 106 aa, Glycine max
  Coding DNA Sequence Number=SeqID_88290
MGYVGVRELSWRWATGDGGFMRALWMWKNLLCTIARPPPSTTCDGVVPGDMSRGSGDLGDVRRAPGSQQIKGKPRPQSKEACGGWPAGAKMVSGNRLPGDVIDYQA

SEQ ID NO: 179976 - protein, 59 aa, Glycine max
  Coding DNA Sequence Number=SeqID_88291
  Subcellular localization annotation: CTP_CleavageSite=40; ConfidenceScore=5.23e-01
MTSARKDDRSRPIIVFSGRGGFVVRCRLQNLQCRSARVFRASSTEAVFRPTLACSHLLG

SEQ ID NO: 179977 - protein, 246 aa, Glycine max
  Coding DNA Sequence Number=SeqID_88292
MQLPQEPLNKKPRGLAWKSMAETNSVELCGAATMSSSFEGKRGTNHEYIAWKLTIAKKAQRHPYNTRSKSKMGNEEGVQEQMKANMSTLKDQMASMMEAMLKIQKSIEDNAMAAATNTTREAEPVLQPAMNSSRDRSTTGFNWRLHSPYRYRQFELSPYLQGATPSSCRLPSRGRRRGRCPFGPFTSPKGADTHELPWPNIIHHAPSQSAPVREPVPISKDKGKINLLEERLRAVEDLGNYPFSEQ

SEQ ID NO: 179978 - protein, 390 aa, Glycine max
  Coding DNA Sequence Number=SeqID_88293
  Gene Ontology: Cellular component=viral envelope
  Homolog annotation: Hit_ID=Q84VH5; Match level="QueryCoverage=93%, HitCoverage=67%, E-value=1e-134, Identity=92%"; Hit description =Envelope-like protein
  Subcellular localization annotation: CTP_CleavageSite=13; ConfidenceScore=5.21e-01
MATSPKETSSPVSPSVPSSPSYYKTPSNQEQPALNIQSIQMIPGPGPVPEKLVPKRQQGVKISENPSFATSPREEDTEMDKKIRSFVNSILKNASVPDADKDVPTSSTPNAEVLSSSSEEKSTEEEDQATEETPAPRAPEPAPDVPNIKRAKKSGKKVPGNVPDAPLDNISFHSIGNVERWKFVYQRRLALERELGRDALDCKEIMDLIKAAGLLKTVTKLGDCYESLVREFIVNIPSDITNRKSDEYQKVFVRGKCIRFSPAVINKYLGRPTEGEVDIAVSEHQIAKEITAKQVQYWPKKGKLSAGKLSVKYAILHRIGTANWVPTNHTSTVATGLGKFLYAVGTKSKFNFGNYMFDQTIKHSESFAVKLPIAFPTVLCGIMLSQHPNI

SEQ ID NO: 179979 - protein, 72 aa, Glycine max
  Coding DNA Sequence Number=SeqID_88294
MDNHLGFSACHRTRRLWMKKDSPSPDDKGAEDDVSLCVSTGSLAPGSQKVQMTTLVSACQRARLPLVDKRCG

SEQ ID NO: 179980 - protein, 151 aa, Glycine max
  Coding DNA Sequence Number=SeqID_88295
MTRGNPGDLQPFDPKIDRSFHRLVRHSVHPSHSVHFEHSEHSVEVNSEYSDFQHSTTNFHTENMAQPPPRERTLREMAAPDFTYESLCIQYPDEGEDPHKHLKEFHIVCSTMNTPGVQEDHIFLKAFPHSLEGVAKDWLYYLSPSVHFKLG

SEQ ID NO: 179981 - protein, 218 aa, Glycine max
  Coding DNA Sequence Number=SeqID_88296
  Homolog annotation: Hit_ID=Q2HTA0; Match level="QueryCoverage=38%, HitCoverage=13%, E-value=1e-10, Identity=47%"; Hit description=IMP dehydrogenase/GMP reductase, related
  Pfam annotation: Domain name=DUF1723; Domain location=119-168; Score =28.7; E_value=2.1e-05; Accession=PF08330.1; Description=Protein of unknown function (DUF1723)
MVKTRGLAHALARVLPEVLGRGDGDDFDGAPQRRRPTASAQRRQVPIIVDDVVLTVPVDSPAVPEAEAVVVGDEPMERPELKLSSHGRKVHNLGMPVPAIEDMVAGTRLSPLIACSINIGDRGLISSFVERWYRETSSFHLLVGEVSIMLDDVASLSHLSTVGTFHDFQPLCTDEAMLLLVELLMVSAEVPMAKTGQCGGPYVRLQWLRDVYHCRCQT

SEQ ID NO: 179982 - protein, 103 aa, Glycine max
  Coding DNA Sequence Number=SeqID_88297
MRDNHYGDWMEYHAEWINIWKNKRNDVLTRQWVKGIVTHTNFDAPHSFGEQGQSSSAATTHIEYTDIEQQHHHDVGEPIIQERRNPRHNRRPLPCGIGHHLGH

SEQ ID NO: 179983 - protein, 100 aa, Glycine max
  Coding DNA Sequence Number=SeqID_88298
  Homolog annotation: Hit_ID=UPI0000ECBAF8; Match level="QueryCoverage =41%, HitCoverage=48%, E-value=1e-16, Identity=100%"; Hit description= UPI0000ECBAF8 related cluster
MASLGYPILEDKAEEERGAGGDDDCTEEGNGEHWRDIMVSSFRIMRSSMQAWHWPSFYNVVTGKTLALPNLIALQHIPLSPAGVIAKRPAPIALPNSCAA

SEQ ID NO: 179984 - protein, 88 aa, Glycine max
  Coding DNA Sequence Number=SeqID_88299
DRNGQWLKKDALPPQDERTPSPPAQREDTALLNEVLTELRGLRTYVGERIDSLDTRFAGMDIRLTQVEEDVSFIRTCFDPPPPPPSSC

SEQ ID NO: 179985 - protein, 106 aa, Glycine max
  Coding DNA Sequence Number=SeqID_88300
  Homolog annotation: Hit_ID=A5B3J2; Match level="QueryCoverage=52%, HitCoverage=12%, E-value=2e-08, Identity=51%"; Hit description =Putative uncharacterized protein
MAEEHDQRITLEDYSRSPNEDPYAHLATFTEICNTVKIAGVPDEAIRLGLFSFPLAGEAKRWLHSFKGNSLKTWCRNLPFGGRATRDSRDAFSMKGIRAESPPTFI

SEQ ID NO: 179986 - protein, 172 aa, Glycine max
  Coding DNA Sequence Number=SeqID_88301
MTLTILELFLRLYQVTWDVTVFEVFNPDFPLYIKHKDLSEIAHGGQCLSISVLQLWILHLTETSMRAKNSDLYGFLELQSIQGSGQSQFETESYIKSWMQSSKHDVYLGDYLNGGHWQMVVIVPKEHLVVWFCSLHNRPDNYLKGIINSALKGLDDAPQPKSKVPTRWIVVK

SEQ ID NO: 179987 - protein, 92 aa, Glycine max
  Coding DNA Sequence Number=SeqID_88302
  Homolog annotation: Hit_ID=A5ZQM3; Match level="QueryCoverage=70%, HitCoverage=92%, E-value=2e-19, Identity=53%"; Hit description =Putative uncharacterized protein
PSVRYHSGRARILTLCQDLRAEGQSQAEGSLTARPTRRAGTKVGLSDPTVPSGRAVAQRIKGWAVRPLKRYVSWVQNVVRQFGPYPVWALEH

SEQ ID NO: 179988 - protein, 145 aa, Glycine max
  Coding DNA Sequence Number=SeqID_88303
  Pfam annotation: Domain name=DUF1471; Domain location=1-90; Score =37.8; E_value=3.9e-08; Accession=PF07338.4; Description=Protein of unknown function (DUF1471)
  Subcellular localization annotation: CTP_CleavageSite=43; ConfidenceScore=5.02e-01
MKNVMLKTMLLGAFVFSGATVAATQINSQQADALTPRQVITVSGAANLSDAEKMLADKTAKAGARYYKIIAIRGRGVDFTLRHAIALIRVIISAHADDKVTVQAAAGGDGAALPLWRAGPALALVSTLGVGRASRVICWTGTFSE

SEQ ID NO: 179989 - protein, 96 aa, Glycine max
  Coding DNA Sequence Number=SeqID_88304
MLWKLGGIDGDPVLRGTRIRATWEYVISVEGGQLGMVDLCVICGCGESTCTIAQLPPKWYLEICRGGQETLGTSGGVLLPKTKLDQSRPNPGIVSQ

SEQ ID NO: 179990 - protein, 17 aa, Glycine max
  Coding DNA Sequence Number=SeqID_88305
VRRVSTLSLDSTSSRPS

SEQ ID NO: 179991 - protein, 44 aa, Glycine max
  Coding DNA Sequence Number=SeqID_88306
MLQAIKERPRTREDEDARRREDDSGGKELKNAEEEAELMLDLND

SEQ ID NO: 179992 - protein, 231 aa, Glycine max
  Coding DNA Sequence Number=SeqID_88307
  Gene Ontology: Mol. function=transcription factor activity; Cellular component=nucleus; Biological process=regulation of transcription, DNA-dependent
  Homolog annotation: Hit_ID=Q0Q097; Match level="QueryCoverage=98%, HitCoverage=79%, E-value=2e-49, Identity=51%"; Hit description =AP2/EREBP transcription factor AINTEGUMENTA-like
TQEEAAEAYDVAAIKFRGVNAVTNFDISRYDVERIMASNTLLAGELARRNKNSEPRTEAIEYNVVSSQQVISNREEVHETVNNNNNNNSENGSSSDWKMSLYHHQQQSNNCDQKTIKCENYNRGGAAFSVSLQDLIGIDSVGSSQGMMDESTKIGTHFSNPSSLVTSLSSSREGSPDKMGPTLLIPKPPMGSKIVTSPTVANGVTVGSWFPSQMRPVSMSHLPVFAAWSDA

SEQ ID NO: 179993 - protein, 49 aa, Glycine max
  Coding DNA Sequence Number=SeqID_88308
MAKQWLRLMEDDEGGKLGLQEKNLSNSIYLHFVYKSHTPSRKGELYLKY

SEQ ID NO: 179994 - protein, 388 aa, Glycine max
  Coding DNA Sequence Number=SeqID_88309
MAQEACLKEIQERQSVEGTSSTPEYDSHRFRSAEHQQRFEAIQGWSFLQERRVQLRDDEYTDFQEEIARRRWPLLVTPMAKFDPDIVLEFYAKAWPTEEGVRDMRSWVRGQWIPFDADAFSQFLGYPLVLEEGQECEYGQRRNQADGFDEEAIAQLLCIPGKDFAWTAVGRRVRIMCTNMTTLTQIWMTLLLSNIQPSDHNSDLPLPKCQLVYAILTRMSIHVAQLIADALYLFAGMAPTRHPLDSDKSNRALGFPALITGLCQSFGVPVAPSKAGDAPPPHQAGPAGSFDLEQYLRHVVRQQAANHQAHVQTHDCLYQLSLSLQSQGFTSFPCPTPDQFRAEVAWPGDWPEAQAGEAPAEAPGEADEARKDEEMTDLLDFLGRSGAT

SEQ ID NO: 179995 - protein, 84 aa, Glycine max
  Coding DNA Sequence Number=SeqID_88310
MKFSKKPDSGGRPPKDRDIGLKREPNKDLSCIILHNLECYQFRYFRSNRKKSNDWSGRVRVEKRIPHFFLSFKTVHETFISHGS

SEQ ID NO: 179996 - protein, 54 aa, Glycine max
  Coding DNA Sequence Number=SeqID_88311
MEEDKSNAYIRLLQYLLRKRKSGVHCSRESVISPNSNIRLMSVETALGTKEICE

SEQ ID NO: 179997 - protein, 299 aa, Glycine max
  Coding DNA Sequence Number=SeqID_88312
MEGSLSPFLVKDLGAQGLKVIQRIHKAWRSPLRKDKELKGIRNGVIGGYDGWLRIHTRGLDWLSKLKVIDEENFEAPEEDEEVRALKLELGKARLAKEKFKSAATHIRKECTELQEENATTARALEQETKRARKEEYGREKFRGALWGSNNELKLRREERDRSRVHGMILKEELVACARSKQSLAQHLEATEQSMLAIIGQYKEELNQSVAHEQKLVEDFAQVYAEKEARGRVIDALHQEATMWMDRFALNLNGSQDLPRLLAKAKAMAEVCTAPEEIHGLINYCQHMIDLMAHIIRNH

SEQ ID NO: 179998 - protein, 181 aa, Glycine max
  Coding DNA Sequence Number=SeqID_88313
MGEVEEVQEQMKTDMEAMKEQMATMMEAMMSIKKIMEANAITVAATSAVAKVNPTPPSGLNQMNHPTSDMVGKDLGSTGGPHDVQIQNDHAFPPYGWPPNYTPPNVAYTPSEDVNNSAPILIESRQPQTDHVDVSQTMGETHEIPHHNLADFEPCLRYATEGQAVGGSRTLKEAKIMPLLT

SEQ ID NO: 179999 - protein, 78 aa, Glycine max
  Coding DNA Sequence Number=SeqID_88314
MDFQEEVARRHWTSLVTPMAKFDPDIVLEFYANAWPTEEGVRDMRSWVRGQWIPFDTDALSQFLGDSLVLEEGQECKF

SEQ ID NO: 180000 - protein, 17 aa, Glycine max
  Coding DNA Sequence Number=SeqID_88315
MSVETYPSAEGRREGSR

SEQ ID NO: 180001 - protein, 101 aa, Glycine max
  Coding DNA Sequence Number=SeqID_88316
VPQHVEDESSKATIPEPFDLGEEAGETQVRHVVAATPERSLEATSEPPAPVVDLPSPQHTTVPSTPILEVPKEPTTPVLAMDTSPPTTPVLHLTDEEDVQT

SEQ ID NO: 180002 - protein, 286 aa, Glycine max
  Coding DNA Sequence Number=SeqID_88317
  Gene Ontology: Mol. function=hydrolase activity
  Homolog annotation: Hit_ID=A2Q1D6; Match level="QueryCoverage=70%, HitCoverage=46%, E-value=2e-17, Identity=26%"; Hit description =Ovarian tumour, otubain, related
CDALPGVIITDRDLAMMNAVKIVFPECTNLLCRFHIDKNVKAKCKSLIGQKNAWDYVMDAWRSLVDYPSKHQFDDCLKKFEIACSPWYALNQIAAEYECVHYAGKNPSRCGCVMRTTHGLLYACELSKYVIGTIPLDSIHIFWRRLSFSVTLKSKVQEISYPDQNSMCPLLEKVNTKGAQKKPMTKHQRSTKCDPSYWKYVDALHFVQNSNSSVKRSASSSDQAIPRRTMPMLDRFHPFIHDLIENIVDVKADELAQWPDEYINLFGGIDRFEELKRSLLVDGLSM

SEQ ID NO: 180003 - protein, 87 aa, Glycine max
  Coding DNA Sequence Number=SeqID_88318
MEEASDFCFEYMEKTKSVGVLESQHDEREEDDDKSDDKKLKGQSKNEFNIFKIESRTLQDSRGKLISRIKNQEIKIQDSRFKNQEKA

SEQ ID NO: 180004 - protein, 137 aa, Glycine max
  Coding DNA Sequence Number=SeqID_88319
RSFLIGVIVISSFGYRKEHDGSWVKKGAQPIDEEGNLPVGEDSSLLQRILDRFDGLQTFVGERVVIIKKGEIVEASFMMTNQVDSSSFDDNKDDDKKPKRMISRLSQQDSRIKRMISRLSQQDSRIKIILISRFKRR

SEQ ID NO: 180005 - protein, 132 aa, Glycine max
  Coding DNA Sequence Number=SeqID_88320
NLTDCASVFSFDFRHVPELHKLPMMGAKHLTRTKHKLHASSTDSKNNVYTDNHSGISARQRDSNVSMTDLVSAEDDTAKNNVYTDNHSSIFARQRDSNVSMTALVSAEDDTPKNNVYTDNHSGISAGQRDSN

SEQ ID NO: 180006 - protein, 136 aa, Glycine max
  Coding DNA Sequence Number=SeqID_88321
MAPRKLSVKRSRRDAATEGTSAAPEFDSHRFRSAEHQQRFEAIKGWSFHRERRVQLKDDEYTDFQEEIARQRWTSLVTPMAKHPLDPDKSNRALGFPALITGLYQSFGVPVAPSKVIQPPITRAFIEKYYTPRQAQ

SEQ ID NO: 180007 - protein, 81 aa, Glycine max
  Coding DNA Sequence Number=SeqID_88322
MKENNGGLWWLMVVVGDGESAWDVGNGFGRKKEKKMAFYLSYLDYKAQNAQVNNALGNRNFVHTPDIFSTIPTVRSWKIVL

SEQ ID NO: 180008 - protein, 116 aa, Glycine max
  Coding DNA Sequence Number=SeqID_88323
MSSSGTSHMEKLEIEQRKISGNSNGHNFSHGGTSDIETPEIEPRKISRNSNGHNFSQGGPIQALNILRRSKLNNGIYREIKIVINLQTGVRFMRISNSSALYIETLEIELRKLSIN

SEQ ID NO: 180009 - protein, 254 aa, Glycine max
  Coding DNA Sequence Number=SeqID_88324
GWWVYARFVDVENLLCTITRPPPSTTCDGVVPGDMSRGSRDLGDVRRAPGSQQIKGTKTTKQGGLWWLASCEFCVIYGLWPLVIDYQGLENEVRKLGELLVIDYQGEEWVTGNRLPGCVIDYQRWNASRYPFYLHPVIVMAAQLIHDRVEMECLEGVWETLEGNTRVDTTHAYTISSSGASPSDRGDVIRGRTLRRIPEELPPEPAADALDFLEGDEDPLPEVDSPEEVMSASEADSTEDSGLREMATSGGSSS

SEQ ID NO: 180010 - protein, 99 aa, Glycine max
  Coding DNA Sequence Number=SeqID_88325
MVKEFYANLYSPEDQSSKQVRVRGHLIRIDADSLNTFLVTPVVLEEGETLPSYSRFTRMRIDPQDFVVRLCIPGRGFILNAKGHPWKLMRKDLTTLAQT

SEQ ID NO: 180011 - protein, 234 aa, Glycine max
  Coding DNA Sequence Number=SeqID_88326
MPSEKTFQASGNLVERACMSTGKDSRNCVQVVLTTRFLSMERSMIDTASGGALGDMTPAEARNLIEKMASNSQQFSARNDAIILRKVHEVATDSSSSVENKKLEGKLDALVNLVTQLAMNQKSTSAPVARVCGLCSSADHHTDLCPSLQQSGPVSPFQNATGPSKPYVPPPMQQQQQQQQRQQATEALPQPSLEELVRQMTIQNMQFQQETRASIQILTNQMRQMATQLNQAQS

SEQ ID NO: 180012 - protein, 84 aa, Glycine max
  Coding DNA Sequence Number=SeqID_88327
MEFKIETAKGLAKKFKQKCLFSRDLLSGNRLPEEGLRDRGSLVVKKSEHKGRVVLAWFRTCKGILQDSGTLKRVAWRLDVGTRV

SEQ ID NO: 180013 - protein, 271 aa, Glycine max
  Coding DNA Sequence Number=SeqID_88328
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-29, Identity=28%"; Hit description= UPI00006A17C9 related cluster
  Subcellular localization annotation: CTP_CleavageSite=57; ConfidenceScore=5.56e-01
MRCNPLKARTCTPLKVMVHSPLKVRTCSPQKVRACNPLKAKTCSPLKVRTCSPLKVRARSPLKVRTCSPLMVTTCNPLKPRTHSPLKVRACTPLKVRMYSPLKVMRCNPLKARTCSPQKVRACNPLKAKTCSPLKVRTCSPLKVRARSPLKVGKCSPLMVRTCNPLKVRTCSCLKVRARSLLKVRTCSPVKVMGCNPLKARTCSPLKVMVHSPLKVRTCSPLKVRASNPLNARTCSPLKVRECSPLKLRSCSLLKVWVHCSLKVRTCSPLR

SEQ ID NO: 180014 - protein, 64 aa, Glycine max
  Coding DNA Sequence Number=SeqID_88329
MNIGGHHEPLLLAVEPLHKDECFNQSGILRIHLKDLVKKQALNPSFMVSLRHERERPLSNMERS

SEQ ID NO: 180015 - protein, 69 aa, Glycine max
  Coding DNA Sequence Number=SeqID_88330
MGCRQEALLDLDQRLVIELGKYRKKGEILEGVEVVVSLSMAHALSEIHPLSETSAHLASKRNLGENLPR

SEQ ID NO: 180016 - protein, 191 aa, Glycine max
  Coding DNA Sequence Number=SeqID_88331
  Gene Ontology: Mol. function=protein dimerization activity
  Homolog annotation: Hit_ID=A5B6K0; Match level="QueryCoverage=99%, HitCoverage=20%, E-value=2e-19, Identity=34%"; Hit description =Putative uncharacterized protein
IHSIKRNRLEHKRLHDLVFVKYNQQLKQRYNARDEIDPISLNDIDVCNEWVVGEMDEDDDNDAGNDLVFEDDDALNWTTVYEASGVGECRMYTRWKKRERKQPTSAAISPTAAVAAHTSKKQAMGVGSSSRKQNVVEENDEDLEFGDIELESEEEEIMVNFEASNGEEGEGDVPLPYDNNEDDYVGVGEDD

SEQ ID NO: 180017 - protein, 283 aa, Glycine max
  Coding DNA Sequence Number=SeqID_88332
  Homolog annotation: Hit_ID=A5B2A7; Match level="QueryCoverage=86%, HitCoverage=35%, E-value=4e-27, Identity=30%"; Hit description =Putative uncharacterized protein
  Pfam annotation: Domain name=DUF659; Domain location=205-283; Score= -24.5; E_value=2.3e-05; Accession=PF04937.6; Description=Protein of unknown function (DUF 659)
MTAAMAIVCDGNMPSSKWLNHHLMLQPATRKNKTGLGWKAKEHLIGKSGNVASCNKTLPNVVEELKEYMANKKSGTTYSSFGSGNVASTRDFEFGQPIGCDGSEDEFADSCNATALAAKTKCGTKKGPMDRFCKNPENAINRRKMEMLRQMKIRESMDKNEVLNVHQYIACFWYQAGLSFNLIKLKSIENMVAAIGQYGPHLPIPSYHDIRVPLLKKEVEYTENLMKGHKEQFGTMFLKSVDGSDFVKTGEKLFELLDAIVEEVEEENIVQVVTDNGSNYVLG

SEQ ID NO: 180018 - protein, 101 aa, Glycine max
  Coding DNA Sequence Number=SeqID_88333
MAKNLHGITHGNVSDALRKRLGENEGAACHPARPSELGCFLQKASPSGGTSWKAQVRSSKGCMPSNNGPRTKLGYDTWHVWVRPCEDVLIFFKKGYQTLAD

SEQ ID NO: 180019 - protein, 158 aa, Glycine max
  Coding DNA Sequence Number=SeqID_88334
MVKHGAAKVVGVEGYGYVNGGGGREAAILAVAEGGGLPEERELQGRTTDNNNLTIYGFNEYLHAGFPIMVTLTIENGWEEGDKHTRVFILVRQQPVPTSSPQATCGPRDFFQPCKNPFTSKDPLGMYPPLFSLNLVDVPSTRTDPQEMYPLLFSVKPK

SEQ ID NO: 180020 - protein, 140 aa, Glycine max
  Coding DNA Sequence Number=SeqID_88335
MPEPSKKRKGSSSRGQRHSEAQDIPIPSSISSSSLFSSKEQCIWYTNLFSSHSIIDPKFIDMDFFSDESFKCIQAFQNSNLIPFMSLKLPVYFELVKSFYSNLEIQESTLISEVYGIKMVIDQSLFYDLTQLSSDGVPFE

SEQ ID NO: 180021 - protein, 227 aa, Glycine max
  Coding DNA Sequence Number=SeqID_88336
AEMPEESEEVQALKAELEKTRVAKEKLKVAVTRVRKECYELKDINMIADEALEQEMKKGQIKDGKPDVNLAANHGQMLEDEQAKVSALWVEREAREGVIELLHKEAMKWMDKFVLTLNESQELPRLLARAKVVADTYSAPDEADTETMKDQMTTMMEAMMSIRKMMEVNTATVTATSATIEVDLTHPSGINQSKHPFPPYGLPPNYAPPNVAHAPDENVNNSTLIPI

SEQ ID NO: 180022 - protein, 46 aa, Glycine max
  Coding DNA Sequence Number=SeqID_88337
MDPVKYIFEKPTLTGRRARWQPMHPEFLNEDIMALFKEDVEDEDKR

SEQ ID NO: 180023 - protein, 155 aa, Glycine max
  Coding DNA Sequence Number=SeqID_88338
YIHCSTSRGYIYLGLTENKRGYISCGSVLVEGTSTRFKENKGGYIPWWIFACKRIFTRLKEISRTAGRLGTGCVPFEGTIVDDWEFDYSSHDARRMVCKLLARSLTFDCHIMHYIIVRIWLPRSSNLAQASKEDLILMWAFQTGRQIDWAHLVWY

SEQ ID NO: 180024 - protein, 69 aa, Glycine max
  Coding DNA Sequence Number=SeqID_88339
TLPEQVRAVMQVGSATFIIRVIKHSGIGNGDSKILQVASRFQDVKTSHDVKTSYVTSPFCSPCLHALAA

SEQ ID NO: 180025 - protein, 276 aa, Glycine max
  Coding DNA Sequence Number=SeqID_88340
  Gene Ontology: Mol. function=helicase activity; Biological process =viral genome replication
  Homolog annotation: Hit_ID=Q2A9E0; Match level="QueryCoverage=99%, HitCoverage=18%, E-value=6e-71, Identity=49%"; Hit description =Putative uncharacterized protein
MARDRLADSQLDNVKLRLIAGREKYGRTYNLPNVSEVVALIVGDFDADSKRDTIVETQNGELQRIHELQSSYLGLQYPLLFPYGEDGYRPNILHRCTSSSRKRKRNRLTMREWFAYRLQSRSNEAQTLLHSRKLFQQFIVEAYTMVESERLSYIRNNKKKLRVDKYCSLQTSLDAGSSKDSSKGKRVILPSTFVGSPRYMDLLYFDGMAICSHVGFPNLFITLTCNPNWPEIRRVLAPLNLKAADRPDLISRVFRLKYEQMLFDLTKKHLLGKVVA

SEQ ID NO: 180026 - protein, 120 aa, Glycine max
  Coding DNA Sequence Number=SeqID_88341
MPCQHAIATITHKGWKPEDMCHERLSIEAYNKTYQHFIEPVQGPQYWAQTHNEQALNEAEEVAAHVQQDPVEINLSQPHLSQDSDMELMVPATIVPPIARNKLTITRAKQRKVADKDDAV

SEQ ID NO: 180027 - protein, 55 aa, Glycine max
  Coding DNA Sequence Number=SeqID_88342
EELGPCSPTECGASNYCKEAKYDATEFGVFKSTPNKLVIHSWLVTLTDSPVWPKV

SEQ ID NO: 180028 - protein, 71 aa, Glycine max
  Coding DNA Sequence Number=SeqID_88343
  Homolog annotation: Hit_ID=A6FJQ2; Match level="QueryCoverage=53%, HitCoverage=84%, E-value=3e-11, Identity=92%"; Hit description=50S ribosomal protein L5
MTVKTSDNMQLPETMRKEKIPHQAPFAIQAAQLLGRAIGAGLFAITPAGERGMCCKAIKLGNARVFPVTTL

SEQ ID NO: 180029 - protein, 51 aa, Glycine max
  Coding DNA Sequence Number=SeqID_88344
MSSEENRVNDLGDEKEEGFGAGGSPDVSWRCWPTAMVVEEDPFLFFEDYAI

SEQ ID NO: 180030 - protein, 149 aa, Glycine max
  Coding DNA Sequence Number=SeqID_88345
  Homolog annotation: Hit_ID=Q2HW90; Match level="QueryCoverage=87%, HitCoverage=31%, E-value=1e-10, Identity=31%"; Hit description =Putative uncharacterized protein
MGQLQRQAFAKPMDFQLVPTVKEFEEILGCPLGGRKPYLSSGFYPSTTRVANVVKILAQELNQANELSFIDILALLIFGVVLFPNMEGLVDLAVIDTFLAFHHGEESPVVAILAMYDTFDRGCEKSGTRIVCCALALYVWLVSHPFLQE

SEQ ID NO: 180031 - protein, 106 aa, Glycine max
  Coding DNA Sequence Number=SeqID_88346
MQNYQHAKRCDSAKGRTNRKRVMQQKRHGHAESSSQPTINCTLEYNIIVSDSSESENSESTQGSGSNYMTPFEDCQSPTNQPVINTKGNDYNSDFQFQMLLYMFLS

SEQ ID NO: 180032 - protein, 243 aa, Glycine max
  Coding DNA Sequence Number=SeqID_88347
KVYGKIWDLAMIEVSVEDIASLTQYYDQSFRCFTFGDFQLTIEKFEGILGCLIGGRKLYLFSGYYPSMAKVARVVKISERELDQLKQSRNGVAGILRKCLEEKVETHASQGKRVSFMDVPKGSEEVQALKAKLERKKVVKEKLKVVVTRIRKECDRQKDVNMSAAKALEQETKKARKEEWSRNKFRGALLGSSNELKLRKAKRDKSRMENYKEKVNLATSHGQMLRDEQAKVSALRVEKEARK

SEQ ID NO: 180033 - protein, 134 aa, Glycine max
  Coding DNA Sequence Number=SeqID_88348
MATKGWSFNGGGRRREWQREREREKASKIFGAENFQDVTRVITKESYVDPSSTDPNTGDSDKYVLYIEGNPSRLVALGRVYEGSTAVHNIPLFHGQVKVGVEKVKDAAAPVPVPTDKSVVSPAKPPDRPDQGIL

SEQ ID NO: 180034 - protein, 140 aa, Glycine max
  Coding DNA Sequence Number=SeqID_88349
MRSRRETQVDVPSTCTTKDVPSNVLRQRSLTVKPLILCEWGYKRILRREKGDTKEFRRLVLCSFGKGRRETQKEFRRLVLGEFFLAKGEEMKRMNSTSFQGLENHKTLKSFWYKEEEEFQRDSRLVKDCKRLIGKVFKIE

SEQ ID NO: 180035 - protein, 231 aa, Glycine max
  Coding DNA Sequence Number=SeqID_88350
  Homolog annotation: Hit_ID=UPI00016621D1; Match level="QueryCoverage =100%, HitCoverage=40%, E-value=4e-15, Identity=31%"; Hit description= UPI00016621D1 related cluster
VLTLRGLHVLAFRGQHALAFRGLHILPFRGLHALAFRRLHALAFTGLHVLIFRGLHILAFRGLHTLALKGLHALAMRGLHVLAFRELHVLTFRGLNVLAFRGLHVLAFKGLHNLAFKRLHALAMRGLQGCTPVAFRELLALTFRGLHVFPFRGLQVLAFQGLHVLIFRVLNVLAFRGLHVLAFRGQHALTFKGLHDLTFKRLQALAMRGLQVLAFRGLHVLTFRGLHILAF

SEQ ID NO: 180036 - protein, 386 aa, Glycine max
  Coding DNA Sequence Number=SeqID_88351
  Homolog annotation: Hit_ID=Q2HW90; Match level="QueryCoverage=98%, HitCoverage=98%, E-value=7e-30, Identity=39%"; Hit description =Putative uncharacterized protein
  Pfam annotation: Domain name=DUF1723; Domain location=48-97; Score =11.5; E_value=0.023; Accession=PF08330.1; Description=Protein of unknown function (DUF1723)
MDIPLRSTRKYLFKKTDLLRLRELASLVSDPVDFQTHHGKLLRILRVDVEEGCLETLVQFYDPLYHCFTFPDYQLVPTLEEYSYLVGLPVPDKIPFHGFEPTPKPSDIAAALHLKTSIIQANLTSKGGLQGLPTHFLYQQASIFAEAAMVSFHLPQSRAFKTNDDKLSWPRRIMTLDPSDIVWYQAASDVGEIIVSCGEYPNVPLWVCVAELATTRFSLDDNLDHSNKRERFAQAWSAIRRLNRSQLGKKSDYVHESYTQWVIDRTKSFGLPYRLPRYLSSTIPPSSLPIPFDTKEEFHEQLTKERQEKETWKRRCQELEQENETLKGKIAQQSRELFIQNQRMIEKDDLLRQKDALLHRDARRKRRFMDLFSRAHSDSEDPATPG

SEQ ID NO: 180037 - protein, 91 aa, Glycine max
  Coding DNA Sequence Number=SeqID_88352
VAVSPAKPADRPDPEVMWDAFLFGLFNSDFPLYIKHEDLSEIAHGGQCLSISVIQLWILKLHEELDAEFKTRCLPWSLPEWRILANGRHFA

SEQ ID NO: 180038 - protein, 106 aa, Glycine max
  Coding DNA Sequence Number=SeqID_88353
MAMRTKSYLTHTLLWKHKFQNFNCKCAVCLQPLSPLLSLFQPFFITQDEEVDAILPPKGIFSRKLLKEVSLVIRGVCVAKLKLLKEVFSKKLLKEVFSRKLLKEAT

SEQ ID NO: 180039 - protein, 373 aa, Glycine max
  Coding DNA Sequence Number=SeqID_88354
  Gene Ontology: Mol. function=kinase activity; Cellular component =cytoplasm; Biological process=coenzyme A biosynthetic process
  Homolog annotation: Hit_ID=A7P8S6; Match level="QueryCoverage=85%, HitCoverage=99%, E-value=1e-135, Identity=70%"; Hit description =Chromosome chr3 scaffold_8, whole genome shotgun sequence
  Pfam annotation: Domain name=DUF89; Domain location=120-370; Score= -120.8; E_value=0.016; Accession=PF01937.10; Description=Protein of unknown function DUF89
MGIVSVAPTQTVVYLVPRYPPSISTYLYASSLTKAKTIHQPTQSYVHSKSVETAIESTSQLVPFPLLTNGNYTACTIPWRFPSDDPSIPTPTELSWINLLLNTIPTFKKHAENDTSVPDAANKAENFAQRYARILEDFKKDPASQGRPLDILILCRLREQVLREQGFRDIFKKIKDVENANAISLFQNVVHLNDAIEDEGKRLENLVRGIFAGNIFDLGATQVIIFVDNSGADVILGILPFARELLRRGSQVILAANDLPSINDVTYSDLIEIIPKLKDEEGRLTGVSTSNLLIANSGNDLPVIDLTRVSQELAYLANDVDLVILEGMGRGIETNLYAQFKCDSLKIGMVKHPEVAEFLGSRLYDCVIKYDEV

SEQ ID NO: 180040 - protein, 65 aa, Glycine max
  Coding DNA Sequence Number=SeqID_88355
MKNAKIEPGTAVYKENRTLTTQQYSAVVEKTLAEEEKRLMKEAQIEYHTRIGRDSQRKHEGGEEI

SEQ ID NO: 180041 - protein, 400 aa, Glycine max
  Coding DNA Sequence Number=SeqID_88356
  Gene Ontology: Mol. function=transferase activity, transferring acyl groups, acyl groups converted into alkyl on transfer; Cellular component=chloroplast; Biological process=carboxylic acid metabolic process
  Homolog annotation: Hit_ID=Q30DX9; Match level="QueryCoverage=99%, HitCoverage=61%, E-value=1e-153, Identity=71%"; Hit description=2 -isopropylmalate synthase 1
  Pfam annotation: Domain name=HMGL-like; Domain location=89-377; Score= 351.2; E_value=1.7e-102; Accession=PF00682.10; Description=HMGL-like
  Subcellular localization annotation: CTP_CleavageSite=61; ConfidenceScore=5.84e-01
MATVIRNPILFPSTSHRPNQNHSNNTFLIFRFPQTSRSSLHSKSRFAFSCSQSEPPPPSPSASPRRRPPYIPNRIPDPSYVRIFDTTLRDGEQSPGASMTSKEKLDVARQLAKLGVDIIEAGFPAASKDDFEAVKMIAQEVGNAVDDDGYVPVICGLSRCNEKDIRTAWEAVKYAKRPRIHTFIATSAIHMEYKLRMSKDKVVDIARNMVKFARSLGCEDVEFSPEDAGRSDREFLYEILGEVIKAGATTLNIPDTVGITMPSEFGKLIADIKANTPGIENVIISTHCQNDLGLSTANTIEGARAGARQLEVTINGIGERAGNASLEEVRVHFLLPSLVQVVMALRCGAHVNGNLYTGINTKHIFLTSRMVEEYTGLQLQPHKALVGANAFAHESGIHQS

SEQ ID NO: 180042 - protein, 51 aa, Glycine max
  Coding DNA Sequence Number=SeqID_88357
MISAYIDRELVSEWVRRKRRKKEGGGVEEEEEAGVAGRVEDNVIEQVAEGD

SEQ ID NO: 180043 - protein, 45 aa, Glycine max
  Coding DNA Sequence Number=SeqID_88358
MAELRPNRRTPEEAQRKRRERKEGRNNKEKPKPGIEMGHPHKQRA

SEQ ID NO: 180044 - protein, 523 aa, Glycine max
  Coding DNA Sequence Number=SeqID_88359
  Gene Ontology: Mol. function=sugar:hydrogen symporter activity; Cellular component=integral to membrane; Biological process =carbohydrate transport
  Homolog annotation: Hit_ID=A2Q2S7; Match level="QueryCoverage=80%, HitCoverage=84%, E-value=1e-155, Identity=65%"; Hit description =General substrate transporter
  Pfam annotation: Domain name=DUF81; Domain location=145-408; Score= -70.7; E_value=0.053; Accession=PF01925.10; Description=Domain of unknown function DUF81
  Pfam annotation: Domain name=MFS_1; Domain location=79-452; Score =99.0; E_value=1.5e-26; Accession=PF07690.7; Description=Major Facilitator Superfamily
  Pfam annotation: Domain name=Sugar_tr; Domain location=69-501; Score =375.8; E_value=7.2e-110; Accession=PF00083.15; Description=Sugar (and other) transporter
  Pfam module annotation: Pfam domain module=DUF81::MFS_1::Sugar_tr; Domain location=145-408::79-452::69-501
MVGLEKKDGLTWSSCQLGALKLTKHEASVERGVRKSHIICLNSQGATYISVGQLHLMLIGFKMKSNRNLKWVKQQQANLYFTQKYFFFSLDLSNCELQETIVSMAVTGAIVGAAAGGWINDVYGRKKATLIADVIFTLGAIVMAAAPDPYILIIGRVLVGLGVGIASVTAPVYIAESSPSEIRGALVGINVLMITGGQFLSYLINLAFTQVPGTWRWMLGVSGVPAVVQFFLMLLLPESPRWLFIKNRKEEAITVLAKIYDFARLEDEVNLLTTQSEKDCQRRDGIRYWDVFKSKEIRLAFLAGAGLQAFQQFIGINTVMYYSPTIVQMAGFQSNELALLLSLIVAGMNAAGSVLGIYLIDHAGRRKLALYSLGGVIASLIILALSFFNQSSESGLYGWLAILGLALYIAFFSPGMGPVPWTVNSEVYPEEYRGICGGMSATVNWVSNLIVVQSFLSVAAAVGTGPTFLIIAIIAVLAFMFVVVYVPETKGLTFDEVELLWKERAWGKNPDAQSLLVRTENHS

SEQ ID NO: 180045 - protein, 319 aa, Glycine max
  Coding DNA Sequence Number=SeqID_88360
  Gene Ontology: Mol. function=transcription factor activity; Cellular component=nucleus; Biological process=regulation of transcription, DNA-dependent
  Homolog annotation: Hit_ID=A7PFT6; Match level="QueryCoverage=96%, HitCoverage=93%, E-value=2e-85, Identity=50%"; Hit description =Chromosome chr11 scaffold_14, whole genome shotgun sequence
  Pfam annotation: Domain name=AP2; Domain location=35-84; Score=34.0; E_value=5.4e-07; Accession=PF00847.11; Description=AP2 domain
  Pfam annotation: Domain name=B3; Domain location=156-267; Score=82.0; E_value=1.9e-21; Accession=PF02362.12; Description=B3 DNA binding domain
  Pfam module annotation: Pfam domain module=AP2::B3; Domain location =35-84::156-267
MIQTYKESSDCSEIKFAFDAVVKRARHEENNAAAQKFKGVVSQQNGNWGAQIYAHQQRIWLGTFKSEREAAMAYDSASIKLRSGECHRNFPWNDQTVQEPQFQSHYSAETVLNMIRDGTYPSKFATFLKTRQTQKGVAKHIGLKGDDEEQFCCTQLFQKELTPSDVGKLNRLVIPKKHAVSYFPYVGGSADESGSVDVEAVFYDKLMRLWKFRYCYWKSSQSYVFTRGWNRFVKDKKLKAKDVIAFFTWGKSGGEGEAFALIDVIYNNNAEEDSKGDTKQVLGNQLQLAGSEEGEDEDANIGKDFNAQKGLRLFGVCIT

SEQ ID NO: 180046 - protein, 298 aa, Glycine max
  Coding DNA Sequence Number=SeqID_88361
  Gene Ontology: Mol. function=nucleic acid binding; Biological process= regulation of transcription
  Homolog annotation: Hit_ID=A5AP98; Match level="QueryCoverage=84%, HitCoverage=83%, E-value=1e-92, Identity=65%"; Hit description =Putative uncharacterized protein
  Pfam annotation: Domain name=KH_1; Domain location=174-236; Score =57.2; E_value=5.5e-14; Accession=PF00013.20; Description=KH domain
  Pfam annotation: Domain name=zf-CCCH; Domain location=101-127; Score =34.9; E_value=3e-07; Accession=PF00642.15; Description=Zinc finger C- x8-C-x5-C-x3-H type (and similar)
  Pfam annotation: Domain name=zf-CCCH; Domain location=265-290; Score =41.2; E_value=3.7e-09; Accession=PF00642.15; Description=Zinc finger C-x8-C-x5-C-x3-H type (and similar)
  Pfam module annotation: Pfam domain module=KH_1::zf-CCCH::zf-CCCH; Domain location=174-236::101-127::265-290
MNQQEDQLEHEWWSLRLVVGGSVADWAEVSQTENRETLGRVEKKSTSGCPFGEGCHFLHYVPGGFKAVSQLINVGSNPVTPQVGRNPVPPSFPDGSSPPVVKTRLCNKFNTAEGCKFGDKCHFAHGEWELGRPTAPSYEDPRVLGQMPSSRVGGRVEPPHPAHGAAASFGASATAKISINASLAGAVIGKNGVNSKQICRVTGAKLSIRDHDTDPNLRNIELEGSFDQIKQASAMVHEVILNVSSASGPPMKSFTSQTSAPTSNFKTKLCENFAKGSCTFGERCHFAHGTDELRKSGM

SEQ ID NO: 180047 - protein, 504 aa, Glycine max
  Coding DNA Sequence Number=SeqID_88362
  Gene Ontology: Mol. function=sugar:hydrogen symporter activity; Cellular component=integral to membrane; Biological process =carbohydrate transport
  Homolog annotation: Hit_ID=Q8VZR6; Match level="QueryCoverage=93%, HitCoverage=92%, E-value=1e-149, Identity=56%"; Hit description =Probable inositol transporter 1
  Pfam annotation: Domain name=MFS_1; Domain location=42-433; Score =114.2; E_value=3.8e-31; Accession=PF07690.7; Description=Major Facilitator Superfamily
  Pfam annotation: Domain name=Sugar_tr; Domain location=38-482; Score =404.3; E_value=1.9e-118; Accession=PF00083.15; Description=Sugar (and other) transporter
  Pfam module annotation: Pfam domain module=MFS_1::Sugar_tr; Domain location=42-433::38-482
MVAEMGMGMSMRAGSSGYLEMHPERKITFFQNPYIVGITFAAGLGGLLFGYDTGVVSGALLYIKEDFELVRNSSFIQEVIVGMALIGAIFGAAIGGVINDHLGRKTATIIADICFGAGSVIMGLAGNPYVIIFGRFLVGLGVGSASVTAPVYIAEVSPSEIRGGLVSANTLMITAGQFLSFIVNYGLTRVPGTWRWMLGLSGFPAVLQFVLISFLPESPRWLYMKNRREEAILVLSKIYSSPRLEDEIKILDDLLLQEPESKASVKYTDVFTNKEIRVAFTFGAGLQALQQFAGISIIMYYSPTIIQMAGFKSNQSALFLSLIVSGMNAAGTILGIYLIDLAGRKKLALGSLSGVLVSLIILSTSCYLMGHGNTGQTLGWIAILGLALYILFFAPGMGPVPWTVNSEIYPEEYRGLCGGMSATVNWICSVIMSTSFLSVVDAIGLGESFIILLVVSVIAIVFVIFLMPETKGLTFEEVAYIWKERAYGRDKTTASLAEKEALSS

SEQ ID NO: 180048 - protein, 342 aa, Glycine max
  Coding DNA Sequence Number=SeqID_88363
  Gene Ontology: Cellular component=cytoplasm
  Homolog annotation: Hit_ID=O04237; Match level="QueryCoverage=100%, HitCoverage=100%, E-value=6e-75, Identity=47%"; Hit description =Transcription factor
  Pfam annotation: Domain name=HABP4_PAI-RBP1; Domain location=131-239; Score=149.6; E_value=8.6e-42; Accession=PF04774.6; Description =Hyaluronan  mRNA binding family
  Pfam annotation: Domain name=Stm1_N; Domain location=5-119; Score= -11.4; E_value=0.064; Accession=PF09598.1; Description=Stm1
  Pfam module annotation: Pfam domain module=HABP4_PAI-RBP1::Stm1_N; Domain location=131-239::5-119
MASMNPFDLLGDDAEDPSQQIVAEQLKAQLPTKPLPPSQAASKLLTSFVIVREARNVNSRGGRGSGRGRGRGGFNRDLFNDENSFAAPAGQVAFEGERPAYGGPPGPYRGSRGGGGRGAFGNGEAAEDGLPRRPFERRNGTGRGNEFKREGAGRGNWGVQTDEFAQATDEVNETSKNFGDEKPSGEDDVAAIGNKENPANEAEEKEPEDKEMTLEEYEKVLEERRKALQALKTEERKVDTKVFESMQQLSNKKDIDDIFIKLGSDKDKRRETLEKEDKSKKSVNINEFLKSPEGESYYNPGGHGRRHGRGRGARGGYGGYATANIPAPSIEDPGQFPTLGVK

SEQ ID NO: 180049 - protein, 71 aa, Glycine max
  Coding DNA Sequence Number=SeqID_88364
  Homolog annotation: Hit_ID=A9P9Y7; Match level="QueryCoverage=53%, HitCoverage=36%, E-value=2e-12, Identity=84%"; Hit description =Putative uncharacterized protein
  Pfam annotation: Domain name=Tryp_alpha_amyl; Domain location=14-71; Score=7.9; E_value=0.044; Accession=PF00234.13; Description=Protease inhibitorseed storageLTP f
NEYVSEAEADDSGCGIGGVLVVDFGEGTKHMQHLPCLCSYKNSPLLPSLGIDPKLALQLPAKCNLPHPPNC

SEQ ID NO: 180050 - protein, 109 aa, Glycine max
  Coding DNA Sequence Number=SeqID_88365
MVKPTPKKGKRKKGTMVIGEMGKEAGGRAFLAEQGGSEGGGVVVERSLLFAGRLRRLSGKVGTGTGSTNKRINRAGEKRTGGGTVASEASLGHGLRGRGGGGRGRGIHG

SEQ ID NO: 180051 - protein, 434 aa, Glycine max
  Coding DNA Sequence Number=SeqID_88366
  Gene Ontology: Mol. function=hydrolase activity, acting on carbon -nitrogen (but not peptide) bonds; Cellular component=cytosol; Biological process=histidine catabolic process to glutamate and formamide
  Homolog annotation: Hit_ID=A7QUT9; Match level="QueryCoverage=97%, HitCoverage=86%, E-value=1e-167, Identity=68%"; Hit description =Chromosome chr1 scaffold_180, whole genome shotgun sequence
  Pfam annotation: Domain name=Amidohydro_1; Domain location=69-417; Score=174.8; E_value=2.2e-49; Accession=PF01979.11; Description =Amidohydrolase family
  Pfam annotation: Domain name=Amidohydro_3; Domain location=69-415; Score=-50.2; E_value=0.00029; Accession=PF07969.2; Description =Amidohydrolase family
  Pfam module annotation: Pfam domain module=Amidohydro_1::Amidohydro _3; Domain location=69-417::69-415
MEREEEKEVVGVSVLHGGMIITMDEEQRVYRDGGIVVEHDKIKAIGQSADILAEFSDVADSIVDLSGHILLPGFINTHVHSSQQMARGIADDVDLMTWLHERIWPYESNMSEQDSYLSTLLCGIELIHSGVTCFAEAGGQHVSGMARAVGLLGLRACLTQSTMDSGHGLPPSWATRTTHQCIQSQKDNYHKYHNTAQGRIRIWFAIRQIMNSTPRLLIQTRDAATQLNTGIHMHVAEIPHENQLVMDVHKIDHGTVTYLDKINFLQNNLLAAHSVWIDNNEISLLSRAGVKVSHCPAAAMRMLGFAPVREMLDAGICVSLGTDGAPSNNRMSIDCTSNPHQTVKLRESLARMENTGQYTFYKIPRRGVYANGTTDPTALPAETILRMVTVNGAKSVLWDDELGSLEVGKKADIVVVDPSSWSMVPVHDWYELIT

SEQ ID NO: 180052 - protein, 175 aa, Glycine max
  Coding DNA Sequence Number=SeqID_88367
  Homolog annotation: Hit_ID=A2Q4S5; Match level="QueryCoverage=39%, HitCoverage=10%, E-value=2e-08, Identity=41%"; Hit description=IMP dehydrogenase/GMP reductase, putative
MKGIKGAPYRGRLGALTITDVSWLPYSEHQVVRGFQLISCYQGQLRWGHVVVYVRPKQVLRQFGYIQTIPSPPISHPFVTPTQKGDEPRQLAAPDVDAYVEPHVLEVPVTDDLSRHSVVSCEGCEAIAERLKRMLNLKMVIAGTKLHEIMKDCLLLAKGEASNGSLRMQRRQRID

SEQ ID NO: 180053 - protein, 129 aa, Glycine max
  Coding DNA Sequence Number=SeqID_88368
  Homolog annotation: Hit_ID=A7QT59; Match level="QueryCoverage=79%, HitCoverage=20%, E-value=1e-46, Identity=85%"; Hit description =Chromosome chr1 scaffold_166, whole genome shotgun sequence
MAIGVGSGTSTMYQMALECTCRYIKSPGDPKFMEAFELSPEESEDVLFKEAWLTYFWRRAKAHGIEEDIAKERLRFWIGRSGHSPTSHDAVDAEQGLSELRKLGIEHRLWEASRKEVDQDFTIARKLLT

SEQ ID NO: 180054 - protein, 72 aa, Glycine max
  Coding DNA Sequence Number=SeqID_88369
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=UPI000045BC60; Match level="QueryCoverage =93%, HitCoverage=81%, E-value=3e-14, Identity=61%"; Hit description =COG1511: Predicted membrane protein
  Subcellular localization annotation: CTP_CleavageSite=45; ConfidenceScore=5.65e-01
MAWDLGFRVQGSGFRVQGSGFRVQGSGFRVQGSGFRVQGLGFRVQGSGFRVQGSGFRVQGLGFRVQGSGFRV

SEQ ID NO: 180055 - protein, 172 aa, Glycine max
  Coding DNA Sequence Number=SeqID_88370
  Homolog annotation: Hit_ID=Q8LEK1; Match level="QueryCoverage=78%, HitCoverage=75%, E-value=2e-36, Identity=60%"; Hit description =Putative uncharacterized protein
  Pfam annotation: Domain name=Cupin_3; Domain location=103-169; Score =71.1; E_value=3.7e-18; Accession=PF05899.3; Description=Protein of unknown function (DUF861)
  Subcellular localization annotation: CTP_CleavageSite=23; ConfidenceScore=5.66e-01
MASSFVGTLLPNHFTQTKHSAVPASRSGAPRRRRVHLATTRAETMTTVIEKLGIKIERNPPESKLTQLGVRQWPKINKPEIFAATDSWFGDVKVNSRHRRHRHHRHRHRYCKFPWTYEAKETCYLLEGKVKVFPSGSNESVEIAAGDLVVFPKGMSCTWDVSVGVDKHYNFE

SEQ ID NO: 180056 - protein, 284 aa, Glycine max
  Coding DNA Sequence Number=SeqID_88371
  Gene Ontology: Mol. function=nucleoside-triphosphatase activity; Cellular component=intracellular; Biological process=protein transport
  Homolog annotation: Hit_ID=A5AH95; Match level="QueryCoverage=100%, HitCoverage=34%, E-value=1e-107, Identity=72%"; Hit description =Putative uncharacterized protein
MVNVPERGARKHPRGDNIQIDTKNILFICGGAFIDLEKTISERRQDSSIGFGSPVRSNMRTGGVTNAAVTSSLLESVESADLIAYGLIPEFIGRFPILISLSALTEDQLMQVLTEPKNALAKQYKKLFNMNNVKLHFTEKALRLIAKKAMAKNTGARGLRALLESILTEAMFEIPDVKAGNELIGAVVVDEESVGSVNAPGCGGKILCGDGALELYLAKMEDLFFCAGCLSKLPCEIPANRGFHTDVFHSFATVMNYENVANGAVAEPDLQEGESEISSRAVSM

SEQ ID NO: 180057 - protein, 354 aa, Glycine max
  Coding DNA Sequence Number=SeqID_88372
  Gene Ontology: Mol. function=protein dimerization activity; Cellular component=cellular_component; Biological process=alkaloid metabolic process
  Homolog annotation: Hit_ID=Q06YR2; Match level="QueryCoverage=99%, HitCoverage=99%, E-value=1e-133, Identity=66%"; Hit description=IOMT 4
  Pfam annotation: Domain name=Dimerisation; Domain location=30-78; Score=80.7; E_value=4.9e-21; Accession=PF08100.2; Description =Dimerisation domain
  Pfam annotation: Domain name=Methyltransf_2; Domain location=87-331; Score=337.4; E_value=2.5e-98; Accession=PF00891.9; Description=O -methyltransferase
  Pfam module annotation: Pfam domain module=Dimerisation::Methyltransf_ 2; Domain location=30-78::87-331
MGSMNNQNAMELFEGQALLYMQLQGHLRTTCLKWAVQLGIPDIIQNHSKPITLSNLVSTLQIPPSKACFVQRFMRFLAHNGIFDIHERQEDHEPTYALTSASKLLVSGSDHCLSPMVLLKTDQLLTSTFHQLGEWTRGEDATLYETAFGTNIWEFFEKTPAYFSLFNEAMASDSRMVDLALKNCTSVFEGLDSMVDVGGGTGTTARIICDAFPKLKCVVFDLPHVVANLLGTNHLSFIGGDMFNSIPQADAVLLKWILHNWNDENCIKILEKCRDSISSKGNKGKVIIIDAVINEKLDDPDVTQAKLGLDIIMSAMNGKERSEKEWKQVFMEAGFKHYKIFPIFGFRSLIELYA

SEQ ID NO: 180058 - protein, 73 aa, Glycine max
  Coding DNA Sequence Number=SeqID_88373
MLTKHIKNFVPHCPEALRYAKRDHPGHDVACKSDCIMPCLQVLEGEAYCYCLHFEMDCKGVVDSIHSATEEFS

SEQ ID NO: 180059 - protein, 114 aa, Glycine max
  Coding DNA Sequence Number=SeqID_88374
  Homolog annotation: Hit_ID=A7Q805; Match level="QueryCoverage=97%, HitCoverage=32%, E-value=1e-13, Identity=38%"; Hit description =Chromosome chr18 scaffold_61, whole genome shotgun sequence
MKFLLKGSNLVGMEKVSLVCRILNVHGTMREHVKLVHSVVRVELNELEGDEFALRGLGECSYARGRNNLESIGSDDLRLSLGGIFGRECPTDAYLSSGYYAVLNLTFGKNYDES

SEQ ID NO: 180060 - protein, 394 aa, Glycine max
  Coding DNA Sequence Number=SeqID_88375
  Homolog annotation: Hit_ID=A7QR03; Match level="QueryCoverage=92%, HitCoverage=39%, E-value=7e-84, Identity=52%"; Hit description =Chromosome undetermined scaffold_147, whole genome shotgun sequence
MENGHDGKLADKFSGLNINQHAQQHVHDQSNLSSNNNDNLYQVMKAVEAAEATIKQQVVLWIQHVLRYNGHGSSPFLLPWEIADKCGRCCHSCGCVNALSCSGSFMLVEENSRLRSELLSKIQELEKYRQEDSVDQKSRLAAQWKEQEHGSYEARQSAPSIARSNTGDHSENSQINGTLRVQPNDQLPMDNTGYSQLSSPSTRSVSPSRLLPEGDLDSRFNSPRQGLMPVVETNSNNNSLLKQDLAINKVREHEEEIILLRKRLADYSVKEGQIRNEKYVLEKRIAYMRLAFDQQQQDLVDAASKALSYRQDIIEENIRLTYALQDAQQERSTFVSSLLPLLAEYSLQPPVPDAQSIVSNVKHLHVYPTNMAPGCNLTLSLLLPRRKILEAKLL

SEQ ID NO: 180061 - protein, 506 aa, Glycine max
  Coding DNA Sequence Number=SeqID_88376
  Gene Ontology: Mol. function=identical protein binding; Cellular component=nucleus; Biological process=phospholipid metabolic process
  Homolog annotation: Hit_ID=A7QR17; Match level="QueryCoverage=92%, HitCoverage=95%, E-value=1e-136, Identity=55%"; Hit description =Chromosome undetermined scaffold_147, whole genome shotgun sequence
  Pfam annotation: Domain name=SET; Domain location=16-293; Score=50.6; E_value=5.6e-12; Accession=PF00856.19; Description=SET domain
MASRRLRAFKRWMKSKGLEWSDALEFVDTPEEGVEVRALCQLKEGDVVAKMPKEACLTTKTSGARKIIEEAGLDGHLGLAFAIMYERSLDGDSPFAGYLQLLPHQECVPIVWTLDEVNELLCGTELHQTVQEDKALIYDDWKENILPLLDLAPLKLNPKFFGVEQYFAAKSLISSRSFEIDDYHGFGMVPLADLFNHKTGAEDVHFTAMSSNDESDTDVDGCNDDEGIVKEETLAQNSSIDMTVLNNGNCNVSDSDSSSVSDGDTSMLEMIMIKDVSSGTEVFNTYGLLGNAALLHRYGFTEQDNSYDIVNIDMELVLQWCTSVFSDRHSRARVSLWRKLGYSACGSQNSEYFEISFDGEPQIELLVLLHIMLLPDNAYHKLDLSVAGNCDESSGTTFLNGNIFPSKAFNMSKKSLLPKKVCDVLSSLADMRESLYGLKSIEDDIEALGRCSLVRERKLYHSLMLRINERKILQRLRNYASQPFKNKITNHSSPRKKLKRTTKKTS

SEQ ID NO: 180062 - protein, 311 aa, Glycine max
  Coding DNA Sequence Number=SeqID_88377
  Homolog annotation: Hit_ID=A7QR16; Match level="QueryCoverage=100%, HitCoverage=47%, E-value=1e-144, Identity=77%"; Hit description =Chromosome undetermined scaffold_147, whole genome shotgun sequence
  Pfam annotation: Domain name=Rxt3; Domain location=4-84; Score=48.8; E_value=1.9e-11; Accession=PF08642.1; Description=Histone deacetylation protein Rxt3
MWKEREHQWSEGNLVKCSIGVRGGQLWGTDVYTYDSDLVAGYCRPTASPPHAAIQELRATVRVLPPQDCYISTLRNNVRSRAWGAAIGCSYRVERCCIVKKGGGTIDLEPCLTHTSTIEPTLAPVTVERTMTTRAAASNALRQQRFVREVTIQYNLCNEPWIKYSISTVADKGLKKPLYTSARLKKGEVLYLETHLSRYELCFTGEKMLKVTPAAPLHDPATEKSQNHHPHSANGEKNDCENVMIDAFRWSRCKKPLPQKLMRTIGIPLPLEHIEVLEENLDWEDVQWSQAGVWIAGKEYTLARVHFLSMN

SEQ ID NO: 180063 - protein, 29 aa, Glycine max
  Coding DNA Sequence Number=SeqID_88378
MASLYPGSISVAQPFRLVLMILASIMCGG

SEQ ID NO: 180064 - protein, 76 aa, Glycine max
  Coding DNA Sequence Number=SeqID_88379
MSKSIRPTKTRKLDEVIHKVNAKFDSKRKQKRVVKKYTSGSFLTAAGVSYFCFSRLCKLTAPFIAALVPQDLVVEL

SEQ ID NO: 180065 - protein, 97 aa, Glycine max
  Coding DNA Sequence Number=SeqID_88380
MGLSLRLRLGHSFSNTAEGSSGRWEHQGSSESTSFTAFRSLFKLPSLPFAGIDDNNLPHQPSTEGEVAQRKGRQCAVVAHDVGWKTMFNEKDETFSP

SEQ ID NO: 180066 - protein, 136 aa, Glycine max
  Coding DNA Sequence Number=SeqID_88381
  Gene Ontology: Mol. function=transporter activity; Cellular component= integral to membrane; Biological process=transport
  Homolog annotation: Hit_ID=P23958; Match level="QueryCoverage=88%, HitCoverage=48%, E-value=2e-47, Identity=69%"; Hit description =Probable aquaporin TIP-type alpha
  Pfam annotation: Domain name=MIP; Domain location=1-105; Score=13.8; E_value=1e-10; Accession=PF00230.11; Description=Major intrinsic protein
PQGFSVSIGLGAFHGLILEIALTFGLMYTVYATAIDPKRGSIGSIAPLAIAFVVGANILAGGPFDGACMNPARAFGPAMVGWRWHYHWIFWVGPLIGAALAALLYEYVMVPIEPPHHQPLAVHICNFFDAGLKYQH

SEQ ID NO: 180067 - protein, 393 aa, Glycine max
  Coding DNA Sequence Number=SeqID_88382
  Homolog annotation: Hit_ID=A7PAY0; Match level="QueryCoverage=78%, HitCoverage=68%, E-value=1e-127, Identity=74%"; Hit description =Chromosome chr16 scaffold_10, whole genome shotgun sequence
MEALKSGFANLRHLNAIAANTIGSFGSELDWIAIGCLTLFCSIAATLPVHNFDLTSELPEQTTRYSTQDMGCFVSTPKDSGGNRRRPGSIGEVSVYVPGLRIPKPVDFAQSLGDYLSKNIVERLSALRTRIVVMAGQEGPTITRTKRKSATQHGGSTLADLQQALEDYLLVLLGLVENGSHLQYKVQFAWVNQEDEAEETTMSNAWYEVLSVLHLMAMLLLSQSDLLLLPRTSTDGHQPKVSEESRRASVDIFLKAAGYLDCAVRHVLPQLPGELRRNLPVDLAEGVLRALCLQALGQGVDIQLGMAIDSTKATLAVKRRLACEMVKYWQQPFSPKTKLCFNSIYRAQDNIMNLPLANGWGEKHCLFVKWKYIEAKRLKSEILVQADGDVFEE

SEQ ID NO: 180068 - protein, 310 aa, Glycine max
  Coding DNA Sequence Number=SeqID_88383
  Gene Ontology: Mol. function=binding
  Homolog annotation: Hit_ID=A7QJ66; Match level="QueryCoverage=94%, HitCoverage=58%, E-value=1e-134, Identity=83%"; Hit description =Chromosome chr2 scaffold_105, whole genome shotgun sequence
MMWAFFQLPQAVHLEDKAFYNWAIAISDRAKMRGRTKEAEELWKLATRNYEKAVQLNWNSPQALNNWGLALQELSGIVPAREKQKIVRTAISKFRAAIQLQFDFHRAIYNLGTVLYGLAEDTLRTGGSVSAQEVSPNELYSQSAIYIAAAHALKPNYSVYSSALRLVRSMLPLPHLKVGYLTAPPVGASIAPHNDWKRSEFLLDHEKLQQIPRGEYKQVPPQNLSGRLVDAVSGDKKTIKVDIADIISVSACADLTLPPGAGLCIDTSYGSVYLVADSWESLDGWLDALRLVYTIYVRGKSDVLAGIITG

SEQ ID NO: 180069 - protein, 122 aa, Glycine max
  Coding DNA Sequence Number=SeqID_88384
  Subcellular localization annotation: CTP_CleavageSite=35; ConfidenceScore=5.13e-01
MAEVVGGDDNGFVVKSLTQVKSRLREDARPCRSVSDTLVRSLTQQSNALTRAKSSCSGSDDGGGMVEAIMVVVAQRGVIVVTMTVTVVVVVEWWQRRMCGDGSDDGSGCSGMVAVKATMMGW

SEQ ID NO: 180070 - protein, 426 aa, Glycine max
  Coding DNA Sequence Number=SeqID_88385
  Homolog annotation: Hit_ID=A7QJ33; Match level="QueryCoverage=74%, HitCoverage=80%, E-value=1e-137, Identity=74%"; Hit description =Chromosome chr2 scaffold_105, whole genome shotgun sequence
MAEDQGAEFVSYDTIKGEWKIKVKHFSIYKLIPSFMDIITDLAMFITPLWIAVIVGVVVGWAWKPKWAFHPKDALLKFRSPRPPNPQNDTAFTYSATSSSAREKDASGSPVVTEDDLLHLWKLVEEKDGGRAWIQMMDRSTPTMTYQAWRRDPESGPPQYRSRTVFEDASPELVRDFFWDDEFRLKWDDMLIHASTIQECVLTGTMMVHWVRKSHVDLVQFCLQFPFFCSDREYIIGRRIWDAGRIYYCVTKGVPCPSMPRHNKPKRVDLFYSSWCIRAVKSRKDDQLTSCEVLLFHHEDMGIPWEIAKLGVRQGMWGAVKKFDPGLRTYEKQRVSGTPLSPCARAAKINTKVTMDYVRSLENTTSDLLETENQDSSDKPGGRNIPKLLIVGGAIALACTLDQGLLTKAVIFGVARRFAKMGGRRL

SEQ ID NO: 180071 - protein, 619 aa, Glycine max
  Coding DNA Sequence Number=SeqID_88386
  Gene Ontology: Mol. function=DNA binding; Cellular component=nucleus; Biological process=embryonic development ending in seed dormancy
  Homolog annotation: Hit_ID=UPI00000529F6; Match level="QueryCoverage =94%, HitCoverage=46%, E-value=0.0, Identity=58%"; Hit description =transcription factor jumonji (jmj) family protein / zinc finger (C5HC2 type) family protein
  Pfam annotation: Domain name=JmjC; Domain location=404-520; Score =237.3; E_value=3.3e-68; Accession=PF02373.13; Description=JmjC domain
  Pfam annotation: Domain name=JmjN; Domain location=148-207; Score =70.5; E_value=5.7e-18; Accession=PF02375.8; Description=jmjN domain
  Pfam module annotation: Pfam domain module=JmjC::JmjN; Domain location=404-520::148-207
MGTELMRICVKEDNDDFPSVPPGFESYTSFSLKKVENNEKQDDKNMTSCSASTSASESPSTQAENDVQVGDTAKVPRSLRRRPWINYGQYENISDEDPDCERHDQNFSSRPCLPRGVIRGCPDCSNCQKVVARWRPEDARKPNIEDAPVFYPTEEVSFNSYDTFEFTSVHEFQDTLKYISSIRSKAEPYGICRIVPPSSWKPPCPLKEKSIWEGSKFSTRVQRIDKLQNRDSMRKMSKIQTNMKRKRRRCTRMGVDNSTRTGPNAGFCEVERFGFEPGPEFTLETFQRYAEDFQLKYFRKNENVSHLGANTTILNGTSEPSVENIEGEYWRMVESPTEEIEVLYGADLETGIFGSGFPSKSSQVGSASHEQYIKSGWNLNNFARLPGSLLSYESSDISGVLVPWLYVGMCFSSFCWHVEDHHLYSLNYLHWGAPKMWYGVPGKDACKLEEAMRKHLPELFEEQPDLLHKLVTQLSPSILKSKGVPVYRCIQNPGDFVLTFPRAYHSGFNCGFNCAEAVNVAPVDWLPHGHIAIELYQEQGRKTSISHDKLLLGAAREAVQAQWELDLLKKNTLDNLRWKDVCGKDGLLAKALKLLENLMIHNTNPMIKPIDFYSKMNLK

SEQ ID NO: 180072 - protein, 995 aa, Glycine max
  Coding DNA Sequence Number=SeqID_88387
  Gene Ontology: Mol. function=inositol or phosphatidylinositol phosphatase activity; Cellular component=integral to membrane; Biological process=response to abscisic acid stimulus
  Homolog annotation: Hit_ID=A7QXS3; Match level="QueryCoverage=79%, HitCoverage=77%, E-value=0.0, Identity=72%"; Hit description =Chromosome undetermined scaffold_229, whole genome shotgun sequence
  Pfam annotation: Domain name=Exo_endo_phos; Domain location=586-968; Score=83.1; E_value=9.1e-22; Accession=PF03372.14; Description =EndonucleaseExonucleasephosphatase family
  Pfam annotation: Domain name=WD40; Domain location=212-250; Score =5.5; E_value=6.6; Accession=PF00400.23; Description=WD domain, G -beta repeat
  Pfam annotation: Domain name=WD40; Domain location=269-306; Score =11.5; E_value=1.2; Accession=PF00400.23; Description=WD domain, G -beta repeat
  Pfam annotation: Domain name=WD40; Domain location=481-517; Score =1.3; E_value=22; Accession=PF00400.23; Description=WD domain, G-beta repeat
  Pfam module annotation: Pfam domain module=Exo_endo_phos::WD40::WD40:: WD40; Domain location=586-968::212-250::269-306::481-517
MIVRIVVIGTGVRCLISAGILLGLSVRLCFHSLTSHTFPNFDSMDPSSSPLRQNDVASFDRQTSSRIYLHSSSSDDDVSPSHSIQSTNRRLDYMLQFLDRKLSSDHAHRRHSSGSRAAQLPEFVAKGGGAGIFRLPARGAVHPARPPSLELRPHPLRETQIGRFLRNIVSTESQLWAASECGVRFWNFKDLYASWCGVGEEEGVVARNGDEESAPFRESVWTSPTLCLVADEGNRLVWSGHKDGKIRCWKMDDDDDDNNNNNCDWSNRFTESLSWHAHRGPVLSLTFTSYGDLWSGSEGGGIKIWPLEAVEKSIHLTKEERHSAAIFVERSYVDLRSQLSTNGFSNMLTSDVKYLVSDNSRAKVWSAGYFSFALWDARTRELLKVFNSDGQIENRLDVSSIQDFSVELISSSRKDKTQSSIGFFQRSRNAIMGAADAVRRVAAKGGFGDDNRRTEALVVTIDGMIWTGCTSGLLVQWDGNGNRIQDFLYHSSSIQCFCTFGMQIWVGYVSGTVQVLDLKGSLIGGWVAHGSPIVKMTVGAGYVFALANHGGIRGWNITSPGPLDSILRSELGGKEFLYTKIENIKILSGTWNVGQGKASLDSLTSWLGSVASDVSLVVVGLQEVEMGAGFLAMSAAKETGSSVGQWWLDMIDKTLDEGSTFERIGSRQLAGLVIAVWVKTNIRFHVGDVEVAAVPCGFGRAIGNKGAVGLRIRVYDRIMCFVNCHFAAHLDAVGRRNADFDHVYRTMSFSRPTNLLNTTAAGTSSSVPTFRALILEIGFQSAEGMPELSEADMVVFLGDFNYRLDDISYDEARDFVSQRCFDWLRERDQLRAEMEAGNVFQGMREAIITFPPTYKFERHQVGLAGQSTVTGDQKATNHQLRGSFGFPRWLEVSPATGIIRPDQIVEVSVHHEEFQTLEEFVDGVVQNSWCEDSRDKEAILVVKIAPGISKELYYTDLISNHSAVPVMWLTSYRNCIALESAVNGACGPTCNHPAD

SEQ ID NO: 180073 - protein, 512 aa, Glycine max
  Coding DNA Sequence Number=SeqID_88388
  Gene Ontology: Mol. function=protein kinase activity; Cellular component=centrosome; Biological process=protein amino acid phosphorylation
  Homolog annotation: Hit_ID=Q0WL65; Match level="QueryCoverage=100%, HitCoverage=63%, E-value=1e-151, Identity=60%"; Hit description =Putative uncharacterized protein At2g40730
  Pfam annotation: Domain name=HEAT; Domain location=105-141; Score =14.2; E_value=0.2; Accession=PF02985.13; Description=HEAT repeat
  Pfam annotation: Domain name=HEAT; Domain location=144-180; Score =14.1; E_value=0.21; Accession=PF02985.13; Description=HEAT repeat
  Pfam annotation: Domain name=HEAT; Domain location=223-259; Score =17.6; E_value=0.046; Accession=PF02985.13; Description=HEAT repeat
  Pfam annotation: Domain name=HEAT; Domain location=66-102; Score =13.5; E_value=0.26; Accession=PF02985.13; Description=HEAT repeat
  Pfam module annotation: Pfam domain module=HEAT::HEAT::HEAT::HEAT; Domain location=105-141::144-180::223-259::66-102
MEILSLKDSVEKDTFFRKLPNLAEQLPQQIVLKKLLPLLASALEFGSASAPALTALLKMGSSLSAEEFRVKVLPTIVKLFASNDRAIRVGLLQHIDQFGESLSAQVVDEQVYPHVATGFSDTSAFLRELTLKSMLILAPKLSQRTFSGSLLKHMSKLQVDEEPAIRTNTTILLGNIASHLNEGTRKRVLINAFTVRALRDTFPPARGAGIMALCATSSYYDITEIATRILPNVVVLTIDLDSDVRSKAFQAVDQFLQMAKQHYEKDCCHGHTAEDLPNTNTAEATEGTAIGISSLPGNAGLLGWAMSSLTLKGKPSDHAPVASVSSSARTPTSSNASPAVDAPSTAPVRVSSTPDFAEHLVPTSPTSTDGWGELENGLGENDKDGWDDLEPLEEIKPTPALVNIQAAQRRPVSQPVSQIKQASSLLSKSTPKLSKDEDGDLWGSIAAPAPKSSKPLSLKSTVTDDDDPWASIAAPAPTTKAKPLSAGRGRGAKLAAPKLGAQRINRTTSSGM

SEQ ID NO: 180074 - protein, 488 aa, Glycine max
  Coding DNA Sequence Number=SeqID_88389
  Homolog annotation: Hit_ID=A7QCA1; Match level="QueryCoverage=78%, HitCoverage=92%, E-value=1e-117, Identity=55%"; Hit description =Chromosome undetermined scaffold_77, whole genome shotgun sequence
  Pfam annotation: Domain name=DUF707; Domain location=164-487; Score =394.1; E_value=2.2e-115; Accession=PF05212.3; Description=Protein of unknown function (DUF707)
MTLLVIWAVLSTLLVDLTKHHAQRCGWEAKQDLHFADDGIREDVGAMREVFHLGCEGVDWASMRAKGGGERMVARGEGGDGGGIKKKGKEEYGRGIENEKAFSVADTKSRKSCLYAIFPAASLICVVLFFMTSAFTQEPKLSSWKMDTAVDADQNVIVDPVIDKCKNQCRPSGSEALPAGIVSITSNLELRPLWNPPMPKKGRHTIELKVNASTNLFAMVVGIKQKDLVNKMVKKFIDSNFVVMLFHYDGIVDEWKDLEWSSRVIHVSAIDQSKWWFAKRFLHPDIVAEYDYIFLWDEDLGVEHFHPDKYVSIIKREGLEISQPALDPKKSEVHHQITARGRRSSVHRTYRASNDGKGCDKSSTAPPCTGWIEMMAPVFSRAAWRCVWYMIQGDRTKKVGVVDAEYIVHYNRPTLGGIDKTMHTSYLACVSLILSSLKLRLICDLQVSSQEKDHRVDVRRLSYQELDIFRKRWEKAVEEDKCWVDPFQ

SEQ ID NO: 180075 - protein, 141 aa, Glycine max
  Coding DNA Sequence Number=SeqID_88390
  Gene Ontology: Mol. function=phosphoric monoester hydrolase activity; Biological process=dephosphorylation
  Homolog annotation: Hit_ID=A7R256; Match level="QueryCoverage=39%, HitCoverage=26%, E-value=9e-17, Identity=67%"; Hit description =Chromosome undetermined scaffold_404, whole genome shotgun sequence
  Pfam annotation: Domain name=Y_phosphatase2; Domain location=28-125; Score=-32.9; E_value=0.0015; Accession=PF03162.4; Description =Tyrosine phosphatase family
  Subcellular localization annotation: CTP_CleavageSite=25; ConfidenceScore=5.42e-01
MARLLSQPMFRHRMTMAPRRYSCRRSTSSWSTTALIFRVGFPDSANFEFLKSLRLRYVICLCPEPYPETTFEFFKANGIRLYQFGINGCKQMKLLIGTTEVMRRKESFLLLQPMSLEINKYIFLINYGKGGRISFVWVYGG

SEQ ID NO: 180076 - protein, 288 aa, Glycine max
  Coding DNA Sequence Number=SeqID_88391
  Gene Ontology: Mol. function=ammonium transmembrane transporter activity; Cellular component=membrane; Biological process=transport
  Homolog annotation: Hit_ID=Q7Y1B9; Match level="QueryCoverage=71%, HitCoverage=57%, E-value=4e-65, Identity=76%"; Hit description =Ammonium transporter
  Pfam annotation: Domain name=Ammonium_transp; Domain location=1-256; Score=-1.6; E_value=4.8e-11; Accession=PF00909.12; Description =Ammonium Transporter Family
MGASPSGDYSFFLYQWAFAIAAAGITSGTIAERTQFVAYLIYSSFLTGLVYPIVSHWFWSSDGWASAARSNGNVLFGSGVIDFAGSGVVHMVGGIAGMWGALIEGPRIGRFDRTDRSVALRGHSASLVVLGSFLLWFGWYGFNPGSFITIAKGIMLAAKVEYDDPLEAAQLHGGCGAWGVFFTRLFAKRVYMEEICGVGRPFGALMGGAGDSDIGGVRVGHGDHGGVVQKMNLLRISRDEIGEGIVLSTLVAAFTVTTWTRRSIEHGRGNPNWRRGTGRSKNMMKLEK

SEQ ID NO: 180077 - protein, 304 aa, Glycine max
  Coding DNA Sequence Number=SeqID_88392
  Homolog annotation: Hit_ID=A7PZ32; Match level="QueryCoverage=83%, HitCoverage=84%, E-value=7e-88, Identity=65%"; Hit description =Chromosome chr4 scaffold_39, whole genome shotgun sequence
  Subcellular localization annotation: CTP_CleavageSite=52; ConfidenceScore=5.52e-01
MVSASLQFWSWIAPTPISHRYTHKFASLTSLKLATPVSSTNTVYLPKPLVVRFALTESDSPKSIEPDPQTLLQEIADSFDLPSDYFSKLPGDLRLDLNDAAFDLSNGPVLDECGQELGETLLNLSRAWELADTSTSHSLVKKLPLIEAKLTGYAKSALGKRLVSAGRRFQSMGQYGQGELQKIAKAMIAAGRVLTASSTSAVIVEEPKEEARFGELQVEVTPDKANIGAVIGFLFGILCWQIARGVQNVPDSSLQYANDNALLLAKSLKGALLAIFYSSTFLSAFTSVGLVLLGLQLKSKKNKD

SEQ ID NO: 180078 - protein, 766 aa, Glycine max
  Coding DNA Sequence Number=SeqID_88393
  Gene Ontology: Mol. function=two-component response regulator activity; Cellular component=endoplasmic reticulum membrane; Biological process=two-component signal transduction system (phosphorelay)
  Homolog annotation: Hit_ID=A7QMR7; Match level="QueryCoverage=96%, HitCoverage=98%, E-value=0.0, Identity=65%"; Hit description =Chromosome undetermined scaffold_127, whole genome shotgun sequence
  Pfam annotation: Domain name=GAF; Domain location=191-340; Score =52.9; E_value=1.1e-12; Accession=PF01590.17; Description=GAF domain
  Pfam annotation: Domain name=HATPase_c; Domain location=488-615; Score=3.3; E_value=0.036; Accession=PF02518.17; Description =Histidine kinase-, DNA gyrase B-, and HSP90-like ATPase
  Pfam annotation: Domain name=HisKA; Domain location=376-441; Score =35.3; E_value=2.2e-07; Accession=PF00512.16; Description=His Kinase A (phosphoacceptor) domain
  Pfam annotation: Domain name=Response_reg; Domain location=640-756; Score=78.9; E_value=1.6e-20; Accession=PF00072.15; Description =Response regulator receiver domain
  Pfam module annotation: Pfam domain module=GAF::HATPase _c::HisKA::Response_reg; Domain location=191-340::488-615::376 -441::640-756
MEITPPPLLLLFLLLLFFLCYLVLCASATDVDFDNCNCDDGEGIWSIHSILVGQKVSDFFIAVAYFSIPIELLYFVSRSNVPFKLLFLQFIAFIVLCGMTHLLNAYSYHGPPSFQLLLSLTVAKFLTALVSCATALTLPPLIPLLLKIKVRELFLRQNVMELGQEVGMMKKQKEASWHVRMLTREIRKSLDKHNILYTTLVELSKALDLHNCAVWMPNEDRREMHLTHELKTNSAKNFQNSIPVNDPDVLEIRKTKGVKILRPDSAIGAASSGGSAELGAVAAIRMPLLHVSNFKGGTPQLVETCYAILVLVLPSSSTRVWTYHEMEIVEVVADQVAVALSHASVLEESQQMRQKLEERNRALQQAKKNAMMASQARKSFQEVMSHGMRRPMHSILGMLSLFQEDNLRSEQKIIGDTMLKVGHVLSSLINDVMEISENEKGGFRLEMKPFLLHSMMREAASIAKCLCVYEGFGFEIDVQKSLPETVMGDEARTFQVILHMIGYLLNMNDKGTLNFRVFLESDGGDRDDKNIGIWRSSSQNEYVHIKFDFQITESSQSDKAISTIHYSSRRQYYNNEPKEGLSFSMCKKLVQMMQGNIWISPNSLGLVQGMTLLLKFQIGPSLGKSIFAPKDYSSSQFRGLKVLLAEDDGVNRTVTKKLLEKLGCQVIAVSSGFECLSAISGAGNSFRIILLDLHMPEMEGFEVAKRIRKFHSRSWPLIIALIASAEEHVREKCLLAGMNGLIQKPIVLHQIANELRTVLQRAGEKL

SEQ ID NO: 180079 - protein, 222 aa, Glycine max
  Coding DNA Sequence Number=SeqID_88394
MSDLGLWPLPLLLIANTSRLCLKIANIAQAADEGVEAAPGLSERAGTRGRWVGETEERAWVVVNLSLPELVEVVEEFQHVRAAAKGQGEWGTVVPQVLAEGVPVPSLLVLVAARSSSAPAIVASRRRRRHRRRRWIRGWRLHLVPAAGPDEIGKERLPEKSGGVAGKGRPRREQPGQMVAKKDVGVVVIGMIPGERENRRLHEGEEAVVPKEDKVWQYAVMM

SEQ ID NO: 180080 - protein, 91 aa, Glycine max
  Coding DNA Sequence Number=SeqID_88395
MSGFWMCRGEGTMKIGVGCEGIVEGLEAMKVKGQRRVEVVVDGVWREGGGIKKVVSLWVREEDKRTISSFDLRCEALVNVVSLGKTKETQK

SEQ ID NO: 180081 - protein, 118 aa, Glycine max
  Coding DNA Sequence Number=SeqID_88396
  Subcellular localization annotation: CTP_CleavageSite=66; ConfidenceScore=5.68e-01
MCSSFIPDIHTTIPSTGASTSSSTPSSTSASISSFAPILTFTKLAHTIGNLDSVINFKKRGEGYCNGEAPVEKRIKDAMVEKGNPLILEVRVWVQSMAKGGLQEGVETTNIKGFTVVW

SEQ ID NO: 180082 - protein, 74 aa, Glycine max
  Coding DNA Sequence Number=SeqID_88397
MATRKLRHQQQLKSILLPHGTSLKHGFLKFNVDAASFEDQQHFGIGIYIRDNQAQFVKAKTIFLPGLPEPSERS

SEQ ID NO: 180083 - protein, 108 aa, Glycine max
  Coding DNA Sequence Number=SeqID_88398
MGNIHEKLKSLTLSKKNKICIYLKTPNNLSWTIVTHWGRVRTGKIRSVMWNSFTGCETMALGSGKNIKGRWVMLEKEEKFEKRLRKIGGESKSEIEDEGQGEERKIGN

SEQ ID NO: 180084 - protein, 242 aa, Glycine max
  Coding DNA Sequence Number=SeqID_88399
  Gene Ontology: Mol. function=zinc ion binding
  Homolog annotation: Hit_ID=A7UQU7; Match level="QueryCoverage=90%, HitCoverage=47%, E-value=2e-33, Identity=34%"; Hit description=IMP dehydrogenase/GMP reductase, putative
  Pfam annotation: Domain name=DUF1723; Domain location=1-38; Score =25.8; E_value=0.00016; Accession=PF08330.1; Description=Protein of unknown function (DUF1723)
RWHNETSSFHLPVGEVTITLDDVVSLLHLPIIGTFHTFEPLHIDEAVLMFVELLEVSGEEARAETTQCHGAYSISYAWGAATLMHMYDHLNDACRSGNRQLAGYITLLQCWIYEHFPSVAECLTDPDYDDLSPRVCRWIATKASLKSISASTYRKRLDGLRIPDVCWMPYGEHRAVREFDLISCFSGHLRWEPVVVRHRPEMVMRQFGYVQSFPVEATDSWVSFEEIDDRWMHYSDHFALAG

SEQ ID NO: 180085 - protein, 132 aa, Glycine max
  Coding DNA Sequence Number=SeqID_88400
  Gene Ontology: Mol. function=nucleic acid binding
  Homolog annotation: Hit_ID=A7PF18; Match level="QueryCoverage=78%, HitCoverage=79%, E-value=2e-40, Identity=80%"; Hit description =Chromosome chr11 scaffold_13, whole genome shotgun sequence
  Pfam annotation: Domain name=Alba; Domain location=17-86; Score=60.8; E_value=4.8e-15; Accession=PF01918.12; Description=Alba
MATVAAAPALTANDSHKKYRIQVSNTKKPLFFYVNLAKRYIQQHDEVELSALGMAIATVVTISEILKNNGLATEKKVLTSTVGMKDENKGRLVQKAKIEIVLGKSDKFDNLMSPPAPTESEAAAADDDHDKK

SEQ ID NO: 180086 - protein, 50 aa, Glycine max
  Coding DNA Sequence Number=SeqID_88401
MFGIRGGSVLKRRGESLEHTKFLNMEQAKMEEDMPKILWGVYGEGVSFCC

SEQ ID NO: 180087 - protein, 108 aa, Glycine max
  Coding DNA Sequence Number=SeqID_88402
MRERKGGERGRERVSVRNVNLRVRETGRVREREGRPRERVDTKRVVRYDYHRRGLRSKTRNCWWTDDDHTRRQRGSSSWIAYDDTYQSGCNTNNGDWVEVTRKKKLNK

SEQ ID NO: 180088 - protein, 554 aa, Glycine max
  Coding DNA Sequence Number=SeqID_88403
  Gene Ontology: Mol. function=transferase activity, transferring hexosyl groups; Cellular component=soluble fraction; Biological process=carbohydrate biosynthetic process
  Homolog annotation: Hit_ID=A7QMT7; Match level="QueryCoverage=96%, HitCoverage=87%, E-value=1e-176, Identity=62%"; Hit description =Chromosome chr14 scaffold_128, whole genome shotgun sequence
  Pfam annotation: Domain name=Glyco_transf_8; Domain location=30-246; Score=63.3; E_value=8e-16; Accession=PF01501.11; Description =Glycosyl transferase family 8
MKLCGSIWLWLILLLASVQSLGSERTDVAYVTLLYGDEFLLGVRVLGKSIRDTGSNKDMVVLVSDGVSDYANTLLQADGWIVEKISLLANPNQVRPKRFWGVYTKLKIFNMTDYKKVVYLDADTIVVKNIEELFKCGKFCANLKHSERLNSGVMVVQPSATVFNDMMSKVKTLPSYTGGDQGFLNSYYSGFPNAHLFEPNLSPKMLDTRPVPEMERLSTLYNADVGLYMLANKGDTCVLFSSNLNRELFSVEVYDSRTANAAGGSKIMMFVNERLNELEEKLEGMEAIIEAWWMVDENELRVIHYTLGPLKPWDWWTSWLVKPVDVWQNVREQLEESLPGTGGGQNPKDNYLVKFLFLLPFCAVLFCCYRSFLKGYFGSCYRTSLCDHVRHLYYRIKSGGPLAYTTISTSTLNSPHKLINGAQYKAPAYMGSISVCVCLLAAVVSLGLALLIVPRQVAPWTGLLLMYEWTFTIFFILFGGYLNLIYHRGRIMTSQTPSSLSHHEYSDDDSGKVHQRQMSSCNAATWFYGLGMAFLAIATPSLPFLFGITALFLR

SEQ ID NO: 180089 - protein, 704 aa, Glycine max
  Coding DNA Sequence Number=SeqID_88404
  Gene Ontology: Mol. function=nucleoside-triphosphatase activity; Biological process=proteolysis
  Homolog annotation: Hit_ID=A7Q614; Match level="QueryCoverage=59%, HitCoverage=42%, E-value=1e-168, Identity=63%"; Hit description =Chromosome chr14 scaffold_54, whole genome shotgun sequence
  Subcellular localization annotation: CTP_CleavageSite=87; ConfidenceScore=5.74e-01
MSFSPLHSPLHFPQRPLFTSIRPIPNRTFISNPRRTPRTPLSLAPITFAAKSTPSPNDDVLFKRLVRALFCFAVGFSALGAFRAPPPAFAIAAPWTYWGKRGAEKERAKSHQYSDCTDRLLETVSFLLKTVDEVREGNGEVNEVEAALESVKSKKEELRKEINGRLYPALKRLRRERKALWKRSGEIVGEILKATAEYEKLKVKVAGNEKENARMKELEESVGVMEDEYNGVWERVGEIEDRISREETVALSYGVREINFIERECEQLVERFKREIKNKDFKSLPTGSVTRLSKSVIQKDLETVHRKQAEQIILPSILDVEDLWPFFHEDSINFAQRLTRSLKDSREKQRNLEAQIRKKMKKFGKEKHSIIYSPEEEVVKGFPEVELKWMFGNKEVVLPKAVGLHLYHGWKKWREEAKANLKQNLIKDAEFGRQYVAERQERILLDRDRVVSRTWYNEGKNRWEIDPVAVPYAVSKKLIEHVRIRHDWGAMYITLKGEDEEFYVDIKVVAEYEMLFEDLGGFDGLYMKMLACGIPTAVHLMWIPFSELNIRQQFLLILRVSRGILSGLWSSGVVTNVRNWIFKNIKDTTDDIMVVIVFPIVEFLVPYPVRIQLGMAWPEEIYQTVDSTWYLKWQSEAELNFRSRQTTTDDDEEVPWFFWFLVRAAIYGFVLFHVLKFTRRRLPSLLGFGPLRRDPNMQKLQRVV

SEQ ID NO: 180090 - protein, 243 aa, Glycine max
  Coding DNA Sequence Number=SeqID_88405
  Gene Ontology: Mol. function=protein dimerization activity; Cellular component=nucleus; Biological process=regulation of transcription, DNA-dependent
  Homolog annotation: Hit_ID=P32294; Match level="QueryCoverage=76%, HitCoverage=96%, E-value=2e-76, Identity=74%"; Hit description=Auxin- induced protein 22B
  Pfam annotation: Domain name=AUX_IAA; Domain location=12-194; Score =384.0; E_value=2.3e-112; Accession=PF02309.7; Description=AUXIAA family
MENTTVTYQTDLNLKATELRLGLPGTEESEEKTLSAGARINNKRPLTETSDECASNGTSSAPHEKTETAPPAKTKIVGWPPIRSYRKNSLQESEGAGIYVKVSMDGAPYLRKIDLKVYGGYTQLLKSLENMFKLTIGEHSEKEGYKGSDYAPTYEDKDGDWMLVGDVPWDMFVTSCRRLRIMKGSEARGLGCACMLLAYLYTKLYSEAGEDGRYGAVSSSSLATFLVILPSVVGCYMLCCCFH

SEQ ID NO: 180091 - protein, 357 aa, Glycine max
  Coding DNA Sequence Number=SeqID_88406
  Homolog annotation: Hit_ID=A7Q5W0; Match level="QueryCoverage=89%, HitCoverage=90%, E-value=3e-35, Identity=30%"; Hit description =Chromosome chr14 scaffold_54, whole genome shotgun sequence
  Pfam annotation: Domain name=DUF573; Domain location=108-207; Score =90.2; E_value=6.6e-24; Accession=PF04504.5; Description=Protein of unknown function, DUF573
MLSPLVSWILSPSSSSSSSEEEEEEILDIITDNDINHENDQKLNVEDDECDVDNTIPVALAVPNASPAVTVAFPANDERNTIPVTATATTVVTCSKGQRNAKYSGMVRQYQRLWTKEDEMELLKGYLDYVKRHRKETTTLQSVVASLYDHVRPKLNVSFNKNQLVEKLRRLKRKHKLALDKDKDKEVPFRNPQEQAIFEISHKIWGIDTDNIIDQDALDGYESGHTPESHDHVGNIKVKIEQLDNNDEIDNRVPKRLRLDDADDVNKTNDQNNGDSIQGFIEETMRSCFPPLLKEVLHDAHEEPLPELEPIPMPLCPGEVDHEQWRKRRILELEVYVKRLELLQDQIKSRLEELRSN

SEQ ID NO: 180092 - protein, 302 aa, Glycine max
  Coding DNA Sequence Number=SeqID_88407
  Gene Ontology: Mol. function=beta-pyrazolylalanine synthase activity; Cellular component=cytoplasm; Biological process=cysteine biosynthetic process from serine
  Homolog annotation: Hit_ID=A3RM06; Match level="QueryCoverage=99%, HitCoverage=99%, E-value=1e-147, Identity=86%"; Hit description =Cysteine synthase
  Pfam annotation: Domain name=PALP; Domain location=11-278; Score =363.5; E_value=3.4e-106; Accession=PF00291.16; Description=Pyridoxal- phosphate dependent enzyme
MEPQCRIKKDATELIGNTPMVYLNNIVDGIALSMIEDAEKKGLITPGKTVLVEYTSGNTGIGLAFIAALRGYKLQVTMPSYVSLERKIILRAFGAEVYLTDPAKGIDGVIQKAEELIAKTPDSFMLNQFENPANPNIHYETTGPEIWRDSGEKIDALVSGIGTGGSIAGAGRFLREKNPDIKLYGVEPAESPVLNGGQPGKHLIQGIGAGIIPKVLDVNLLDEVIQVSSEEAIETAKLLALKEGLLMGISSGAAAAAAIKVGKRPENAGKLIVVIFPSFGERYLSSPLFESIRKEAEQMTFD

SEQ ID NO: 180093 - protein, 34 aa, Glycine max
  Coding DNA Sequence Number=SeqID_88408
MADEGVQLKTLQTISIIFQSRLHPENELDLGVVR

SEQ ID NO: 180094 - protein, 206 aa, Glycine max
  Coding DNA Sequence Number=SeqID_88409
  Pfam annotation: Domain name=RRM_1; Domain location=59-129; Score =19.8; E_value=0.0022; Accession=PF00076.13; Description=RNA recognition motif. (a.k.a. RRM, RB
MSRERNSGWERVRSRGKAIERDRVSFNEDPRWTHAGNRDGQQQGYNRANWRDKKDISSFYFTRFSEDVTEKDLWYHFKKWGDVRETFISKQKNKNGRRYGFARFKGVKDVHKLERQLDQIVIGGQKLKETYNDHHSRVASLSSVYLDIPLNDKKWFTEAWVRRLKNLAWFDRVEDDPLWDFGADITPKYMGDDMILLLGLTDAKAE

SEQ ID NO: 180095 - protein, 375 aa, Glycine max
  Coding DNA Sequence Number=SeqID_88410
  Homolog annotation: Hit_ID=A3BW28; Match level="QueryCoverage=27%, HitCoverage=35%, E-value=6e-13, Identity=40%"; Hit description =Putative uncharacterized protein
MAPKRRPKKGESRMDAALDAMKPYGFPNRLVRTTVNSLLKVYGGNGGWFFIEESAYSLLIETLLEKQANSSPQDAEFSYSRLIPPSHGEYSSQNPVIKDLSFTALEGTPNQLENLLSLSGTSLYKGTLGMNIDRNSFEIKGTGKAPVRYKTVENKPPELKSTQNNTIPGQSPVPLMWKNHHAYNEDGLIEANPDGPNEVTPAGCSNSALLACSNTQTSDDTLLTNQAADTVSSSSGTGIQLPINGVDTVSAKTEIGSELPIKSVDISSVPSEPANQPLIKAASETPIEAFKESGYQCRKRNEAASETPMEAEKESEFQPVKKLALAENHVSKSPQLGTGLSDKRYKPCYGWISNDDEEEEELIELPLAPWLSGVN

SEQ ID NO: 180096 - protein, 639 aa, Glycine max
  Coding DNA Sequence Number=SeqID_88411
  Gene Ontology: Mol. function=microtubule motor activity; Cellular component=microtubule associated complex; Biological process =microtubule-based movement
  Homolog annotation: Hit_ID=A7Q5T0; Match level="QueryCoverage=100%, HitCoverage=100%, E-value=0.0, Identity=59%"; Hit description =Chromosome chr14 scaffold_54, whole genome shotgun sequence
  Pfam annotation: Domain name=Kinesin; Domain location=100-421; Score =448.0; E_value=1.3e-131; Accession=PF00225.14; Description=Kinesin motor domain
MPVPNGEEQVLLPENASEVSESPSLNLNPDSVDGSPPVSTVYTDVGVVPEHQKNELEHLISNLEGEIEELRLKQKKLDKKRREALSKILDIKGSIRVFCRIRPNLVTEKRKISEPVSAGPEKIQVKFGGTRKDFEFDKVFNQEASQESVFVDVEPILRSAMDGHNVCVFAYGQTGTGKTFTMDGTNKEPGIIPRALEELFRQASLDNSSSFTFTMSMLEVYMGNLRDLLSPRPSGRPHEQYMTKCNLNIQTDPKGLIEIEGLSEVQISDYAKAKWWYNKGKRFRSTSWTNVNEASSRSHCLTRISIFRHGDALEVKSEVSKLWMIDLGGSERLLKTGAKGLTLDEGRAINLSLSALADVVAALKRKRCHVPYRNSKLTQILKDSLGYGSKVLMLVHISPSEEDVCETVCSLNFAKRARAIESNKEMPVEVKKQREKKIMELEEDIKEAVKQRQNLREQIQKIELKLNECKKLASTTYSVVESDDIATSTSLKDDVKEVIETPKTSKKSIKRNFSNSTPRFMTSTVASRQRQSAAERDISTVRLKSFRSIISKSSNNYSYSQSMSYSDIRIKAILRSSNGKSRYAEADSVPIPNTVLTEKPKCNDMESKVTTPRSKMVTSSDQNFRVSLGRHRRRMSDLI

SEQ ID NO: 180097 - protein, 286 aa, Glycine max
  Coding DNA Sequence Number=SeqID_88412
  Gene Ontology: Mol. function=sodium:hydrogen antiporter activity; Cellular component=integral to membrane; Biological process=sodium ion transport
  Homolog annotation: Hit_ID=Q0IJ87; Match level="QueryCoverage=100%, HitCoverage=56%, E-value=1e-136, Identity=84%"; Hit description =Sodium/hydrogen exchanger
  Pfam annotation: Domain name=Na_H_Exchanger; Domain location=25-286; Score=-54.6; E_value=0.0025; Accession=PF00999.12; Description =Sodiumhydrogen exchanger family
MVFEISTVVSKLQTLSTSDHASVVSMNLFVALLCGCIVLGHLLEENRWMNESITALLIGVCTGIVILLFSGGKSSHILVFSEDLFFIYLLPPIIFNAGFQVKKKQFFVNFMTIMLFGAIGTLISCTIITLAIGAIFAATDSVCTLQVLNQDETPLLYSLVFGEGVVNDATSVVLFNAIQSFDLNQIDPSIAGHFLGNFLYLFIASTMLGVLTGLLSAYIIKKLYIGRHSTDREVALMMLMAYLSYMLAELSYLSGILTVFFCGIVMSHYTWHNVTESSRITTKYVF

SEQ ID NO: 180098 - protein, 185 aa, Glycine max
  Coding DNA Sequence Number=SeqID_88413
  Subcellular localization annotation: CTP_CleavageSite=44; ConfidenceScore=5.02e-01
MDKREFHLQPMGICYRLYHFLTKALASQALKTVTLGCSRRDSSRSSAVRSSDSNAKKEVQSETQCKVDDGKKLPPTEGVPGDSISSVQQQAEEKSKPCMNVDKMEGENAALTLPTPSLAPTRSIKKTVSISENVEEIPPPKKLKRKWSRSFQKSFSLDQEEEPISPPRSILKVGSDLNDKSNPFS

SEQ ID NO: 180099 - protein, 274 aa, Glycine max
  Coding DNA Sequence Number=SeqID_88414
  Homolog annotation: Hit_ID=A9PJD2; Match level="QueryCoverage=50%, HitCoverage=45%, E-value=1e-25, Identity=46%"; Hit description =Putative uncharacterized protein
MVFFLYVPILLSLSFSFLLHVFKKHIHISLLDLVTTFNSTNIMIDNYKLYPNQIGFIEDVSEGIEGFMTCTKNLGFQSIDISDKIDDNDNNNDDEDEDNCWRKTRVTEGKGNFPPPLSSLNGNGQPSFILVPVRKNGRLQLSKVRIKKPKILYATRQDGRLKLFLVPDQCVKDNAQEDEKEQEQELVDDMEEHTEEEEGMMIVESMEEEEEEDDDEVVEEITYYEQKDFRIGEWKFPNERSRKCHEVLNHIQSHHHHHGHGSHHHLHMYGFSIA

SEQ ID NO: 180100 - protein, 1223 aa, Glycine max
  Coding DNA Sequence Number=SeqID_88415
  Gene Ontology: Mol. function=3-dehydroquinate dehydratase activity; Cellular component=cytoplasm; Biological process=aromatic amino acid family biosynthetic process
  Homolog annotation: Hit_ID=A5ATW0; Match level="QueryCoverage=39%, HitCoverage=89%, E-value=0.0, Identity=72%"; Hit description =Putative uncharacterized protein
  Pfam annotation: Domain name=DHquinase_I; Domain location=1-206; Score=201.1; E_value=2.7e-57; Accession=PF01487.6; Description=Type I 3-dehydroquinase
  Pfam annotation: Domain name=DnaJ; Domain location=581-642; Score =93.3; E_value=7.5e-25; Accession=PF00226.22; Description=DnaJ domain
  Pfam annotation: Domain name=Shikimate_DH; Domain location=334-451; Score=120.4; E_value=5.3e-33; Accession=PF01488.11; Description =Shikimate  quinate 5-dehydrogenase
  Pfam annotation: Domain name=Shikimate_dh_N; Domain location=221-301; Score=95.4; E_value=1.7e-25; Accession=PF08501.2; Description =Shikimate dehydrogenase substrate bind
  Pfam module annotation: Pfam domain module=DHquinase_I::DnaJ::Shikimat e_DH::Shikimate_dh_N; Domain location=1-206::581-642::334-451::221-301
MVFEMVKGKELGADLVEARLDFLNDFHPTQHLPSLINNRPLPILITYRPIWEGGEYDGDESQRQDALRLAIELGSEFVDVELKVADEFYKSIGGKKAESVKIIVSSHNLESTPSVEEIGNLAARIQATGADVVKIATTALDITDCARLFQVLVHSQVPMIGIAMGEKGFISRVLCAKFGGFLTFGSIEAGAISAPGQTTIKELLDLYNFRQIGVGTKVHGVIGNPIGHSKSPHLYNPAFKSVGFDGIYLPLLIDNVSDFLNTYSSPDFVGYSYTIPHKQNGLRCCDEVDPIAKAIGAISCMIKRPNDGRLIGYNFDYLGAIAAIEERLHLQDSNGRSISGCSPLYGKLFVVMGAGGAGKALAYGGKEKGARVVVANRTYAKAKELATKVGGEAITLSELESFHPEQGMILANTTSVGMKPKIDLTPIPKEALKHYSLVFDAIYTPKLTRLLREAQETGAAIVYGTEMFINQAFMQFEMFTKLPVPVIVIVILIVQSMFGGLLEPGWLDFDLNSPMECNKDEALRARQIAEARMQRGEFAEALRFATKAKRLYADVENIAQIITVCEVHIAAQKKLSGCDMDWYAILQIERLADEATVKKQYRRLALLLHPDKNKFAGAEAAFKLIGQANGLLCDQAKRSLFDKKFGASVKGAAPKPKTSHNYSNGNVFAAKHNANATKTQKSSDSHHFSHGNVFAAKCGANATNYQNSYPNSTGFSNQGAQMTFWTSCQHCDAKYQYPIRFVNANLLCQQCKKPFKALANGFGIMGAATVLTSVNIPKEAPMHGPPKPASENTGRKPLGREQAGTFVRSNPTSMKKCAAGVGRRCGGEKSKDGNIPASSDMEPQTSQNFGSKRVRQSAPDSGESFKARNGDDTKAANIRENAVDSSNTRRSSRKKQHVSYIETSEDDDFEIPSKKPRQSGPLNADEAEEQNVPASGESSDNNIPATPGATDQNKEKVSESDIGLGTSKEDKRSPKNSKVPSRPRIFHCPVSDTDFNDFEKDKEEDCFAVNQLWAVYDSTDAMPRFYGLVKKVASPFQLKITWLEPDPDDKGEIDWNDAELPIACGKFRLGGSQQTTDRTMFSHQVRCIKETGRGSYLVCPNKGETWAIFRDWDINWSSNPKNHLKYDFEYVEILSDFSENVGIAVAYMGKVKGFVSLFQRTEKNGVNIFYIEPNELYRFSHRIPSYKMTGYEREGVPRGSFEFDPAALPTHLFEVGDSGNVKM

SEQ ID NO: 180101 - protein, 1372 aa, Glycine max
  Coding DNA Sequence Number=SeqID_88416
  Gene Ontology: Mol. function=aminoacyl-tRNA ligase activity; Cellular component=cytoplasm; Biological process=tRNA aminoacylation for protein translation
  Homolog annotation: Hit_ID=A7PSB7; Match level="QueryCoverage=32%, HitCoverage=100%, E-value=0.0, Identity=85%"; Hit description =Chromosome chr14 scaffold_27, whole genome shotgun sequence
  Pfam annotation: Domain name=Seryl_tRNA_N; Domain location=926-1037; Score=147.4; E_value=4e-41; Accession=PF02403.13; Description=Seryl -tRNA synthetase N-terminal domain
  Pfam annotation: Domain name=tRNA-synt_2b; Domain location=1101-1275; Score=222.7; E_value=8.6e-64; Accession=PF00587.16; Description=tRNA synthetase class II core domain (G, H, P, S and T)
  Pfam module annotation: Pfam domain module=Seryl_tRNA_N::tRNA-synt _2b; Domain location=926-1037::1101-1275
MAEEEEDDESFGEFTFASFPSQPTSNDTNPLDDDDWGDFMNHSNRINGPFDSFGLPTDPTNKHVNDDKGVAVQAEAAKNPKGAIPLSIFGEEEGEEEEKPASANVFSNGGGGAVKRGSGSNGSVGISDLISSLYNQQRPQVDSHNNGSVSVSNVAAPNPTYSNGSKLNSDEDEDGWEFKSAEWETGTKSQDVKAETPKHDNGALDVGTVLDSSNGILDKAGRWHVEFEFSPHSASQDHVNPQPSPESESNDIGTGFAMFSQNFGEFSSGSGPNQNLEVLKKADIYPTNMELLKFEGATPHGTIDSSLTSESNQPDGWNFGFNFNSSSVGEDNHSSDSYFKTKNNQDDNNRNNASPTNINVDSHVNFFESESDVTKHEKPLTSSENRREAMPLSIFGDETPDTDKHPVTQDLSPYTPTSPIRNSFNSPGSNFSINDIWNLYNQAENQSSPNMTPKASENQIHASPEVLGSSLVTSNDNLDDDFWDYKDAATETRFTNESAQKTSSPQVNENVLQSSPTFLNSDLTNGDDDFVDDSWVFKDAISGTISQDHTPSLDHRDLPQLSTKLEQVDYAEFYSKVKDELCNYVLFHLQNLKKTQNVAALSGEDAKAKALLEEIQGILSMGVMGESGGRSFRIWHKEFSKILHQDNMSIPNEYLSEDYCPRNVCFNELLEVLKEPKFQPFESEYQLASRLLMAEKDIKCVMELLKDTVSTLRILKLGSTEEQSNYLTIWSKIAFVCSQELKHGAYVWKQAVLQNTHDQILSSPKGKLHDYVMPNVYAADVDELKQSEITSSFSGIGVQFILALGEIYRVAEIIGTSAKLHKPWMLSGATDHKSLCALLNECYGIWLASGLEEAILSISNWNNFEPDGISRELVESIKYIHELDEHALQSFVISGEQTTCQLSALPAGFIPVVAQVREVEGGVRSMLDINLFREEKGHNPEFIRESQRRRFASVEVVDEVINLDKEWRKRQFELENLRKEFNKINKEVSKLKRAGEDATKFISESEETKKSIGEKEVEVRETLNLLNSKLETIGNLVHDSVPISQDEANNVVVRSWGEKRVEPKLKNHVDLVELLGIADTKKGADVAGGRGFYLKGDGVRLNQALINFGLDFLEKREYTLLHTPFFMRKDIMSKCAQLAQFDEELYKVTGEGDDKYLIATAEQPLCAYHLDDWIHPTQLPLRYAGYSSCFRKEAGSHGRDTLGIFRVHQFEKVEQFCLTSPNDNDSWDMHEEMLKNSEDFYKALNLPYQVVSIVSGALNDAAAKKYDLEAWFPASQAYRELVSCSNCTDYQARRLEIRYGQKKSNEQMKQYVHLLNSTLTATERTICCILENNQKEDGVEIPEALRPFMGGKTFLPFKNQPSNEAKGKKSKA

SEQ ID NO: 180102 - protein, 317 aa, Glycine max
  Coding DNA Sequence Number=SeqID_88417
  Gene Ontology: Mol. function=transferase activity, transferring glycosyl groups; Cellular component=integral to membrane; Biological process=carbohydrate metabolic process
  Homolog annotation: Hit_ID=A7PSB6; Match level="QueryCoverage=76%, HitCoverage=87%, E-value=1e-110, Identity=77%"; Hit description =Chromosome chr14 scaffold_27, whole genome shotgun sequence
  Pfam annotation: Domain name=Yip1; Domain location=127-292; Score =188.5; E_value=1.7e-53; Accession=PF04893.8; Description=Yip1 domain
MTTKAGEDTINKNDEDEQRDEGGETHGATKEARLQKHKREGMGHYTSIDNQKVSGSVPAVEPPPFKFSDSNLQTFPPSGAQGKISGGSRPPRDVDDTFSKSGSGSDEPQRQSGWFQAFSLASYKPYFDVDTIDVLDRIKDSLCPFSGTFNEKTASHPDLYGPFWICTTLIFVAASIGTFVTYIAHKLKDQEWNYDINLVTWSAGLFYGYVTVVPLCLYVILKYFSVPSGFVQLLCLYGYSLFVFIPALCMSVVPLEIFRWVVAGVAGFMSATFVALNLRAHIMSAVGSSCSTKGLPLHSNSMRGKWYYHHSASMNCR

SEQ ID NO: 180103 - protein, 206 aa, Glycine max
  Coding DNA Sequence Number=SeqID_88418
MIEATQRHSVERKGVVADNLVRGSVFVGEQYKSLLEWSKPLTRLVLGGGHDSRVPMQLWRTGIYTSLTSIGMGPQKQVKLSNPPRPQATRNADQHECKPRRFLLRQPPVGGYFPSPATDEKAQSLAIAARDFAGEGVEGLRQDLEIERDGGSQLKNFPIGWLGPAAAPLSAEDCGSWMRLRKAKRNRIEEARIDVDYGDWEWKGVI

SEQ ID NO: 180104 - protein, 282 aa, Glycine max
  Coding DNA Sequence Number=SeqID_88419
  Gene Ontology: Mol. function=DNA binding; Cellular component=nucleus
  Homolog annotation: Hit_ID=A7PS74; Match level="QueryCoverage=98%, HitCoverage=24%, E-value=2e-55, Identity=46%"; Hit description =Chromosome chr14 scaffold_27, whole genome shotgun sequence
MSLPRQRLLPLITSVHKLVVLNHETLLMELRSANSDILENQNGIECLKDSEVFKKHYATVSDAMLQLRQRNTYRGNSLPPWMKPQASFNVHDDLPGMLDSSLTQELGSTVVQVIKGSRLRAHAMVDAAFEALSLTKEGEDAFIKIGQALDSINHQQLASKSRLPVIRSQEQVNVNGSFYHLSHSTSGVSEPILNDPSVPKPHNYSDKFDTELPSDLIASCVATLIMIQTCTERQYPPADVAQILDSAVTSLHPCCPQNLPIYREIQMCMGRIKTQMLALIPT

SEQ ID NO: 180105 - protein, 56 aa, Glycine max
  Coding DNA Sequence Number=SeqID_88420
MDDANVVKCHEMYDQNSEIQVLLEFMDGVVFPSMDVAAFTSGCSPSSASVAAVIFY

SEQ ID NO: 180106 - protein, 161 aa, Glycine max
  Coding DNA Sequence Number=SeqID_88421
  Homolog annotation: Hit_ID=A7PS37; Match level="QueryCoverage=70%, HitCoverage=51%, E-value=7e-23, Identity=46%"; Hit description =Chromosome chr14 scaffold_27, whole genome shotgun sequence
MGMAVQPRFGVWKPIRIPQCSGDDPFRGITSFLLGLPPQSGRNLKLDVLYPIGGYSRCVDTKEGFYAAKKREMERSLDPPPLNQRRRSNINEPVVAFGPPAFGGPDEVGEAVVRSITGSGQLDKIKFERISLEMSNTTNWSSELRVPRLGGTMFPSAALVV

SEQ ID NO: 180107 - protein, 572 aa, Glycine max
  Coding DNA Sequence Number=SeqID_88422
  Gene Ontology: Mol. function=metal ion binding; Biological process =histone H3-K9 demethylation
  Homolog annotation: Hit_ID=A7PS36; Match level="QueryCoverage=100%, HitCoverage=61%, E-value=1e-114, Identity=64%"; Hit description =Chromosome chr14 scaffold_27, whole genome shotgun sequence
  Pfam annotation: Domain name=WRC; Domain location=16-61; Score=79.0; E_value=1.6e-20; Accession=PF08879.1; Description=WRC
MDNARSANGEENAAGIPDDLRCKRSDGKQWRCTAMSMPDKTVCEKHYIQAKKRAANSAMRANLKKAKRKSHSLSLNESDNVYLESKSDDFDLPLSSIGLSQKKLSKNEFRYEPERDARRGSSARRASNLNDDDDDDDDDVVVDVDGDGDGDAALYEEENWVSYDSPPDSSRKRSRRSLEANAVSWNIRMEHPVRLTRTPAGRLVTSAGGMTAIELLGVNGVIGGDIVIAVYQHGTRTFHWMKFRGYVLLAGVYVIARLACGVIIPLSEFSAFSGTKVRIREIPVLDKLQYLHVLLSSVLPVVKQIHHEQCFEVELEKKLRGAEIDLPRIKLNTDEQMCCNFCRIPITDYHRRCPSCSYDLCLNCCRDLREATADHNKEPQTEQAKTSDRNILSKFPHWRSNDNGSIPCPPKEYGGCGYSSLNLSRIFKMNWVAKLVKNVEEMVSGCRISNADDPPETGRNDLRLCQYSHREASDDNYLYCPASDDIKTDGIGSFRKHWKTGEPIIVKQVFDGSSISSWDPMVIWRGILETTDEKAKDENRMVKAIDCLDGSEIDIELAQFMKGYFEGHILEN

SEQ ID NO: 180108 - protein, 63 aa, Glycine max
  Coding DNA Sequence Number=SeqID_88423
MKGCSKNITRLKIVHPLTNSFEVDTRQSTGHCVGHVWICQEQPELKLTSHDALGVSTSYSTAS

SEQ ID NO: 180109 - protein, 121 aa, Glycine max
  Coding DNA Sequence Number=SeqID_88424
  Pfam annotation: Domain name=zf-GRF; Domain location=68-102; Score= -0.4; E_value=0.035; Accession=PF06839.3; Description=GRF zinc finger
MGCGNLKPVSVLPRCPHLVDFLKQGCRPIWVSEVVVEKRGHCLKHVVNDAIPMERSSSLYTLEPWSCVMCLCNVKVPLVISWTKDNLGRHFYGCGLYKVGKGGIILSDTIQLQTVVRRESL

SEQ ID NO: 180110 - protein, 619 aa, Glycine max
  Coding DNA Sequence Number=SeqID_88425
  Gene Ontology: Mol. function=acyl-CoA binding; Cellular component =cell cortex of cell tip; Biological process=lipid transport
  Homolog annotation: Hit_ID=A2Q340; Match level="QueryCoverage=99%, HitCoverage=99%, E-value=0.0, Identity=72%"; Hit description=Acyl -coA-binding protein, ACBP; Serine/threonine protein phosphatase, BSU1
  Pfam annotation: Domain name=ACBP; Domain location=10-96; Score=45.6; E_value=4.8e-11; Accession=PF00887.10; Description=Acyl CoA binding protein
  Pfam annotation: Domain name=Kelch_1; Domain location=179-221; Score =6.4; E_value=0.53; Accession=PF01344.16; Description=Kelch motif
  Pfam annotation: Domain name=Kelch_1; Domain location=225-271; Score =8.0; E_value=0.33; Accession=PF01344.16; Description=Kelch motif
  Pfam annotation: Domain name=Kelch_1; Domain location=299-344; Score =21.2; E_value=0.0038; Accession=PF01344.16; Description=Kelch motif
  Pfam annotation: Domain name=Kelch_1; Domain location=349-394; Score =21.1; E_value=0.0042; Accession=PF01344.16; Description=Kelch motif
  Pfam annotation: Domain name=Kelch_2; Domain location=179-221; Score =16.2; E_value=0.12; Accession=PF07646.6; Description=Kelch motif
  Pfam annotation: Domain name=Kelch_2; Domain location=225-271; Score =14.1; E_value=0.53; Accession=PF07646.6; Description=Kelch motif
  Pfam annotation: Domain name=Kelch_2; Domain location=298-344; Score =18.7; E_value=0.021; Accession=PF07646.6; Description=Kelch motif
  Pfam annotation: Domain name=Kelch_2; Domain location=349-394; Score =13.6; E_value=0.73; Accession=PF07646.6; Description=Kelch motif
  Pfam module annotation: Pfam domain module=ACBP::Kelch_1::Kelch _1::Kelch_1::Kelch_1::Kelch_2::Kelch_2::Kelch_2::Kelch_2; Domain location=10-96::179-221::225-271::299-344::349-394::179-221::225 -271::298-344::349-394
  Subcellular localization annotation: CTP_CleavageSite=3; ConfidenceScore=5.02e-01
MARASSGLQYPERFYAAASYVGFDGSTKSLTSKFSNSTALLLYSLYQQASIGPCNVPEPSSWKLVEHSKWASWNQLGNMSSTEAMRLFVKILEEEDPGWYSRASNSVLDPVVDVQMNHNSKVEPVIENANAYPEIKTISTENGSHVGTQDKDVVIEGFGSVGVYDQWVAPPVSGQRPKARYEHGAAVVQDKLYIYGGNHNGRYLNDLHIEAEVVESTNSSSITFPCAGHSLIPWENKLLSIAGHTKDPNESIQVKVFDLPNATWTTLKTYGKPPNEKGSMLMLDAKEVLIGSGVPPSPRSDHAAAVHVERYLLIFGGGSHATCYNDLHVLDMQTMEWSRPTQLGEIPTPRAGHAGVTVGENWFIVGGGDNKSGVSETVVLNMATLTWSVVTSVQGRVPVASEGSSLVVSSYDGEDILVSFGGYNGHYNNEVYVLKPSHKSTLQSKLIENPIPYSVSGAHNAANATRDLDSEAGHKGIIKELVMDSVDSIKSKGDVITVLKVEKEDLESSLYKEKLQTLQLKQELSETKTRNSDLCKELQSIRGQLASEQSRCFKLEVEVAELSQKLQTIGTLQKELELLQRQKAASELAALNAKQKQGSGGVWGWLAGAPPPTQKEDDG

SEQ ID NO: 180111 - protein, 306 aa, Glycine max
  Coding DNA Sequence Number=SeqID_88426
  Homolog annotation: Hit_ID=A7PS28; Match level="QueryCoverage=36%, HitCoverage=16%, E-value=3e-23, Identity=50%"; Hit description=Lysyl- tRNA synthetase
MDFGNIVLAIIGFSTSFLFCVPIKRWQRKQVAAEKLKIVSEALEAAEERAVRFQERHDTILSQICASYLTNTEVVEALAGARATMSQALDFAVELREIQFRIIASFPDAIDGIEEPNECALGAGGCKQPAIVRECKTRDSGIMSHDELGSFRGHFEIGEVVDEDLVGEDDDDSVAAEADALDLRAEGELADAAGQVVVPDHDLVGRVAGVGGGAAADEGEDVAAEEHVDEADAAAGAEVAAEDLAEGVAVVDAEAAVGGGGEAPGVLIEGEVEEGRGLGGVGGLRRLIGIEGLGWGLRHYYWESNE

SEQ ID NO: 180112 - protein, 754 aa, Glycine max
  Coding DNA Sequence Number=SeqID_88427
  Gene Ontology: Mol. function=ATP-dependent helicase activity; Cellular component=intracellular; Biological process=DNA recombination
  Homolog annotation: Hit_ID=Q6Y5A7; Match level="QueryCoverage=83%, HitCoverage=74%, E-value=0.0, Identity=53%"; Hit description =Putative DNA helicase RecQsim
  Pfam annotation: Domain name=DEAD; Domain location=138-311; Score =106.4; E_value=8.9e-29; Accession=PF00270.20; Description=DEADDEAH box helicase
  Pfam annotation: Domain name=Helicase_C; Domain location=503-560; Score=41.6; E_value=2.9e-09; Accession=PF00271.22; Description =Helicase conserved C-terminal domain
  Pfam annotation: Domain name=ResIII; Domain location=134-305; Score= -34.1; E_value=0.034; Accession=PF04851.6; Description=Type III restriction enzyme, res subunit
  Pfam module annotation: Pfam domain module=DEAD::Helicase_C::ResIII; Domain location=138-311::503-560::134-305
MDGNKTSSAQVIAEMIGMGFDYTDIMEAIKVAGPSIPSAVEHILNSTARTPKLHAHNGRKKTVLRKQPFRSCRQVRQSKIFDHFHSNDAKEESPQMGVDPNPIVLSEPFEAQDLDIAYDWEQRVSLLMQKHFGFSSLKTFQKEALSAWLAHKDCLVLAATGSGKSLCFQIPALLSGKVVVVISPLISLMHDQCLKLTRHGISACFLGSGQPDDTVEQKAMGGLYSIVYICPETVLRLIEPLQKLAESHGIALFAIDEVHCVSKWGHDFRPDYRRLSVLRENFSASKLKSLKFDIPLMALTATATKRVREDILKSLHMSKETNVVLTSFFRSNLRFMVKHSRTSQASYAKDFHELIQVYGRKQNMTGNEKYFISDDSDHVSNSSDASSISDTDSVSPDDNQDDYAYKDINIMHSGNTDDFLTGRELSVDFLENDVDAFQSVDNSDVTCGEFCVQPAHKEWELSETIDPPKKPEGRLKFLKKPLEQGPAIIYVPTRKETLRIAKYLCKFGVKAAAYNAGVIVATIAFGMGIDKSNVRRIIHYGWPQSLETYYQEAGRAGRDGKLADCILYANLANKPSLLPSRKSEDQMKQAYIMLSDCFRYGMNTSCCRAKILVEYFGEDFSHQKCLLGLARILEVKGYIGEGDDKTHVQAKYLEPTELGLEFVKSMSEQDFYVYPEADMLLARKTNKPFSSFSEWGKGWADPEIRRERLERMRVNRKPGMLPSPKKQRKRKARKGWAGLRTSRGRLAAKLSKHK

SEQ ID NO: 180113 - protein, 130 aa, Glycine max
  Coding DNA Sequence Number=SeqID_88428
  Gene Ontology: Mol. function=hydrolase activity; Cellular component =soluble fraction; Biological process=proteolysis
  Homolog annotation: Hit_ID=O49857; Match level="QueryCoverage=98%, HitCoverage=88%, E-value=7e-20, Identity=69%"; Hit description =Epoxide hydrolase
MHFAEKGEGPVVLFLHGFPDLWYCWRNQILNLSELGYHAVAPDLRGYGDTQVLGHDHDKASRYTVLELVESTKCRLSSLQDYIFNGGFKQDVPSLEEVKVLPGVGHFSIAAEAADRVNTEIYNFIHKFPN

SEQ ID NO: 180114 - protein, 351 aa, Glycine max
  Coding DNA Sequence Number=SeqID_88429
  Homolog annotation: Hit_ID=A7PRX5; Match level="QueryCoverage=63%, HitCoverage=78%, E-value=1e-70, Identity=59%"; Hit description =Chromosome chr14 scaffold_27, whole genome shotgun sequence
  Pfam annotation: Domain name=Auxin_repressed; Domain location=7-129; Score=114.6; E_value=2.9e-31; Accession=PF05564.3; Description =Dormancyauxin associated protein
  Pfam annotation: Domain name=Fz; Domain location=130-229; Score= -45.8; E_value=0.064; Accession=PF01392.13; Description=Fz domain
  Pfam module annotation: Pfam domain module=Auxin_repressed::Fz; Domain location=7-129::130-229
MGLLDHLWDDTLAGPRPENGLGKLRKHHSFAFRSASAKGGCSLCDFGGSESDSGSVKSYGEDSPKNAVRVTRSIMIVKPPGNQSPSGSAPASPAGSTPPVSPFSGGRFPPFKSEGGAPKNGPKDLTLCRIFRKKTCCDVTHTHPALLSVRKLASTGEATQECLHLWELLECSICDPRVGTQPGPPLICASLCERIYEACSNAYFSMDVKTQVHGWLAAEWVSNGTDLCLAAGFRVKPSDIVDIASEETSCYGDKASLGSVVDSWKASQFELTEKGESLRMLDDFQQWAREMPFGERVSWAIGGMVLTAGLMFIRSECSPLSFQLLSSCAFLYAPINVRQVKKTKHVGNVDY

SEQ ID NO: 180115 - protein, 953 aa, Glycine max
  Coding DNA Sequence Number=SeqID_88430
  Gene Ontology: Mol. function=enzyme inhibitor activity; Cellular component=cell wall; Biological process=cell wall modification
  Homolog annotation: Hit_ID=A7PRZ1; Match level="QueryCoverage=78%, HitCoverage=97%, E-value=0.0, Identity=59%"; Hit description =Chromosome chr14 scaffold_27, whole genome shotgun sequence
  Pfam annotation: Domain name=DUF1399; Domain location=106-250; Score =153.4; E_value=6.1e-43; Accession=PF07173.3; Description=Protein of unknown function (DUF1399)
  Pfam annotation: Domain name=Pectinesterase; Domain location=738-938; Score=203.5; E_value=5.2e-58; Accession=PF01095.10; Description =Pectinesterase
  Pfam module annotation: Pfam domain module=DUF1399::Pectinesterase; Domain location=106-250::738-938
MSENLDGSEISPSTSSQSLGELPEIAAIPFGIDLVSAARRNIWFLRTVADSVWLHHTPIMVEAVRRYHDFWMPLIADLTLPYSSPPTILPPLDIHWVWFCHTLNPVSYREYCETRFSKLIGKAGIFDEENREYALMRCREIWSSRYPLESFENEASSDSQDLDTVVVVGGCLKESVFKEVEKQRVLLCSMFVEPYRSEVVYLIAARQRYKAFLFMLLRFARDFSSRLVPTSDILLMWLTHQSYPTVYCEDLKALAIEGDLEKVATLSEKVKEKEFEETKKLWDRAFNQPYEKAGGEVPLTLEGVISIKSPVYWEDSGTDACVFVRLKQRITTSQKDVNRDFLRLQIIRCHSELKLDKAFSNFTNDSWKKAWHFYCEFGTKGVMFDYRRHGGNCLRGSSLLDTVSFRWNDLLRADSLTLEKEVSQQVNVVTSITPPVQAPYLLKCVPDRVTDDSGAMISDVILKMNSYRPQEGRWLSRTVLDHAGRVCFVIRIRVGGGFWRRGGEAPSAVKWEDRIIEIREGSWSYVAGYIGRAPEKVVATATPKEPTEQCKAAWCFSTGDELTIQWDSSQSVSGLTFSLLNQTSPESSVLLLRGRQMQYQVKKTKSKRKGEDMKTELEEKEVDEEEDEESFITVVRFTEDNPDGKATALLNWRLLVVEVLPEEDAVLMLLLCLSILKSVSEMKKQDVGGLLVRRRLKEARLGSRDWGSVILHPSSWSSSIDSTYLQPWHWNAGVLMKSDAVDQLKRYPTLSQSPVEAVVGKGFVAVNITFRNTAASSKHQAVAVRNGADMSTFYSCSFEVDFIFGNAAAVLQDCNMYPRLPMQNQFNAITAQGRTDPNQNTGVSIQNCCTIAASDLGDATNNYNGIKTYLGRPWKEYSRTVYMQSFTDGLIDPKGGANEFANWGPGSNTSNRVTWEGYHLIDEKDADDFTVHKFIQGDKWLPQTGVPFKAGFQ

SEQ ID NO: 180116 - protein, 53 aa, Glycine max
  Coding DNA Sequence Number=SeqID_88431
MERSQSYKGRPRASDGRSLATSSEMGVKKEKTFCNLFEWVNVVVNVEIEDNQC

SEQ ID NO: 180117 - protein, 680 aa, Glycine max
  Coding DNA Sequence Number=SeqID_88432
  Gene Ontology: Mol. function=protein transporter activity; Cellular component=nuclear pore; Biological process=intracellular protein transport
  Homolog annotation: Hit_ID=Q2PEZ3; Match level="QueryCoverage=81%, HitCoverage=98%, E-value=0.0, Identity=88%"; Hit description =Putative importin alpha
  Pfam annotation: Domain name=Arm; Domain location=106-147; Score =44.3; E_value=4.4e-10; Accession=PF00514.14; Description =Armadillobeta-catenin-like repeat
  Pfam annotation: Domain name=Arm; Domain location=149-189; Score =57.2; E_value=5.6e-14; Accession=PF00514.14; Description =Armadillobeta-catenin-like repeat
  Pfam annotation: Domain name=Arm; Domain location=191-232; Score =38.5; E_value=2.4e-08; Accession=PF00514.14; Description =Armadillobeta-catenin-like repeat
  Pfam annotation: Domain name=Arm; Domain location=264-303; Score =37.5; E_value=4.6e-08; Accession=PF00514.14; Description =Armadillobeta-catenin-like repeat
  Pfam annotation: Domain name=Arm; Domain location=305-345; Score =47.5; E_value=4.7e-11; Accession=PF00514.14; Description =Armadillobeta-catenin-like repeat
  Pfam annotation: Domain name=Arm; Domain location=347-388; Score =45.2; E_value=2.2e-10; Accession=PF00514.14; Description =Armadillobeta-catenin-like repeat
  Pfam annotation: Domain name=Arm; Domain location=390-430; Score =53.9; E_value=5.6e-13; Accession=PF00514.14; Description =Armadillobeta-catenin-like repeat
  Pfam annotation: Domain name=Arm; Domain location=433-473; Score =34.8; E_value=3.1e-07; Accession=PF00514.14; Description =Armadillobeta-catenin-like repeat
  Pfam annotation: Domain name=HEAT; Domain location=112-149; Score =3.4; E_value=8.5; Accession=PF02985.13; Description=HEAT repeat
  Pfam annotation: Domain name=HEAT; Domain location=155-191; Score =27.1; E_value=6.3e-05; Accession=PF02985.13; Description=HEAT repeat
  Pfam annotation: Domain name=HEAT; Domain location=270-305; Score =12.0; E_value=0.43; Accession=PF02985.13; Description=HEAT repeat
  Pfam annotation: Domain name=HEAT; Domain location=311-347; Score =10.4; E_value=0.75; Accession=PF02985.13; Description=HEAT repeat
  Pfam annotation: Domain name=HEAT; Domain location=353-390; Score =8.1; E_value=1.7; Accession=PF02985.13; Description=HEAT repeat
  Pfam annotation: Domain name=HEAT; Domain location=396-432; Score =8.8; E_value=1.3; Accession=PF02985.13; Description=HEAT repeat
  Pfam annotation: Domain name=HEAT; Domain location=439-475; Score =0.8; E_value=20; Accession=PF02985.13; Description=HEAT repeat
  Pfam annotation: Domain name=HEAT_PBS; Domain location=134-171; Score= 6.0; E_value=13; Accession=PF03130.7; Description=PBS lyase HEAT-like repeat
  Pfam annotation: Domain name=HEAT_PBS; Domain location=176-213; Score= 8.5; E_value=5.5; Accession=PF03130.7; Description=PBS lyase HEAT -like repeat
  Pfam annotation: Domain name=HEAT_PBS; Domain location=417-455; Score= 1.9; E_value=54; Accession=PF03130.7; Description=PBS lyase HEAT-like repeat
  Pfam annotation: Domain name=IBB; Domain location=6-97; Score=124.8; E_value=2.4e-34; Accession=PF01749.11; Description=Importin beta binding domain
  Pfam module annotation: Pfam domain module=Arm::Arm::Arm::Arm::Arm::Ar m::Arm::Arm::HEAT::HEAT::HEAT::HEAT::HEAT::HEAT::HEAT::HEAT_PBS::HEAT_ PBS::HEAT_PBS::IBB; Domain location=106-147::149-189::191-232::264 -303::305-345:...
  Pfam module annotation: Domain location=:347-388::390-430::433 -473::112-149::155-191::270-305::311-347::353-390::396-432::439 -475::134-171::176-213::417-455::6-97
MSYRPSGNSRTEVRRNRYKVAVDADEGRRRREDTMVEIRKNRREESLQKKRREGFQPQQIPASVHSSLVEKKLEHLPSMVTGVWTDDNNLQLEATTQFRKLLSIERSPPIEEVIQTGVVSRFVEFLMREDFPQLQFEAAWALTNIASGTSENTKVVIDHGAVPIFVKLLASPSDDVREQAVWALGNVAGDSPRCRDLVLSHGALLPLLAQLNEHAKLSMLRNATWTLSNFCRGKPQPPFDQLQSMLLGTETNVYVRRNKEEKGCEGGSSEGVKPALPALARLIHSNDEEVLTDACWALSYLSDGTNDKIQAVIEAGVCPRLVELLLHPSPSVLIPALRTVGNIVTGDDMQTQVIINHQALPCLLNLLTNNYKKSIKKEACWTISNITAGNKQQIQAVIEANLIAPLVNLLQNAEFDIKKEAAWAISNATSGGSHEQIKFLVSQGCIKPLCDLLICPDPRIVTVCLEGLENILKVGEADKNIGNTGDVNLYAQMIDEAEGLEKIENLQSHDNTEIYEKAVKILETYWLEEEDETMPPGDASQSGFNFGSSDAPAVPSGVLVGLSVKSSFMTRQQLGDKSTSCHCPNVLGLYEVQQKTCCNYCVVSKDIFILGAIIRSMLVICTRLIFSHKSLIYVCTDLIPDVAGRENARWIPTVKISLMMALTPFLVWWIEIIGCLGEEK

SEQ ID NO: 180118 - protein, 894 aa, Glycine max
  Coding DNA Sequence Number=SeqID_88433
  Homolog annotation: Hit_ID=A7PRU4; Match level="QueryCoverage=99%, HitCoverage=99%, E-value=1e-118, Identity=33%"; Hit description =Chromosome chr14 scaffold_27, whole genome shotgun sequence
MEIQKKRFKGSFLSFFDWNGKSQKKLLCDRPNLPDVSKQGKENMDSMPKSQDNRIKMDNNRVNPSNNASCDIDCAISINSDEGCGAKVPGLVARLMGLDSLPVSTVSGLSSSSTSLYGSNSLGSSHSPDDDVLHSMVDCCCPVDPINMRLKPEKSSWAAMQSRAQKVGNPAMKRFQTEMLPPKSVKPIPVTHNKLLSPIKSPGYTQPKHAAHVMEAAAKIIEASSQPCRRNRMSSSGSSSVPLRILDLKEKLEAAQYEFKFMDTHTANPLNGKPSERRNNLYKSSSSFKGSRDSVKNSSCQLASKGKSASLAMPSKTNAQSRDELTLNGNRRYMRQNKQNDVKSNQFPRSQKKQIVDRARVMQQRACTGQSSNVLGKNNQKQNSVTNKGGSASKVDSNKPTQTWSSESSTGAKKTTKKVVVNANIEPKRFGTRITDTIKEFPVSKRKGIFQKKNYSSSDVHNEARGSNSAANTYENKSVKCNITTDRSIDQDAFSMKGSNGVISFTFTSPLRRNMPELQSSTEQVMGTRNEIEVNSCNSDKLYPQKSSFSPPRLHVIDGDALSVLLEKKLQELTSRINPPQCSLTTEGSSTGLRSSLEDKCQSVLSTTVREQDRIFRNKLDSMHDNCSSSDIMMLSMNQQLQTSESMEEPSCSSNSESQNGSYLHSAYGSTIYSSMQDEEVSNFSPMNESLSLENKAEWSEQSSSIVMGDNMASEQLSLMSNSAEYTRSARNMELEYVKDIFSNAELMAEEFVVGETDKIIMENLFDKLENEGLGAENYEEYSKIERKIIFDTVSECLELRCKQVFVGSCKAWPKWVASVQRKKCLAEEFYKEMLSFRNMEDGVEVDELVSKDMSTGWGRWLDFDIEACEEGSELEFDIVTCLINELVSDLLYV

SEQ ID NO: 180119 - protein, 332 aa, Glycine max
  Coding DNA Sequence Number=SeqID_88434
  Gene Ontology: Cellular component=spliceosome; Biological process =mRNA processing
  Homolog annotation: Hit_ID=A7PRX0; Match level="QueryCoverage=64%, HitCoverage=57%, E-value=4e-98, Identity=81%"; Hit description =Chromosome chr14 scaffold_27, whole genome shotgun sequence
  Pfam annotation: Domain name=PRP38; Domain location=1-177; Score =246.5; E_value=5.8e-71; Accession=PF03371.6; Description=PRP38 family
MANRTDPAAKSIRGTNPQNLVEKILRSKIYQNTYWKEQCFGLTAETLVDKAMELDHLGGTYGGNRKPTPFMCLVMKMLQIQPEKEIVIEFIKNEDYKYVRILGAFYLRITGSDIDVYRYLEPLYNDYRKLRRKLADGQFTLTHVDEVIDELLTKDYSCDIALPRVKKRWTLESLGSLEPRRSALEEDFEEEEEKEDNEQPVDEIEDKAYEKDHYRGRSPTRERDRDRRHDSHRHSVGVYLDCFPFLSLYYIPLSVQSTKGSYNISHPSSQLVVVKKTLTRMVLARSVSHANTITVQRLATLVLIVAISMVCQSGGCKSYTTFLMVETKDYNP

SEQ ID NO: 180120 - protein, 168 aa, Glycine max
  Coding DNA Sequence Number=SeqID_88435
  Gene Ontology: Mol. function=beta-N-acetylhexosaminidase activity; Cellular component=plasma membrane; Biological process=carbohydrate metabolic process
  Homolog annotation: Hit_ID=A7Q448; Match level="QueryCoverage=100%, HitCoverage=34%, E-value=8e-69, Identity=67%"; Hit description =Chromosome chr13 scaffold_48, whole genome shotgun sequence
  Pfam annotation: Domain name=Glyco_hydro_20; Domain location=1-118; Score=-170.2; E_value=0.047; Accession=PF00728.13; Description =Glycosyl hydrolase family 20, catalytic domain
MTAKDAYQYFVLKAQNIALTKNWSPVNWLGPGVCPKAVAKGFRCIFSNQGVWYLNYLNVPWDDVYTAEPLEGIRKASEQKLVLGGEVCMWGETADTSDIQQTIWPRAAAAAERLWSQRDSTSGNANIIALRRLHYFRCLLNRRGVPAAPVNNFNARTAPVGPGSCFEQ

SEQ ID NO: 180121 - protein, 327 aa, Glycine max
  Coding DNA Sequence Number=SeqID_88436
  Gene Ontology: Mol. function=hydrolase activity; Biological process =proteolysis
  Homolog annotation: Hit_ID=O80629; Match level="QueryCoverage=87%, HitCoverage=89%, E-value=1e-117, Identity=66%"; Hit description =Putative phospholipase
  Pfam annotation: Domain name=Abhydrolase_1; Domain location=74-294; Score=41.1; E_value=4e-09; Accession=PF00561.11; Description =alphabeta hydrolase fold
MASEAEIEYEEASEAEIKYDEEYVWNSRGLKLFACRWLPANGSPKALIFLCHGYAMECSITMKSTATRLAKAGYAVYGIDYEGHGKSEGVPGLVMNFDFVIDDCSEHFTTICEKAENKKKMRYLMGESMGGAVALLLHRKKPQYWDGAILVAPMCKISEEMRPNTVVVSVLSALSKVVPSWRIVPIPDIIDVAFKVPEVREEIRANQYCYKGNPRLRTAYELMRVSTEIEQSLHEVSLPFLVLHGEEDQVTDKAVSKQLYDVAASSDKTLKFYPKMWHGLLYGEPPENLQIVFSDIIGWIEQKTHHGNSRLERELKEEHEHLVKSDL

SEQ ID NO: 180122 - protein, 347 aa, Glycine max
  Coding DNA Sequence Number=SeqID_88437
  Gene Ontology: Mol. function=lyase activity; Cellular component =anchored to membrane; Biological process=pathogenesis
  Homolog annotation: Hit_ID=A7Q434; Match level="QueryCoverage=89%, HitCoverage=93%, E-value=1e-150, Identity=81%"; Hit description =Chromosome chr13 scaffold_48, whole genome shotgun sequence
  Pfam annotation: Domain name=Pec_lyase_C; Domain location=75-241; Score=152.0; E_value=1.6e-42; Accession=PF00544.10; Description =Pectate lyase
MAGMQKLPYGDVDSSLRALAGRAEGFGRLAIGGLHGPLYFVTTLSDDGPGSLREGCRRKEPLWIVFEVSGTIHLSSYLSVSSYKTIDGRGQRVKLTGKGLRLKECEHIIICNLEFEGGRGHDVDGIQIKPNSRHIWIDRCTLRDYDDGLIDITRQSTDITVSRCCFGQHDKTMLIGADPTHIGDRCIRVTIHHCFFDGTRQRQPRVRFGKVHLYNNYTRNWGIYAVCASVESQIYSQCNVYEAGTKKKTFEFYTEKAVDKEEQKSGFIISEGDMFLNGAEPSLLTENREESMFHPSEYYPTWTMEAAGHSLREVLLLCTGLHLLVYVGTIDITSSTFKIEGSLCPLF

SEQ ID NO: 180123 - protein, 249 aa, Glycine max
  Coding DNA Sequence Number=SeqID_88438
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q1KSH9; Match level="QueryCoverage=77%, HitCoverage=86%, E-value=6e-86, Identity=83%"; Hit description=PP2c
  Pfam annotation: Domain name=PP2C; Domain location=55-249; Score =24.5; E_value=2.4e-07; Accession=PF00481.12; Description=Protein phosphatase 2C
  Subcellular localization annotation: CTP_CleavageSite=66; ConfidenceScore=5.38e-01
MISNSDLVEPATATATAVATTASSSNEDQAAPPAAPNIVMSLGSRFSLQRRNGRFSYGYSSFKGKRSSMEDFFETKISEADGQTVAFFGVFDGHGGSRTAEYLKSNLFKNLSSHPDFIKDTKTAIVEAFKQTDVDYLNEEKGHQRDAGSTASTAVLLGDRIVVANVGVIPEWLHVELAQVDAMSVMCIVPLSIDHKPDRSNERQRIEQAGGFIIWTGTWRVGGVLAVSRAFGNKLLKPYVVADPEIQVA

SEQ ID NO: 180124 - protein, 1457 aa, Glycine max
  Coding DNA Sequence Number=SeqID_88439
  Homolog annotation: Hit_ID=A7Q415; Match level="QueryCoverage=80%, HitCoverage=98%, E-value=0.0, Identity=37%"; Hit description =Chromosome chr13 scaffold_48, whole genome shotgun sequence
MPVSGHEETGVKSYAGKFSGLIAGVPIKKRRFPTIQPSSAPVSEEPYSLTEETELQRKENSSTSQGPTLPNAAGAPIKKRKFPYLQPSLEEASRSEESDPLRKEHSSTSPGSTLSPSSSGLSDANGIPALEDKKASTDVTNANMVQSNSCFLTPKREQSNVRTQSCTLDVMDSKEKILSQGSNKKLESQIIKGNPELLLAAKEGLALSIGADVSKQNVQDICKQETPLVSGSPGLSLSLKEHVLPAVASMENDGNRQKTEKAESVSLELSLSKEDCSTHSLNTDAKTDSDTTCVQSNRANWDLNTTMDAWEESGTEAGLVKTSIDGLKITDGSLDEKQLVCSTGMTLPTSVVSVKPMCEESHKEAFTFPSGPCGQQFKFLDSSILSLTPIQKYTEEPSRLSVKLNSGSAIPNVSLSSLASTVGDANTSSFRLVKPEPFDESSKKDLKEANASPVGSLDSVAVKQELVQPSTANSSKLSNVSNLMKVDAASVKLEPNHEGSQEGSNAALSKMDQLNKDLRQGSDNSSPSLAMPVMPETTQISAEADCAPVKPLYTKELSTSENIVSQIENSSLTDGVDVEKVCHGVCLNAEQVTIETVAMPMVGNGSKLNDPGLQTFSVRTEEENAADRDACRLKLMNEPPPVPRGNGEGCVSDEEKITLSTDMLEDDSYGSDCESDENRAVTIGVDTERYVEDDDYEDGEVREPLDPSTAEDTICEVREVEHPDCSNFVNKQMEKGMVSGDCPTSYQLVENDNITAIQSEINNEVVDMDIEMHERSGKVIDKSVCVQESLDDEKSNIAAHGANVLQMKALDLLDGKNVCEALVAESPSNQATNGSHGVDFQCADEVVKTADIVKQTDLDFETMEVSANADDAAKDVNNGGNPGRIIVLSRATSSSSPGKTRPISGRSLSSRAGRDVLSDSLDGDKLHRGRDEVFIDGPHKFSRERHQDISPRNSRFNFVRGRGRLNSRLDSVRSEWESDREFSGEFYNGPSQFRGPRPKYAPAFADTDMEYNNVAPDGSYVGNGRLGRKPLNDGSYIAPRRRSPGGRDGIQIGHRNPRNISPNRCIGDGSDLVGVRHNDKFMRGLPEDNMDAMFTRSQTFEGMDGRFTRGSRNFSSMQRRGPPRIRSKSPIRSRSRSPGPWSSPRRRSPRRRSPDGFGGHPELSHRRSPFYRVDRMRSPDRPVFPAERVVRRHGSPSFMSRPSNDMRDIDSARDHGHPRSGRILIRNRRFDVVDPRDRAENDDEYFGGPMHSGRLLELSGEGNGEDRRRFGERRGPVRSFRPPYNNNVGENFHLNAEDGPRHYRFCSDDSDFHERGGNNIRERDFDRRIKGRPANVPPRRTRNMDEQEENFRHGGGGGGQPPGECWRIMEFIFAALVFKPIEVMIVKACIKCGQDCRGRCNWGMKVAERMMESGDVHARETNGIFVFNNLMERSYWFFGLAFSYQQRIIQSAKMIFT

SEQ ID NO: 180125 - protein, 95 aa, Glycine max
  Coding DNA Sequence Number=SeqID_88440
MELYMPITKNCSESSSLNRSAIPSNYHLSSNDTNINILFLSIASGMSPNDPPVFFFYNYGETRIYLHPGKPFTKLANFDRKVILMYWDVLCVGIL

SEQ ID NO: 180126 - protein, 124 aa, Glycine max
  Coding DNA Sequence Number=SeqID_88441
MLNLSAGKKKKKRDQKMKFLIRVGFGFQGNGYGETRNTTSVFEKKEKLKREKVREAWGREELTEKKRGCRMGQSKFQGSANTLLNMQNGRYLARSAREYLYANTTRRKYKPNLPESQVNLFTGN

SEQ ID NO: 180127 - protein, 79 aa, Glycine max
  Coding DNA Sequence Number=SeqID_88442
MKWCWGRAGHVGIADLHGTKGDKGVSCHEMAQVGLHGCWAMLQSGNCVMPKQELSAQLPLTGEAFWGSIFSKELRSISF

SEQ ID NO: 180128 - protein, 195 aa, Glycine max
  Coding DNA Sequence Number=SeqID_88443
MELKAEAEGWVQKTIEQDLSVLKTQRQRQVTRALCLVNKEYKRERLRGVWSLKSVLRVGAENGGEKENLFQVLKSKLSFLGAVIFGLPDVAMVKPTILVPELLLLAGPFVLSLTPCAGGIVGAVTLEAAAAVSAGAGKDGAEVGAAAVGLDAIGPVGIRDGDGLVGEGEAAGGEDGMAGVRLDGGPHDVVAVVDE

SEQ ID NO: 180129 - protein, 506 aa, Glycine max
  Coding DNA Sequence Number=SeqID_88444
  Gene Ontology: Biological process=intracellular signaling cascade
  Homolog annotation: Hit_ID=Q69T67; Match level="QueryCoverage=75%, HitCoverage=48%, E-value=1e-136, Identity=56%"; Hit description =Lustrin A-like
  Pfam annotation: Domain name=DUF231; Domain location=330-493; Score =228.8; E_value=1.2e-65; Accession=PF03005.6; Description=Arabidopsis proteins of unknown function
  Subcellular localization annotation: CTP_CleavageSite=34; ConfidenceScore=5.61e-01
MVDSPVLSPSPSVLRNRLLTRTDSMRFFSSRGVMSFAYGFTLASILFMLFFVLNPSSYQQLSPRLRNAFQSSRGSHFSNVFAHIFPNSPSSSHDSFHHPSSNSREEFSDHRLGSASSPSQISRKEGSGLIPKDSQSEEHRIQAPQQEPSLTAWSPSPTASPNEQQDWMDMWKNCDMYEGSWVRDDSYPLYNAGSCPYIDEPFNCFRNGKRENMYEKYRWQPKNCNVPRFKANEMLEMLRGKRLVFVGDSLNRNMWESLVCVLRNSVKDKSRLFEASGREEFRTEVFLVQEWEIPDQKGSTKETLRLDLLERSCDKYKDADVLIFNTGHWWTHEKRIEGKGYYQEGDHIYGQMNVEEAFHKALLTWAQWIDSNVDPKKTTVFFRGYSPSHFRGGEWNSGGKCDNETEPMESESDLETPEMMMTIDSVIKKMKTPVFYLNITKMTYFRRDAHPSLFRNENMTEETKRYMLSHQDCSHWCLPGVPDLWNELVYAHLLYNLNRNKNNPPK

SEQ ID NO: 180130 - protein, 78 aa, Glycine max
  Coding DNA Sequence Number=SeqID_88445
MTFMVLYEKGPLFDAYNPHIHADPNDLQNPMYNVNIEQILPARGQQGLEIWPGTQAPSVTKQAILLWSAFYSMSQRKL

SEQ ID NO: 180131 - protein, 39 aa, Glycine max
  Coding DNA Sequence Number=SeqID_88446
MDLDPMIALTLRFFGMHLDHQTLPVACLKVDNYGMEATK

SEQ ID NO: 180132 - protein, 380 aa, Glycine max
  Coding DNA Sequence Number=SeqID_88447
  Gene Ontology: Mol. function=structural molecule activity; Cellular component=chloroplast thylakoid membrane
  Homolog annotation: Hit_ID=A7P008; Match level="QueryCoverage=83%, HitCoverage=85%, E-value=1e-125, Identity=69%"; Hit description =Chromosome chr6 scaffold_3, whole genome shotgun sequence
  Pfam annotation: Domain name=PAP_fibrillin; Domain location=38-218; Score=215.3; E_value=1.5e-61; Accession=PF04755.3; Description=PAP _fibrillin
MALKLVNLGFHSSIPCSPRPLKDRFVLRSSKVEQISFTESENSLIEALLGIQGRGRSSSRQQLNAVERAVQVLERLGGVPDPTKSNLIEGRWQLIFTTRPGTASPIQRTFVGVDFFSVFQEVYLRTNDPRVCNIVSFSDAIGELKVEAAASIEDGKRILFRFDRAAFSFKFLPFKVPYPVPFRLLGDEAKGWLDTTYLSSSGNLRISRGNKGTTFVLQKQTEPRQRLLTAISSGKGIKEAIDELISLKQNTGQEDPELEEGEWQMMWNSQTVTDSWIENAVNGLMGKQIIRKNGRIKFLVDILLGLKFSMSGNFVKVGLRPWTKILKPKGTHLSPPESTCSKNVLRLQGKGILRESQELRLSRSNIRTWENFCGGINGNV

SEQ ID NO: 180133 - protein, 205 aa, Glycine max
  Coding DNA Sequence Number=SeqID_88448
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9XEG1; Match level="QueryCoverage=43%, HitCoverage=4%, E-value=2e-32, Identity=79%"; Hit description =Putative callose synthase catalytic subunit
MEKQRLRWFEGEKEGEKTKPKPYSFMTNRKKVANEEEDHTMMEGMHVRDSVGEYAHIFETLIAQTRGFTGRAIVGVHNPKEILRAVEIACAIEWGSSWKLNYGVGRKREQKLAKREAGTIDRSQDIARLQEFYKSYREKHNVDKLREEEMKLRESGAFSRDLGELERKTVKRKRVFATLKVLGTVLEQLSEEIPDEVGFLPSGHS

SEQ ID NO: 180134 - protein, 643 aa, Glycine max
  Coding DNA Sequence Number=SeqID_88449
  Gene Ontology: Mol. function=protein serine/threonine kinase activity; Cellular component=cytoplasm; Biological process=protein amino acid phosphorylation
  Homolog annotation: Hit_ID=A7P019; Match level="QueryCoverage=88%, HitCoverage=85%, E-value=0.0, Identity=79%"; Hit description =Chromosome chr6 scaffold_3, whole genome shotgun sequence
  Pfam annotation: Domain name=Pkinase; Domain location=113-357; Score =1.3; E_value=1.1e-08; Accession=PF00069.16; Description=Protein kinase domain
MPELRRGVRRGRGRGQKASEPARKELKARAAPRGRPRTRLAAKELERQEPLIPIPIPEPLIPIPEPAKEEKKKVGVGVNMGDESGGLSGNKPEEDATTPPFPDRVQVGGSPMYKVERKLGKGGFGQVFVGRRERATGAGAVEVALKFEHRNSKGCNYGPPYEWQVMDILGPSLWDLWNSSSQMMSSEMVSCIAVESLSILEKMHSKGYVHGDVKPENFLLGQPATVQEKKLFLVDLGLATKWRDTSSGQHVDYDQRPDMFRGTVRYASVHAHLGRTASRRDDLESLAYTLVFLHKGRLPWQGYQGDSKSFLVCKKKMGTSPETLCCLCPPPFRHFLETVVNMKFDEEPNYSKLISLFDGAIGPNPALRPINTEGAQKVGQKRGRLNVEDDDSQPRKKVRLGIPATQWISIYNARLPMKQRYHYNVSDARLEQHVERGVADGLLISCVSSCCNLWALIMDAGTGFTAQVYKLSTFFLHKEWIMEQWDKNFYITSIAGSNNGSSLVVMSKGTQYTQQSYKVSESFPFKWINKKWREGFHVTSMATAGSRWGVVMSRNAGFSKQVVELDFLYPSEGIHKRWDKGYRITATAATLDQSALILSIPRRKLSDETQETLRTSQFPGTHVKEKWSKNLYLACLCYGRTVC

SEQ ID NO: 180135 - protein, 84 aa, Glycine max
  Coding DNA Sequence Number=SeqID_88450
MACWSSRERSHNLYPSHGFPPQANYPFTVEKEMTHLLLLLATERTNSLLDDQTSSYEVGPSGEPIFKKPPSEDCSPWGDFQLPN

SEQ ID NO: 180136 - protein, 104 aa, Glycine max
  Coding DNA Sequence Number=SeqID_88451
MDEDDDNDVGNDLAEKRERKQPTSAGISPTAAAAHTSKKQAMVVGSSSRKQKAVQENDEDLEFEDIELESESEEEEIMEAANNDNGKAPHSSWRNYDDFNEYFW

SEQ ID NO: 180137 - protein, 463 aa, Glycine max
  Coding DNA Sequence Number=SeqID_88452
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9XEG1; Match level="QueryCoverage=86%, HitCoverage=21%, E-value=1e-171, Identity=74%"; Hit description =Putative callose synthase catalytic subunit
MVNLVGGTNLENLEKGFDNPFHQWSSHIREGDIAVESKDTQDELWDRISRDDYMMYAVQECYYTIKFILTEILDDVGRKWVERIYDDINASITKRSIDGDFKLSKLAVVISRVTALMGILKETETPELERGAVRAVQDLYDVMRHDVLSINLRENYDTWSLLSKARDEGHLFEKLKWPKNTDLKMQVKRLYSLLTIKESASSIPKNLEARRRLQFFTNSLFMKMPRAKPVREMLSFSVFTPYYSEIVLYSMAELLKKNEDGISILFYLQKIYPDEWKNFLARIGRDENTLESELYDNPGDILELRFWASYRGQTLARTGKLLCFRPIWRGQLLEAAIGCDEVTNTHGFELSPEARAQADLKFTYVVTCQIYGKQKEEQKPEAADIALLMQRNEALRVAFIDVVETLKEGKVNTEYYSKLVKADINGKDKVLFFYTFCIYRSIFYFLYVYFSYDSGHRVLLKSG

SEQ ID NO: 180138 - protein, 399 aa, Glycine max
  Coding DNA Sequence Number=SeqID_88453
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9XEG1; Match level="QueryCoverage=70%, HitCoverage=14%, E-value=1e-128, Identity=80%"; Hit description =Putative callose synthase catalytic subunit
MGADFLEEIQAININLQQLDKWVWTNDTTGKYTVKSAYQLLDKNSKDDNTNGIFHAIWKLKIPNKADMVGILVLDQHGGIFFATPKAEFHAALILQCTSWYQVTKMVNLVGGTNLELEVALLLIVYLAYGYNEGGALSYILLSISSWFMALSWLFAPYLFNPSGFEWQKVVEDFRDWTNWLLYRGGIGVKGEESWEAWWEEELAHIRSLGSRIAETILSLRFFIFQYGIVYKLNVKGTSTSLTVYGLSWVVLAVLIILFKVFTFSQKISVNFQLLLRFIQGISLLVALAGLVVAVILTELSLPDIFASMLAFIPTGWGILSIAAAWKPVMKRFGLWKSVRSIARLYDAGMGMLIFVPIAFFSWFPFVSTFQTRLMFNQAFSRGLEISLILAGNNHNTGI

SEQ ID NO: 180139 - protein, 110 aa, Glycine max
  Coding DNA Sequence Number=SeqID_88454
MTSEEYKYIGSKWGCKVYKGRHLVSRRQKNKDVDKRCRTTLNSCVCYYFSYGIIFVVFSRSFVGVSNFICGSVDYPTRMRLVLAAVLVEARGSRDKCNCGNKKKAIHCRG

SEQ ID NO: 180140 - protein, 208 aa, Glycine max
  Coding DNA Sequence Number=SeqID_88455
  Gene Ontology: Cellular component=integral to membrane
  Homolog annotation: Hit_ID=A7QSR5; Match level="QueryCoverage=95%, HitCoverage=49%, E-value=1e-21, Identity=34%"; Hit description =Chromosome chr4 scaffold_162, whole genome shotgun sequence
  Pfam annotation: Domain name=Mem_trans; Domain location=1-208; Score=- 91.2; E_value=0.0012; Accession=PF03547.9; Description=Membrane transport protein
MELDTSTFGLSCTTSSAYSCRIFNVNKVDDSKVGPVSAIETDLENHSAEPVVTAEDLSQANDHVPKQKQIMKPLKPLVQKLNLKVLLATATIGSILGLIIGVVPPFQKMFVGDDAPLGVIEDSASMLGDASIPAITLLLGANLLNGLKRSGMKLSLVVRIIIVRYIVLPILGVAIVKGAIHFGIIQHDPLYQFILLLQYALPPAISIT

SEQ ID NO: 180141 - protein, 624 aa, Glycine max
  Coding DNA Sequence Number=SeqID_88456
  Homolog annotation: Hit_ID=A7NXH6; Match level="QueryCoverage=98%, HitCoverage=99%, E-value=1e-162, Identity=49%"; Hit description =Chromosome chr5 scaffold_2, whole genome shotgun sequence
MENTGLWIQKEGHGRKDSLRGLLNDREISEEEDSSKSQLKKLIKRSNSHRAIVVNAIQSQISKVFLKDLFVQRVHGLDNRIPKHVVSVDEKYIHRCLEFIHNTALKAAQFNIPESLRATNMETLSESLNTAKFFGGNACGSGHFVFECPVVTETGRVVISANAGDQWTLGTIMGSKSMINILNSTLLQQFGASHRTDNLNRMNFSDPEGLVCYDFMDSPSDLCISSSYKLEKEKQLVRSHKYGPISVHKRLVSTSSTTSTCSDWLSSTSSNLSQGMIQCTWKQGIPHFVFSADDQKEVYVTKLRKVDSTDNKALDYVYEFHLNKGGQKGREIPDGDLPFVGKMHVSTSFTLCPNNCRIRETEFTLFHNIEISDKEMSASEHAHRKSKGLSKKVSKVFKTSPSSKRRTLSKFGGSSAISESCPWEPYALGGTNLLDTDVPPNIEMAAVVVKNHLPCKKPEKVGGWGLKFLNKSGENQVTLPSESCNQNNGNCSTSTSILIPAGLHGGPRTRNGGPSSLIDRWRSGGHCDCGGWDEGCPLTVLERRSNKADVMSKIDTQDECKSVDLVTQGSSDYSPTLRMVNVHDGLYYIHFHPPLSALQSFSIVVAIIHAQSPTLQPNGAKKLS

SEQ ID NO: 180142 - protein, 434 aa, Glycine max
  Coding DNA Sequence Number=SeqID_88457
  Gene Ontology: Mol. function=transcription factor activity; Cellular component=nucleus; Biological process=regulation of transcription, DNA-dependent
  Homolog annotation: Hit_ID=Q0HA68; Match level="QueryCoverage=96%, HitCoverage=82%, E-value=1e-152, Identity=63%"; Hit description =DELLA protein
  Pfam annotation: Domain name=GRAS; Domain location=44-331; Score =386.0; E_value=5.9e-113; Accession=PF03514.5; Description=GRAS family transcription factor
MERLENVISDTILYDPSNIGLGSLVDTLLSDLDQTMSLPSHYHLSSDLPDFATTVEEHSGIRLIHTLMTCADSLQRGHFSFAASLIQNMQGLLAHVNTNCGIGKVAACFIDALRRRISNKFPASSAYENDVLYHNYYEACPYLKFAHFTANQAILEAFNGHDCVHVIDFNLMQGLQWPALIQALALRPGGPPLLRLTGIGPPSAENRDNLREIGLRLAELARSVNVRFAFRGVAAWRLEDVKPWMLQVSPNEAVAVNSIMQLHRLTAVKSAVEEVLGWIRILNPKIVTVVEQEANHNGEGFLERFTEALHYYSSVFDSLDACPVEPDKAALAEMYLQREICNVVCCEGPARLERHEPLAKWRDRLGKAGFRALHLGFNAYKQASMLLTLFSAEGFCVQENQGSLTLGWHSRPLIAASAWQAAPLGDDETLRFEH

SEQ ID NO: 180143 - protein, 172 aa, Glycine max
  Coding DNA Sequence Number=SeqID_88458
  Gene Ontology: Mol. function=nucleic acid binding; Cellular component= intracellular; Biological process=transport
  Homolog annotation: Hit_ID=A7NXI7; Match level="QueryCoverage=95%, HitCoverage=33%, E-value=1e-44, Identity=56%"; Hit description =Chromosome chr5 scaffold_2, whole genome shotgun sequence
  Pfam annotation: Domain name=NTF2; Domain location=14-128; Score =101.5; E_value=2.5e-27; Accession=PF02136.11; Description=Nuclear transport factor 2 (NTF2) domain
MATHFPFPLSAAQVGTYFVGQYYHVLETNPELVYQFYSDASTMVRIDGNARDTATAMLQIHALVMSLSFIGIEIKTAQSLESWSGGVLVMVSGSVQLKGYNVRRQFMQTFFLAPQEKGFFVLNDVFHFVEEEPVHHHQPVFLAQSNLDSKLNAPSTINKPGKFYFRLRVLEF

SEQ ID NO: 180144 - protein, 790 aa, Glycine max
  Coding DNA Sequence Number=SeqID_88459
  Gene Ontology: Mol. function=aspartic-type endopeptidase activity; Biological process=DNA integration
  Homolog annotation: Hit_ID=A5B9U7; Match level="QueryCoverage=54%, HitCoverage=98%, E-value=2e-95, Identity=45%"; Hit description =Putative uncharacterized protein
  Pfam annotation: Domain name=CCT; Domain location=667-736; Score =53.3; E_value=8.7e-13; Accession=PF06203.5; Description=CCT motif
  Pfam annotation: Domain name=TLD; Domain location=269-357; Score= -2.9; E_value=3.3e-05; Accession=PF07534.7; Description=TLD
  Pfam module annotation: Pfam domain module=CCT::TLD; Domain location =667-736::269-357
MKTNDDKSEANVVQNFEDEDLYLATTNEVAKSKWIMDSPASKHICRDRAMFDTLKTNGEFGHFNLGNGEKMKVEVIETVRMKLHNNIIQTFQNVRFVPSATTNVISLGEMTSPGYRYVGLNWGCKDSPYSQEDKPLSSYLSYIIPSVSFDGSKTNKNQHELKPIQSTSAGYNYENFEYQDVPSDNYVDCTNMDLLKDDNDNINEDPISRRTSSSSSSEVFEEANEQQTPNTSKKSRLNLTDDSTFISPELYEFLEICLPNIVKGRQWVLLYSTLKHGVSLRTLIRKSAELSCPGVNRYYYMCLNGLLALGGGGNYALCLEEDLLTGTSGPSDTFGNKCLAHSPEFELKNVEDVFDQPLPPKAEPQQQLPLDEISSPLSARIFELCNTDFFPEALQNSEVTSSSNCCYEENSSYATTNISVTVDVDNKLNSNSNTVTTPTSTTTTNTNNNTTNSSNLSIFFDSQEEIDNDISASIDFSLSPSFNVPPFLPVSSQQEQFDFSSVQHQVQLAACSVVEGFTQYPTDAVAPPFMGAPLPSVFEEDCISSVPSYMPLNPSSPCTYLSPGMPPYMPHGPLTTALSTDSSGIFGGNILLGSELQTQELEYQGENGRMYCTDSIQRVFNPPDLQALGTESQQLVPGAGGSGTLTPEISNLEDSSFKVGKLSVEQRKEKINRYMKKRNERNFSKKIKVFLAYKQPLVIAYFQVQLMMQPNMQYACRKTLADSRPRVRGRFAKNDDFGETNRTTSSNHEEDDEEEVVMKDEDDMVDSSDIFAHISGLNSFKCNYSIQSWI

SEQ ID NO: 180145 - protein, 322 aa, Glycine max
  Coding DNA Sequence Number=SeqID_88460
  Gene Ontology: Mol. function=receptor activity; Cellular component =extracellular region; Biological process=protein amino acid phosphorylation
  Homolog annotation: Hit_ID=A7NXI1; Match level="QueryCoverage=86%, HitCoverage=91%, E-value=1e-105, Identity=67%"; Hit description =Chromosome chr5 scaffold_2, whole genome shotgun sequence
  Pfam annotation: Domain name=DUF26; Domain location=183-234; Score =52.1; E_value=1.9e-12; Accession=PF01657.8; Description=Domain of unknown function DUF26
  Pfam annotation: Domain name=DUF26; Domain location=79-133; Score =49.3; E_value=1.3e-11; Accession=PF01657.8; Description=Domain of unknown function DUF26
  Pfam module annotation: Pfam domain module=DUF26::DUF26; Domain location=183-234::79-133
MGFPRKSLFLLLFLILFTNLAESASDYTTLVYKGCSKETFTDPNGVYSQALSSLFGSLVSQSTKAKFFKATAGSGQSSMTGLFQCRDDLSNSDCYNCVSRLPVLSDKLCGKTTAARIQLLGCYMLYEVVGFTQISGMQILYKTCGGTNAAGRGFEERRDTAFSVMENGVVTGHGFYATSYQSLYVMGQCEGDVGDSDCGECVKSAVQRAQVECGSSISGQVYLHKCFISYSYYPNGVPGRHSSSASSSSNSYSSSSSSSGQNTGKTVAIIVGGAAGVAFLVICLMFARSLKKKRDGRCYVIHGYMEWMAHIIDSGRWLIEEA

SEQ ID NO: 180146 - protein, 557 aa, Glycine max
  Coding DNA Sequence Number=SeqID_88461
  Gene Ontology: Mol. function=binding; Cellular component=nucleus; Biological process=metabolic process
  Homolog annotation: Hit_ID=A7NSY3; Match level="QueryCoverage=88%, HitCoverage=89%, E-value=1e-106, Identity=39%"; Hit description =Chromosome chr18 scaffold_1, whole genome shotgun sequence
  Pfam annotation: Domain name=PPR; Domain location=120-154; Score =48.3; E_value=2.7e-11; Accession=PF01535.11; Description=PPR repeat
  Pfam annotation: Domain name=PPR; Domain location=189-223; Score =44.2; E_value=4.5e-10; Accession=PF01535.11; Description=PPR repeat
  Pfam annotation: Domain name=PPR; Domain location=290-324; Score=9.1; E_value=0.66; Accession=PF01535.11; Description=PPR repeat
  Pfam annotation: Domain name=PPR; Domain location=351-385; Score=9.5; E_value=0.58; Accession=PF01535.11; Description=PPR repeat
  Pfam module annotation: Pfam domain module=PPR::PPR::PPR::PPR; Domain location=120-154::189-223::290-324::351-385
MKSLGFVPDPFTFSSVLGALSLIADEERHCQQLHCEVLKWGALSVPSVLNALMSCYVCCASSWLVDSCVLMAAARKLFDEVPPGRRDEPAWTTIIAGYVRNDDLVAARELLEGMTDHIAVAWNAMISGYVHRGFYEEAFDLLRRMHSLGIQLDEYTPVILFYVNNVLITLYTRCGKLVEAREMPERSLLTWTVMISGLAQNGFGEEGLKLFNQMKLEGLEPCDYAYAGAIASCSVLGSLDNGQQLHSQIIRLGHDSSLSVGNALITMYSRCGPVEGADTVFLTMPYVDSVSWNAMIAALAQHGHGVQAIQLYEKIAPIWEALLAGCWIHGNMELGIQATERLLELMPQQDGTYISLSNMYAALGQWDEVARVRKLMRERVVKKEPGCSWIQISGAMVHEMRKLGYVPDPKFVLHDMESEQKEYALSTHSEKLAVVYGIMKLSLGATIWVLKNLRICRDCHNAFKYISKLVDQEIIVRDRKRFHHFRNGECSCSNYCLKDGNLPSANPLLLHMDDRVDYCYIKSLTIYNFCFKRLLALTIASSTAIQLSGAQFKCPGR

SEQ ID NO: 180147 - protein, 106 aa, Glycine max
  Coding DNA Sequence Number=SeqID_88462
  Subcellular localization annotation: CTP_CleavageSite=81; ConfidenceScore=5.45e-01
MSPKTPPSPPSTAATPQFRTAATTIVPLINANLKKKKQIDRGYGNLRNCTNHSSTNSTPPSAVANCSRPFSLLMSPNVAVCASATFSPTLTWSFLLALRIYARCLR

SEQ ID NO: 180148 - protein, 411 aa, Glycine max
  Coding DNA Sequence Number=SeqID_88463
  Homolog annotation: Hit_ID=A7PBH2; Match level="QueryCoverage=85%, HitCoverage=72%, E-value=1e-148, Identity=72%"; Hit description =Chromosome chr16 scaffold_10, whole genome shotgun sequence
  Pfam annotation: Domain name=Tim17; Domain location=59-195; Score= -12.6; E_value=0.0035; Accession=PF02466.10; Description =Tim17Tim22Tim23 family
MAPPSSPPLVDNSDAERRLREAEERLRDAIEELQRRQRRAAAHAQQHRHVDSLPCDHGPDESCVAHAIGNLCQTFLLSYGVRVGIGILLRAFKLVRGQSYSSLLDLKQLVSEKDLIVREEACRIGLLFGGFTGSYHALRCLLRKLRKKETPANAVLAGSIAGFSIMALNDSNRRRTLALYLLARLAQVMYAFVMRPESLPKSYQDFIQKTGPVAEPVYKAVRDSCRGHPVDVASLHAYLSRVGRSDYVKLEEFPSIIPCSIIHPATNSCLAHQGNATSLTFKKTFPLYFSLTFVPFVVLHLQKFTDAPFRTFWLAIKGAVRSTTFLSAFVGIFQGVICSHRKVFSRDHKLVYWIAGGIAALSVLLEKKARRGELALYVLPRAVDSLWYILVNRHLLPNIRNAEVCPLVTLH

SEQ ID NO: 180149 - protein, 783 aa, Glycine max
  Coding DNA Sequence Number=SeqID_88464
  Gene Ontology: Mol. function=ATP-dependent DNA helicase activity; Cellular component=cytoplasm; Biological process=DNA repair
  Homolog annotation: Hit_ID=A7PBM9; Match level="QueryCoverage=70%, HitCoverage=88%, E-value=1e-104, Identity=65%"; Hit description =Chromosome chr16 scaffold_10, whole genome shotgun sequence
  Pfam annotation: Domain name=PPR; Domain location=97-131; Score=18.4; E_value=0.026; Accession=PF01535.11; Description=PPR repeat
  Pfam annotation: Domain name=UvrD-helicase; Domain location=50-521; Score=64.6; E_value=3.3e-16; Accession=PF00580.12; Description =UvrDREP helicase
  Pfam annotation: Domain name=Viral_helicase1; Domain location=336 -565; Score=-50.3; E_value=0.013; Accession=PF01443.9; Description =Viral (Superfamily 1) RNA helicase
  Pfam module annotation: Pfam domain module=PPR::UvrD-helicase::Viral _helicase1; Domain location=97-131::50-521::336-565
MIFPTNLRFASSPSSQHCAGEVDCYGEEIDWKEEGWVMERGKLKRQLNGWTKGSKLVLVAFRSGLTLNSKVIEMYGNCKNTIDARMVFNHMPNKNMDSWHLMMRGYANNTYGDEALQLFEHMNELGSYQLVSEPSTMSLSYKRATWVVMLALQCSLGNSQRASAHPSRVGAGAANRGGVLGSNCQAKASGRTSAEYRKMGNEIGAAILKNYNNILKSCNALDYHDLISCSVKLLSDFPEECQDSWKAIVIDEFQDTSAMQYKFLKMLASHHKITIVGDDDQSIYSFNGADISGFISFRNDFPNYKEIRLNKNYRSTRCIVEAASSLIQNNSKRCQLKNVLTDNSSGSKIVMKECHNEDAQCAFVVDKIIEISSNYSAANCCYGNIAILYRRQISGKAFQMAFRDRKIPFNIHGVAFYRKKFTLNETLFIHGLNCTFLQVLQYLLDDVSEFLSTKLVEVKEEREISEDKGCIFVLKAFIDYLLEREKENFGARRKDNENSVTLTTIHQAKGLEWDVVFIVKANDSEIPLLHDFKGTVKDTAALLEEERRLLYVAMTRAREKLFILHVMMDSNWQMLQPSRFLKEIPRHLTEVQGEISFQELLIKQEALQKETAHCTTDLLIKEKQSEADVIPMPHEILDNHSSETSNELAQFAEANNRNDFLRRFSVENRSIVSHLFHQWAKKKAFQDPKRLLDKVLRWEQIPADKRAHLMREKQEHFLKLKIENAMGSATPTDKQVCVGSSPIRWAWIADSAGKEATDQASKKWGHGFWFVFQAMPTTQSPPS

SEQ ID NO: 180150 - protein, 635 aa, Glycine max
  Coding DNA Sequence Number=SeqID_88465
  Gene Ontology: Mol. function=ATP binding; Cellular component =chromosome; Biological process=DNA metabolic process
  Homolog annotation: Hit_ID=A7Q229; Match level="QueryCoverage=88%, HitCoverage=53%, E-value=0.0, Identity=64%"; Hit description =Chromosome chr13 scaffold_45, whole genome shotgun sequence
MGEGSRFGGDVAIQLIGTHKLGEFAGLARGVVVGIAVGKSLVMVTQLVKEGSTVAIDFLLGMVEREGREKIRKGAEKIFEAYKWVQDHRHEFNKEVYGPVLLEVNVSNKDHAAYLEGQVAHYTWKSFITQDSGDRDLLAKHLRFFDVNVLNYTGGDGPQREPFEISEDKRALGIYSRLDQIFDAPIAVKEYIGSEKSDQNAGEVRKLGILDFWTPENHYHWSKSRYANYESAVVNQVQRPQLLLNNLNVGEIEKLSSEQRELEEIVANLEESVKRFHDEERSLLNQSANLRKQWEDISITVQNEQKKRQAIISRIDQKKKFLKLMEERDDLDTEIAKLVDQATKYNIRRFHNAMEIKDLLVEAVSYRRIFIEQRMAFIEFDAKEMMKSGTAKMEANLKQHEKFALQASLHFDNCKKESENCRQDLTDSLKYAKSIARLTPELKKEFLEMPTTIEDLEAAIQDTTSEANSILFVNHNILEQYEDRQQQIEDLAAKLEADKKESTRCLAELNNIKGKWLPTLRNLVAKINETFSFNFQEMAVAGEVSLDERDMDFDQFGILIKVKFRENGQLQNLSAHHQSGGERSVSTIVYLVSLQDLTNCPFRVVDEINQGMDPINERKMFQQLVRAASKPNTPQ

SEQ ID NO: 180151 - protein, 68 aa, Glycine max
  Coding DNA Sequence Number=SeqID_88466
MSTNLDAPNEDVLIEAREDSTAVPHLSGFLFASPVASTGIELSATANDENNDGGGGGGLEDAETIVNH

SEQ ID NO: 180152 - protein, 119 aa, Glycine max
  Coding DNA Sequence Number=SeqID_88467
  Gene Ontology: Mol. function=protein binding
  Homolog annotation: Hit_ID=A4Q530; Match level="QueryCoverage=98%, HitCoverage=97%, E-value=2e-33, Identity=51%"; Hit description=BSD
  Pfam annotation: Domain name=BSD; Domain location=61-118; Score=11.3; E_value=0.013; Accession=PF03909.8; Description=BSD domain
MSSRQVVKRAKYKTTVKDPGTPGVLKLTQDKFVFKPNDPTSKTKLDVEFRFIQGVALNKQVPGEATKVISEEQLSPAEMALKIKLLQEDSKLQRLHKELVASGKLTESEFWATKKVKIF

SEQ ID NO: 180153 - protein, 1000 aa, Glycine max
  Coding DNA Sequence Number=SeqID_88468
  Homolog annotation: Hit_ID=Q1RSI3; Match level="QueryCoverage=91%, HitCoverage=96%, E-value=0.0, Identity=63%"; Hit description =Contains similarity to Chlamydia outer membrane protein , related
MAEGSSSADIQRILAAIKSSEASFFLFLLSLFLFLNYILSLWSQILGLTFWENFTCLDVTQCMLNRSIIHVALSYMDFNPSSCLPQFLTLGVKASVWCGKHLKMSLLSTEDSEEDEHSSVFYQLLMEILRFSASTFSTLLKFTDFGDKELMDTVEIFILEALNLTKDSISDAKKIQSFGSEILKVAHMVIDAVVKLCKTRSELINQEGGDEKWLRLDKPATFDHVIHITKCAIEKLSQIGVLAANDGGNSVNILNVSWKGVVSLLQGGGGHFTEVNIANIVLTLLALITEPLKCAAQAWSSSLNEAISVTEAKRIFVPVKFYLINAVKICSLYPHQAYTVYKEITLCVLKIKCFWIFVSNENLLKCASVIITELLEETTLNLLLSLLNSHKLKLEQRLQVLEWLFINKGDCHSGLDCPTLSDCNLAWVNEIFCNSYESMSRSKILILGRVVLFINFLRHSLELDGDVRIAITQKLYWFLDVLVEEDVYSHILVLQFPLLYGSGKTVELLWQPMFTFLLQAFKTFMIVISSSTAWEELESFLLENFFHPHFLCWEIVMECWCFMLRYAETQMANSILGKLCSLLKLSASSYSVFLPYSSFRKLARSICMLLTDGAQSMVNVVYMSLVGDGKSHLSSVFCLALFMEGFPFDLLTDELRKTSIQRIISDYFDFIDNFDEAPLMACSSGLFGVPVFILSVSLQSLQDGLSDIDERALKFLVAISSNYKSTVDKVIKDRFLQLFSETLGIISYLKKLYTSNAIEQVIMEIQNIFLSEPPALLDKCKPHLAQFLAGLVHMEISESDDDAKSCAVWELYHLLLKERHWALSHLAITAFGYFASHTRCNKLWRFVPEDAALSYDTVSGVESDQQRFMVEFGKFLKKEIALLTLEPSPEQLDLLGREGFVLKQMVQKISATAEEREKCEIMDVDHKNQSNKKRKLPDGISRGFSQLEDVITNFEELTGSGEHSSTKSVYVKTKLLMYRSNVFTLNEEVRSEIRRKEDRK

SEQ ID NO: 180154 - protein, 272 aa, Glycine max
  Coding DNA Sequence Number=SeqID_88469
  Gene Ontology: Mol. function=protein binding
  Homolog annotation: Hit_ID=Q1RSH7; Match level="QueryCoverage=100%, HitCoverage=67%, E-value=4e-99, Identity=68%"; Hit description =General transcription factor IIH component, related
MEMEHPRTVAEILARRKQDEERQNRISKMTLIDDLQAQDNHPYAPLCIKDPRDYFDFQQANAVKTLDDSQTGMEQMKCSLGSEEAYGSLRASISKIKTTGLRDPLFSPDVALKVLNGLTKNISSPKYHLGRSSQGSVLDILPNTTKETLLDHWVCSQELLRHFWSSYPITTQNLVNKMLGSPTSLSHISVGQLHLVPIGFKMKSNMTRRLKESISQIYSKLEDIKVSAESDLRHHVSLVVHPMQQALNAALLHYEADIRKRNARGQKPNGYV

SEQ ID NO: 180155 - protein, 499 aa, Glycine max
  Coding DNA Sequence Number=SeqID_88470
  Gene Ontology: Mol. function=unfolded protein binding; Cellular component=mitochondrion; Biological process=cellular protein metabolic process
  Homolog annotation: Hit_ID=Q1RSH4; Match level="QueryCoverage=99%, HitCoverage=99%, E-value=0.0, Identity=91%"; Hit description=GroEL -like chaperone, ATPase
  Pfam annotation: Domain name=Cpn60_TCP1; Domain location=54-481; Score=348.7; E_value=1e-101; Accession=PF00118.15; Description=TCP -1cpn60 chaperonin family
MYRFATSLASKARIARSSTQQIGSRVTWNRNYAAKDIKFGVEARALMLKGVEELADAVKVTMGPKGRNVVIEQSFGAPKVTKDGVTVAKSIEFKDKVKNIGASLVKQVANATNDVAGDGTTCATILTKAIFTEGCKSVAAGMNAMDLRRGINMAVDAVVTNLKSRARMISTSEEIAQVGTISANGEREIGELIAKAMEKVGKEGVITISDGKTLYNELEVVEGMKLDRGYISPYFITNQKNQKCELEDPLIIIHEKKISSINAIVKVLELALKRQRSLLIVAEDVESDALATLILNKLRAGIKVCAIKAPGFGENRKSGLQDLAVLTGGQLITEELGLNLEKVDLDLFGSCKKITISKDDTVILDGAGDKKAIEERCEQIRSAIENSTSDYDKEKLQERLAKLSGGVAVLKDFIWHFILWFCHDKTNICHFCRLEGAVGEYVDMVKTGIIDPLKVIRTALVDAASVSSLMTTTEAVVSELPKDDKDVPAMGGGMGGMDY

SEQ ID NO: 180156 - protein, 255 aa, Glycine max
  Coding DNA Sequence Number=SeqID_88471
MDYFNGNQCTCTSPRPNKSLTLRIMAITWTETNTTTTKQPGNQHHKEVRMEDQTNLSSMVRRLQAQVSDMCRHLAEETMVLQKENAQLREAKSTTVKMSKATNVSAQQDIHPESVNTLQLEQYKNPFVPDIMETTHPSNWKNLNIEKRRKCHFKFVNNLCKKPTSDMDELRQRTTKYMHMEELTKYENQVQAKATRKSASPTLTRLWRKDEGIDRLENLVTPINPPYHKQISHPELSLVHQNSSHTKQNQHSVQD

SEQ ID NO: 180157 - protein, 82 aa, Glycine max
  Coding DNA Sequence Number=SeqID_88472
MNGVGVAEQWSDVPFRMDDADDMIIFNSLCDAVSHGWSLSDSTTTKPENDAADQRPAHEISYSDCQNDDSKAAVLAQKMTMG

SEQ ID NO: 180158 - protein, 322 aa, Glycine max
  Coding DNA Sequence Number=SeqID_88473
  Gene Ontology: Mol. function=transferase activity, transferring glycosyl groups; Cellular component=integral to membrane; Biological process=metabolic process
  Homolog annotation: Hit_ID=A7ISD3; Match level="QueryCoverage=58%, HitCoverage=39%, E-value=2e-64, Identity=64%"; Hit description=1,6 -rhamnosyltransferase
  Subcellular localization annotation: CTP_CleavageSite=36; ConfidenceScore=5.48e-01
MGVATCTQIASDSCNSPLGLHPLQKPAKACPNSLVMVATSTCRQLATTSGVFHATWLRTANSPLTITVCYRTHAKYVENNPHVIFFKRTPFGKIFCKSTPSGEICLMFLFTRFGEKTLTRYERVLRSLSECSKRDSETFLNEDQIKELATGLELIGLPFILVLNFPSNLSAKAELERALTKGFLERVKNRGVVHTGWFQQQLALKHSSLGCYVCHGGFSSVIEALINECQLVLLPFKGDQFFNSKLIANDLKAGVEVNRGDEGGFFHKEDIIDAIKTIMMEDNKEQGKQTRESHMQWSMFLSNQEIQNKFITDMVAQLKSMA

SEQ ID NO: 180159 - protein, 68 aa, Glycine max
  Coding DNA Sequence Number=SeqID_88474
  Gene Ontology: Mol. function=6-phosphofructokinase activity; Cellular component=6-phosphofructokinase complex; Biological process=glycolysis
  Homolog annotation: Hit_ID=A7PBV5; Match level="QueryCoverage=77%, HitCoverage=9%, E-value=4e-20, Identity=86%"; Hit description =Chromosome chr16 scaffold_10, whole genome shotgun sequence
MTLTRYALYIYPTYMIRAIASNASDNIYCTLLAHGAVHGAMAGYTGFTVGPVNSKQAYIPIAVSGSFH

SEQ ID NO: 180160 - protein, 218 aa, Glycine max
  Coding DNA Sequence Number=SeqID_88475
  Gene Ontology: Mol. function=5'-nucleotidase activity; Cellular component=endoplasmic reticulum; Biological process=nucleotide metabolic process
  Homolog annotation: Hit_ID=A7QNS7; Match level="QueryCoverage=86%, HitCoverage=62%, E-value=2e-79, Identity=74%"; Hit description =Chromosome undetermined scaffold_134, whole genome shotgun sequence
  Pfam annotation: Domain name=UMPH-1; Domain location=41-215; Score =49.5; E_value=1.2e-12; Accession=PF05822.3; Description=Pyrimidine 5'-nucleotidase (UMPH-1)
MEEVKVASDLLVGDPASLEKKIDAIRLGGPQKLQVIADFDATLTKFWVNGTRGQTSHGLLQQGNPEYDAKRQQLYEYYHPLEFSPTIGLEEKTKLMEEWWGKTHGLLVEGGLTYDSIRQSVANANIAFREGVSELFEFLEERDIPVLIFSAGLADIIEEVLRQKLHRSFKNVRIVSNRMVFDDDGRLVSFKGDSVFPTFISYIFVGLSSSFSYPNTSF

SEQ ID NO: 180161 - protein, 259 aa, Glycine max
  Coding DNA Sequence Number=SeqID_88476
  Gene Ontology: Mol. function=metal ion binding; Cellular component =integral to membrane; Biological process=ubiquitin cycle
  Homolog annotation: Hit_ID=A5C345; Match level="QueryCoverage=91%, HitCoverage=44%, E-value=9e-16, Identity=36%"; Hit description =Putative uncharacterized protein
  Pfam annotation: Domain name=PHD; Domain location=105-160; Score= -7.4; E_value=0.097; Accession=PF00628.20; Description=PHD-finger
  Pfam annotation: Domain name=zf-C3HC4; Domain location=106-154; Score= 11.5; E_value=0.0044; Accession=PF00097.16; Description=Zinc finger, C3HC4 type (RING finger)
  Pfam annotation: Domain name=zf-C3HC4; Domain location=218-257; Score= 2.5; E_value=0.048; Accession=PF00097.16; Description=Zinc finger, C3HC4 type (RING finger)
  Pfam module annotation: Pfam domain module=PHD::zf-C3HC4::zf-C3HC4; Domain location=105-160::106-154::218-257
MNNSTSNKEDNGFDPSEFTYGVAFVIGLVFLLVTIAFACVRLRMARGPNMLNILAGIPPSRQARSEEDSAEQGLHHIDTSFESYPKLLYSQVEKGSSSSSVVSSSCSICLGDYKESDTLRLLPHCDHLFHLACVDPWLSFIVLTLIVTLTAYVCSNNIPRTIPSVPGGATHSNNNHTIITVETPEPRLDHTSVRSYPSLQFSKAKLCSSNSNSSSSSCSICLMDYKECDSLRVLPACAHFFHVKCVDPWLRINLTCPGA

SEQ ID NO: 180162 - protein, 240 aa, Glycine max
  Coding DNA Sequence Number=SeqID_88477
  Gene Ontology: Mol. function=protein binding; Cellular component =cytoplasm; Biological process=protein transport
  Homolog annotation: Hit_ID=Q9FMC5; Match level="QueryCoverage=60%, HitCoverage=62%, E-value=3e-69, Identity=88%"; Hit description =Genomic DNA, chromosome 5, P1 clone:MUK11
  Pfam annotation: Domain name=Snf7; Domain location=1-141; Score=90.6; E_value=4.8e-24; Accession=PF03357.12; Description=Snf7
MPLVRYEGQRDMLYNQTFNLDQVQFAAEGIKDAQQTMTALKSANKELKGMMKTVKIQDIDNLQDEMMDLMDVSNEIQETLGRSYNVPDDIDEDDLMGELDALELDMGNETEADGVPSYLQPDKEPDLDAELNLPPAPTGQTAVPPGRSNAQLLTVLKMRGLVWRGDLVKSHCEKLGVKTGIRILKISIAGLLEIEAVDLKHLNWLLRMSWVYLLSLRHPYAVKECFLYLGVASAVTSMPL

SEQ ID NO: 180163 - protein, 1160 aa, Glycine max
  Coding DNA Sequence Number=SeqID_88478
  Homolog annotation: Hit_ID=A5BEN3; Match level="QueryCoverage=98%, HitCoverage=82%, E-value=1e-97, Identity=37%"; Hit description =Putative uncharacterized protein
MRQVLYADQGNAGESLSDRQPTLRSEIDHLTALMRSRTVNAPVREEEKGTEMVPSEPMLLSGQKEYPKTPALENGTKNGLVVTPHVASSFPVEDVASPAELAKSYMGSRPTKVSSSILGMQTLALREDPTLVNSENVALKSPIMSIVPRATRHAAVHENGFVTARSRGRSVIYNMARTPYARIYPTSTLKGGGRAVEGEPSSSSQFALDHDVHSGSKLGSVKHRSSVLDNDIGSVGPVRRIRQKSNLLYSIGSCSPISGSSSSVARGGMVKDAAQQPLSSMQKPAKENVDDIIPSSSFPSLPSKSSEVASKILHQLDKLVSPKEKSSELRLPIVNDNSPTKLSPSMLRGQALRSMEMVDSSKLLDSVHGNKIDGPFGNLSTSAQNQKSNSQRDKIENGPLKLVAPSAGLLPLVTAADATKPRNQVLSSAKSGDSFMIKSVSGPPQKKRAFHMSAHEDCLDLDDDAYPNGAVASFSPVQKEMTNSTAVMEKTTSGTEAIAEENPSALSVTMPPKSSTIDGEAHVGTADESRVGEKVDAYISTTSSILDPIFKPFTSATQTSFGFIKPASPNGSIVKPSFTFGNKVVSSTEFMAPGAPSMEITKSGPIFGLEKVVSLREPVADGPLVDFGSNKNVNKVPSMPFTAASSVGGESPFLKFGVSSDSNLGSSIGSTIVTGVTDSMPKVRESDNGNTETNKDTGSSVRASELAISSAPSTLLASSKSLSNFGHNSNQNNGSLFSSPSFSSFPPPVSNILSSSSSAAPSSGVSAAGNSTSMGAITPATIASSNSSSSTVVASSSSATSFFKFGSSPVRSVGLPVSSSGGSEPPEIKSRQDAGTGGLSSTAFGSSSAGSGIFGFSSSAMTTVNSSQSQSSAVGASSGSVLGAQASFTSGFATSTQTQSVSFGSSASSSSFGLSGNTPFSSSSSFPSSSPAASAAFLSGNSLFPSSSPATSFGLGTSASSLAVNSVSSNSGPSSTLFGSSWQPSKSPFGSTFSTSLSSGFLFGTSTASVTSASSPSMFLSTSSASIPQFSFTPAAAASTSTQPAFVSPNPAFTFGSATVNNGQMSMEDSMAEDTGQATPPATSVYSQQPAPVQSNFVFGASTPSGGSPFQFGSQQNIAPQNPSPFQASGSLGGSFSLGTGGGDKSARRIVKVKHKPRKK

SEQ ID NO: 180164 - protein, 606 aa, Glycine max
  Coding DNA Sequence Number=SeqID_88479
  Gene Ontology: Mol. function=RNA-directed DNA polymerase activity; Cellular component=exocyst; Biological process=lateral root morphogenesis
  Homolog annotation: Hit_ID=A7QHV3; Match level="QueryCoverage=96%, HitCoverage=87%, E-value=0.0, Identity=75%"; Hit description =Chromosome undetermined scaffold_100, whole genome shotgun sequence
  Pfam annotation: Domain name=Exo70; Domain location=3-597; Score =439.9; E_value=3.5e-129; Accession=PF03081.6; Description=Exo70 exocyst complex subunit
MVFSPVTKGRGTGRPRRTLGKAEAKILKGPHEDLENYLEAIDKLRSNIQFFGSKKGFKSSDGIVVHANNLLAKAISKLEDEFRQLLLSYSKPVEPERLFDCLPNSMRPSSPGHEGDPSGKNHHSESHNNNAEAVVYTPPALIPPRFLPLLHDLAQQMVEAGHQQQLLKIYRDARSNVLEESLQKLGVEKLNKDDVQKLQWEILEAKIGNWIHFMRIAVKLLFAGERKVCDQIFEGFDSLSEQCFAEVTTNSVSMLLSFGEAIAKSKRSPEKLFVLLDMYEIMQELHSEIETLFKGKACSAIREAATSLTKRLAQTAQETFGDFEEAVEKDATKTAVTDGTVHPLTSYVINYVKFLFEVEHFTFPVILGHALLVGKNLSSNYQSTLKQLFQEFEGGDDSSQLASVTVRIMQALQTNLDGKSKQYKDLALTHLFLMNNIHYIVRSVRRSEAKDLLGDDWVQRHRRIVQQHANQYKRNAWAKILQCLSIQGLTSSGGGSGTAGGDSGTGSSSGASRAIVKDRFKAFNIMFEELHQKQSQWTVPDSELRESLRLAVAEVLLPAYRSFVKRFGPLVESGKNPQKYIKYSAEDLDRMLGEFFEGKNMSETKR

SEQ ID NO: 180165 - protein, 855 aa, Glycine max
  Coding DNA Sequence Number=SeqID_88480
  Gene Ontology: Mol. function=protein binding; Biological process =protein metabolic process
  Homolog annotation: Hit_ID=A5C486; Match level="QueryCoverage=94%, HitCoverage=93%, E-value=0.0, Identity=51%"; Hit description =Putative uncharacterized protein
  Pfam annotation: Domain name=Clp_N; Domain location=112-169; Score =2.0; E_value=0.65; Accession=PF02861.11; Description=Clp amino terminal domain
  Pfam annotation: Domain name=Clp_N; Domain location=24-79; Score=7.4; E_value=0.17; Accession=PF02861.11; Description=Clp amino terminal domain
  Pfam module annotation: Pfam domain module=Clp_N::Clp_N; Domain location=112-169::24-79
MRGGICSIQLQALTPEAATVVKQAVNLATRRGHAQVTPLHVASAMLATSTGLLRKACLQCHSHPLQCKALELCFNVALNRLPASTSSPLLAPQYSTPSLSNALVAAFKRAQAHQRRGSIENQQQHILALKIEVEQLVISILDDPSVSRVMREAGFSSTLVKTRVEQAVSMEVCSQKAQAKENITKPHHQVVLGGRNNVSPSGPFGQVGGSFMKPNLDHVNNDDVTSVLSELAKRRNTVIVGESVTNAEGVVRGVIERFEVGNVPGDLRYVQFVSLPLMCFRNISKEEVEQKLMEVRNLVKSYVGGGVVLYLGDLKWLFEFWANFREQKTNYCSVEHMVMELKKLVCGSGESSRLWLMGISTFKTYMKCKICHPSLETIWELHPFTIPVGILSLSLNLDSDFQAQERNKVFFKDVAFEDRAGVRNHLTCCRDCTINFEKEAQSITSTISKKACTTSSLPTWLQNCKEERSDIMEDQENARLKDLCKKWNSLCNSIHRHPSINEKQVFFVSSSPSSPTSVSSHERKSNFHHSHLNWPIISESEKSPKECELYTETGDDGYDSNFIMFMPDSDVPKPDLLSNPNSSPNSASSSEAVDGLESTQMFKEPNAENHKILCDALEKKVPQHKEVIPEIASTVLHCRSGMRKRDQNHSMKREDNQETWMFFLGVNSQAKESISRELAKVVFGSYSNFVTIGMSSFSSPEDDDDSTDEKSKRKRPREELKSSYAQRFGEAVNENPHRVFFLEDLDQVDYFSQKGVEQAIQSGSITLPGGESVPLMDAIVIFSCESFFSSPKLRKSPCAENKGKETVEDESSSLSLDLNIAIEDESGGVAFGGDNATLSGVGGKKDMNGKVILEI

SEQ ID NO: 180166 - protein, 33 aa, Glycine max
  Coding DNA Sequence Number=SeqID_88481
MAHLILIANGATAIYEFQSNQAAVCKDNVVSHH

SEQ ID NO: 180167 - protein, 275 aa, Glycine max
  Coding DNA Sequence Number=SeqID_88482
  Homolog annotation: Hit_ID=A7PHZ5; Match level="QueryCoverage=26%, HitCoverage=29%, E-value=2e-18, Identity=63%"; Hit description =Chromosome chr13 scaffold_17, whole genome shotgun sequence
  Pfam annotation: Domain name=DUF1635; Domain location=17-253; Score =178.4; E_value=1.9e-50; Accession=PF07795.2; Description=Protein of unknown function (DUF1635)
MEYVCSPLGWEFYHQEEGLEDLRHSLLYTTLELEATIASAKEEITRRECELIRVNDLLSRVMKERDEAQAKCQKLMLEKLELQQELQHKQQLEQNQHQHQHQLVQKHQRDTISQSEEELQEGLSEKHSASSDCEENSSMPSSGGSSTPHHTTPLQVVLELAEKKPLPEKGKLLKAVVEAGPLLQTLLLAGPLPQWQHPPPQLNSIEIPPVAISPQNSSSTKSASFPFNKKRDLLVLSPGTGCPVSKNRKVIQHMPTPTTTTASASHHSLPHPSFS

SEQ ID NO: 180168 - protein, 674 aa, Glycine max
  Coding DNA Sequence Number=SeqID_88483
  Gene Ontology: Mol. function=catalytic activity; Cellular component =plasma membrane; Biological process=chromatin assembly or disassembly
  Homolog annotation: Hit_ID=A5BQ50; Match level="QueryCoverage=99%, HitCoverage=96%, E-value=0.0, Identity=53%"; Hit description =Putative uncharacterized protein
  Pfam annotation: Domain name=DUF594; Domain location=597-656; Score =90.7; E_value=4.5e-24; Accession=PF04578.4; Description=Protein of unknown function, DUF594
MLLAVVWNVLEIRVLVLFSLILQIILIVCGNQRKYKAGWVLQFGVWFTYLSADWAATFVLGILSKDSKNPSTDPTNSIIMAIWAPFLLVHLGGPDTITAYSLEDNELWLRHFLGLISQLFGAVYVVYSSWNDRNLNYVTIPVMVAGIIKYTERTLSLWLGSSKKFRESIHRPPDPGPNYAKFMDDCTAKIAEGYKVELKVESTPILSDHSLAAIANESVPDALRLHYGFYFLEIFECLFADLILGFQELQESQHFFQNKSWEHAYKVIEVELGLMYDKLYTKAVVTYSRLGLFLKIVTFFCTLSAFIAFLCLIDKAHIDCDQIITVVLFAGAIFLEIYAGIVLLSSSWTMHWLSKHKNWIVNLLISCFQTCYKLSHAKRWSNLISQFNLISFCLKGEPAKRIKIWNYQFMYQIFRILYHQDQETVPEKLKELIFEHIREKSKGAKHIKACKNFCAHRGDQVLNKWKCRSIAWSTEVEFDQSLLIWHIATDLCCYSDKDCDKLKNYEISRLMSDYMLYLLVKCPFMLPNGIGQIRFEDTCAEASELLQERKYISQTDQVCEVIGGVSVDEKFLPSKVKGDRSKSVLFDACRLAKSIKSLEEEKKWSKEQKWEMISRVWVEMLCHAASQCRGFHHAKQLSRGGELLTHVWFLMAHLGITEQFQISQGHARAKLIHS

SEQ ID NO: 180169 - protein, 665 aa, Glycine max
  Coding DNA Sequence Number=SeqID_88484
  Gene Ontology: Mol. function=oxidoreductase activity; Cellular component=anchored to membrane; Biological process=electron transport
  Homolog annotation: Hit_ID=A5AIX9; Match level="QueryCoverage=81%, HitCoverage=76%, E-value=0.0, Identity=62%"; Hit description =Putative uncharacterized protein
  Pfam annotation: Domain name=Cu-oxidase; Domain location=157-305; Score=176.9; E_value=5.2e-50; Accession=PF00394.13; Description =Multicopper oxidase
  Pfam annotation: Domain name=Cu-oxidase_2; Domain location=383-527; Score=125.2; E_value=1.9e-34; Accession=PF07731.5; Description =Multicopper oxidase
  Pfam annotation: Domain name=Cu-oxidase_3; Domain location=55-147; Score=42.4; E_value=7.3e-11; Accession=PF07732.6; Description =Multicopper oxidase
  Pfam module annotation: Pfam domain module=Cu-oxidase::Cu-oxidase _2::Cu-oxidase_3; Domain location=157-305::383-527::55-147
MAAGSAGDRLKLVTCAIVLLPFLVTIASSADIFLDWHVSTDINLKPVSTDQPVGIIAFDLFIFLSVFSHALFPNFIADMIGRNGIQQRLDSWEDGVSGTNCPIQPGRNWTYEFQTKDQIGTFFYFPSINFLKAGGGFGPIRVNNRPVISVPFPKPEAEFDFLIGDWHSSSYKDIRSRLDASDVLPPDWMLINGKGPYMNNLSLSYETFNVTQGKTYLLRISNVGTAWSFNFRIQNHQMVLAETEGSYVNQIELESLDVHVGQSYSVLVTANQSAADYYIVASPKMSNATNNNTLVGVAVLHYDNSTTPATGSLPSGPDPFDLQFSINQAKSIRWNLTTGAARPNPQGTFNVKNVAISETFIFQASTAVVDGLYRYTVNNVSYLTPNTPLKLADYFSNGTGVYELDAYSKNSSNVNAVRGVFVASALHKGWTEIVLKNNLDIIDTWHLDGYSFFVVGIGEGEWNPESRSSYNLNDPVARSTVQVYPGGWSAVYVYPDNPGMWNLRSQNLQSWYLGEELYVRVYDADPNPAKEKPPPQNLLLCGFFQPSPPPLNEHNPNAPSVSPAPNSPSSKACKQNAPSVSPEPNAPSPKAYNPNSPSVSPAPNAPSPEAYNPNSPSVSPAPNAPSSKAYNPHRTRLICVLCNNNNRSLIAVITTALCFLYIGLH

SEQ ID NO: 180170 - protein, 499 aa, Glycine max
  Coding DNA Sequence Number=SeqID_88485
  Gene Ontology: Mol. function=catalytic activity; Cellular component =cellular_component; Biological process=metabolic process
  Homolog annotation: Hit_ID=Q2WGL7; Match level="QueryCoverage=100%, HitCoverage=70%, E-value=0.0, Identity=75%"; Hit description=Lupeol synthase
  Pfam annotation: Domain name=Prenyltrans; Domain location=443-498; Score=29.4; E_value=1.3e-05; Accession=PF00432.12; Description =Prenyltransferase and squalene oxidase re
NEDGGWGFHIEGHSSMFGSALSYIALRILGEGSQDGEERAMDRARKWILDHGGLVAIPSWGKFWVTVLGVYEWSGCNPLPPEFWLLPKCSPIHPGKMLCYCRLVYMPMSYLYGKKFVGPITSLIRSLREEVYNEPYDQINWNKARNIVAKEDLYYPHPMIQDMLWGFLHHVGERVMNCWPFSMLRQKALEIAINHVRYEDENSRYLCIGSVEKVLCLIARWVEDPNSEAYKLHLARIPDYFWLAEDGLKIQMWDAAFAIQAILACNVSEEYGPTLRKAHSFVKASQVRENPSGDFKAMYRHISKGSWTFSMHDHGWQVSDCTAEGLKAALLLSEMATDLVGEEMEAERLYDAVNVILSLQSSNGGFPAWEPQRAYRWLETPSLRWSKITVAQLTDMLHLITTLTNFGTDYVHCYMMSNRYVECTGSAMQVGLTACGKNYHNSPSLRKACKFLLSKQLPNGGWGESYLSSQNKVYTNLEGNRANLVQTSWALLSLIDAGQ

SEQ ID NO: 180171 - protein, 286 aa, Glycine max
  Coding DNA Sequence Number=SeqID_88486
  Gene Ontology: Mol. function=transcription factor binding; Cellular component=intracellular; Biological process=regulation of transcription, DNA-dependent
  Homolog annotation: Hit_ID=A9P9Z6; Match level="QueryCoverage=73%, HitCoverage=99%, E-value=7e-76, Identity=68%"; Hit description =Putative uncharacterized protein
  Pfam annotation: Domain name=Arf; Domain location=75-253; Score= -38.7; E_value=1.4e-06; Accession=PF00025.12; Description=ADP -ribosylation factor family
  Pfam annotation: Domain name=GTP_EFTU; Domain location=92-255; Score=- 82.0; E_value=0.046; Accession=PF00009.18; Description=Elongation factor Tu GTP binding domain
  Pfam annotation: Domain name=MMR_HSR1; Domain location=90-208; Score =5.1; E_value=0.00037; Accession=PF01926.14; Description=GTPase of unknown function
  Pfam annotation: Domain name=Miro; Domain location=91-208; Score =60.6; E_value=5.4e-15; Accession=PF08477.4; Description=Miro-like protein
  Pfam annotation: Domain name=Ras; Domain location=91-255; Score =257.1; E_value=3.9e-74; Accession=PF00071.13; Description=Ras family
  Pfam module annotation: Pfam domain module=Arf::GTP_EFTU::MMR _HSR1::Miro::Ras; Domain location=75-253::92-255::90-208::91-208::91 -255
MEGVVKKKEVVKMMLVKLIKWEIFFRPNSQPLGLLASFTFLSQFFTLFLKVRDNHGGIILISGSFWKLQKEKENMGSDSRVGSSNYDYSFKVLLVGDSGVGKSSLLLSFISNSNSINHLSPTIGVDFKIKLFTVGGKRLKLTIWDTAGQERFGTVIGSYYRGAHGIILVYDVTRRETFTNLIDIWAKEVELYSTNHDSIKILVGNKVDKESERAVSKEEGMALAQQHRCLFLECSAKTRENVQQCFNDLTLKILDVPSLRERGSVAVKRQKQKHIYETSKSGGCCS

SEQ ID NO: 180172 - protein, 155 aa, Glycine max
  Coding DNA Sequence Number=SeqID_88487
MVINPYFMHHMVKEQVAIMNKRQDGSLWLTCTSSSTCDWQHIRTSMTTSIRSTKEAVNGVAMVVVKGADSATLVVCTSKGAKKILDGCGKKEVLLEEASEFLRIIQQSEFKVIEQLNKTPTRALEDSSIISLPTTISSSSKKKSLSRGEGIAGLC

SEQ ID NO: 180173 - protein, 60 aa, Glycine max
  Coding DNA Sequence Number=SeqID_88488
  Homolog annotation: Hit_ID=A7Q2F1; Match level="QueryCoverage=95%, HitCoverage=11%, E-value=2e-17, Identity=75%"; Hit description =Chromosome chr1 scaffold_46, whole genome shotgun sequence
MIGAKSMMKFESGYSVEIMFDGSKLGIEPYAVEVLPNGELFILDSTNSNVYRISSSLSLS

SEQ ID NO: 180174 - protein, 719 aa, Glycine max
  Coding DNA Sequence Number=SeqID_88489
  Gene Ontology: Mol. function=catalytic activity; Cellular component =peroxisome; Biological process=metabolic process
  Homolog annotation: Hit_ID=A5BPU4; Match level="QueryCoverage=98%, HitCoverage=100%, E-value=0.0, Identity=64%"; Hit description =Putative uncharacterized protein
  Pfam annotation: Domain name=AMP-binding; Domain location=83-492; Score=392.9; E_value=4.9e-115; Accession=PF00501.19; Description=AMP- binding enzyme
MSGEQILSSNEEYNKSQPPFGSKSGYDSRTGIYHSLIKLVTKHEIPTRPDLNTANFVLSQFPQTHLAEARIAFIDSGTSRSVSYGELKRSIYSLASALFHGLEIRKGDVVFVLSPNSTLYSAICLAVLSVGAVLTTANPINTATEIAKQVHDSGAKLAISAPEELHKLVPTGVPIILTSRPSDGNMLSVEELIEGCCTSPELPQVPVAQSDTAAILYSSGTTGVSKGVVLTHANLISIMRLLFWSADVSGSQDDVFLAFIPMFHIYGLVFFGLGLLCVGVTTILMQKYDFQGMLDAIQKHKVNNIAAVPPVILALVKQAKKTRCDLSSLRRVGSGAAPLSKEVAQEFRRMFPWVELRQGYGLTESSGGATFFPSDKDAKAHPDSCGKLIPTFCAKVVDIETGKPLPPHKEGELWFKSPTIMKGYLGNLEATSATIDSEGWLKTGDLGYIDEKGFVYIVERIKELIKHNGYQVAPAELESVLLSHPLIVDAAVIPVEDEETGQIPMAYVVRAAGSELSENQVIQFVAGQVAPYKKVRKVSFIVTIPKSAAGKILRKDLVSQSKYQLVSKVGSGAAPLSKEVAQEFRRMFPWVELRQGYGLTESSGGAAFFASDKDGKAHPDSCGKLIPTFCAKVIRIEMGKPFPPHKKGKLWFKSPTIMKGYLGNLEATSATIDSEGWLRTGDLGYIDENEFVYIVERIKELIKHNGYQVLKTINVSVFN

SEQ ID NO: 180175 - protein, 333 aa, Glycine max
  Coding DNA Sequence Number=SeqID_88490
  Gene Ontology: Mol. function=oxidoreductase activity; Cellular component=extracellular region; Biological process=hydrogen peroxide catabolic process
  Homolog annotation: Hit_ID=A5BQ28; Match level="QueryCoverage=90%, HitCoverage=91%, E-value=1e-113, Identity=64%"; Hit description =Putative uncharacterized protein
  Pfam annotation: Domain name=peroxidase; Domain location=36-286; Score=379.6; E_value=5e-111; Accession=PF00141.14; Description =Peroxidase
MAFPILFLLFISLPFSSAKLNVDYYKNTCPDFEKIVRENVFTKQSASVATAPGLLRLFFHDCITDGCDASLLITSNAYNPHAERDADLNLSLSGDAFDIIVKIKNALELACPGVVSCSDIVAQATRDLVKMVGGPFYPVRLGRKDSTESDAARVSASLPTPSMTMDQIIEKFTSKGFTVKEMVALTGAHTIGFTHCKEFIHRIYNFSKTSDADPMMHPKLVQGLRSVCQNYTKDSSMAAFNDVRSPGKFDNAYYQNVIKGLGLLTSDSILAVDPRTKPLVELYANDQQAFFKDFADAMEKLSVFRVKTGDKGEVRNRGEKHKTCDGEDPVLPI

SEQ ID NO: 180176 - protein, 902 aa, Glycine max
  Coding DNA Sequence Number=SeqID_88491
  Gene Ontology: Cellular component=Golgi apparatus; Biological process= biosynthetic process
  Homolog annotation: Hit_ID=A5B8M2; Match level="QueryCoverage=100%, HitCoverage=85%, E-value=0.0, Identity=59%"; Hit description =Putative uncharacterized protein
  Pfam annotation: Domain name=Glycos_transf_1; Domain location=167 -354; Score=-12.3; E_value=0.0045; Accession=PF00534.11; Description =Glycosyl transferases group 1
MTIDPQSLMLVTVIWNLQKLGYVFKIFAVGHGKARSIWENIGGRICPLSTEHQGLIDWSIFEGIIVDSLEAKVAISSVMQEPFCSVPLIWIIQEDSLSSRLPVYEQMGWEHIVSHWRSAFSRASVVVFPDFTYPMLYSELDTGNFFVIPGSPVDVWAAESYHKTHAKEQLRELSGFGKNDMLVLVVGSSVFFDDLSWDYAVAMHSVGPLLTRYARRNDATDSFKFVFLCGNSTDGYDDALQGVASRMGLRQGSIRHYGLNGDVNSVLLMADIILYGSAQEVQGFPPLLIRAMTFEIPVVVPDFSVLKKYIVDGVHGIFFSKHNPEALMNAFSLLLSNGRLSKFAQAIASSGRQLAKNVLALDCITGYARLLENVLNFPSDALLPGAVSQIQQGSWEWNLFQNEIDLSKIDSNRKVSIVYAVEHELASLNYSTSIVENGTEVPLQDELTQLDLDTLREIEISEENEMFEVEEAEERMEKGVSVWDDIYRNARKSEKLKFEVNERDEGELERTGQSVCIYEIYNGAGVWPFLHHGSLYRGLSLSRRAQRQTSDDVDAVGRLPLLNDTYYRDILCEMGGMFAIANRVDSIHRRPWIGFQSWRAAGRKVALSAKAENVLEETMQENFRGDVIYFWGRLDMDQSAIRNHNAISFWYMCDILNGGNCSPFEKYETSSKRNMFGGSELEFLEVGLWSLDIVIIVFQDGFRQMYALPPHAEALPPMPEDGGYWSALHSWVMPTSSFLEFIMFSRMFVDSIDAKHRDSTKYSLCLLGSSEIEKKHCYCRMLELLINVWAYHSARKMVYINPNTGSMEEQHPIEQRKGFMWSKYFNFSLLKSMDEDLAEAADDGDHPREMWLWPMTGEVHWQGIYEREREERYRLKMDKKRKTKEKLFERMKYGYKQKSLGR

SEQ ID NO: 180177 - protein, 286 aa, Glycine max
  Coding DNA Sequence Number=SeqID_88492
  Gene Ontology: Mol. function=glucuronosyl-N-acetylglucosaminyl -proteoglycan 4-alpha-N-acetylglucosaminyltransferase activity; Cellular component=membrane; Biological process=heparan sulfate proteoglycan biosynthetic ...
  Gene Ontology: Biological process=process, polysaccharide chain biosynthetic process
  Homolog annotation: Hit_ID=A7QZS2; Match level="QueryCoverage=100%, HitCoverage=37%, E-value=1e-116, Identity=70%"; Hit description =Chromosome chr13 scaffold_286, whole genome shotgun sequence
  Pfam annotation: Domain name=EXTL2; Domain location=138-285; Score =144.0; E_value=4.2e-40; Accession=PF09258.1; Description=EXTL2, alpha-1,4-N-acetylhexosaminylt
MDGDRVPSGDSVRRFTVGCASVVVAVILIVLLGVLLGFVNCIVPLNWFIHNSGKRNFTALSWERSNMFSSRVRRFCSRLNRAPTFLRGKIKHNACARRFILAIIFAVGVGLMCIGVKNIYGGNGSEEPYPLKGQYSQFTLLTMTYDARLWNLKMYVKHYSRCSSVREIVVVWNKGVPPKLSDLDSAVPVRIREEKNNSLNNRFRADPLIKTRAVLELDDDIMMPCDDIERGFNVWRQHPDRIVGFYPRLIDGSLLKYRGEKYARMHKGYNMILTGAAFIDSQVAFK

SEQ ID NO: 180178 - protein, 61 aa, Glycine max
  Coding DNA Sequence Number=SeqID_88493
MIYEYPYALAMPREGLFWSITTQQPGIGTLNVIFTVQTGTCGVCSEQLSNPHVKRIGGHKT

SEQ ID NO: 180179 - protein, 251 aa, Glycine max
  Coding DNA Sequence Number=SeqID_88494
  Gene Ontology: Mol. function=receptor activity; Cellular component =mitochondrion
  Homolog annotation: Hit_ID=A7NX45; Match level="QueryCoverage=100%, HitCoverage=46%, E-value=1e-90, Identity=68%"; Hit description =Chromosome chr5 scaffold_2, whole genome shotgun sequence
MVAEAWIVKMGNQVSANLKHALLLEPSARRKHNPKRQDNSTSSKEVIGILSFEVANVMSKTVHLHRSLSEPEIVKLRNEISNSQGVQNLVSSEEGYLLELARAEKLEELNRVANVVSRLGKKCSLPALQGFEHVYGDIVSGVIDVKELGFLVKHMEGMVRKMDRYVSATRSLHSEMGVLNDLEQAVKKFQHEESRRAFEQKLTWQKQDVKHLKEISLWNQNFDKVVELLARTVCTLYARICIIIGDSTWRK

SEQ ID NO: 180180 - protein, 183 aa, Glycine max
  Coding DNA Sequence Number=SeqID_88495
  Gene Ontology: Mol. function=structural molecule activity
  Homolog annotation: Hit_ID=A7NX50; Match level="QueryCoverage=90%, HitCoverage=37%, E-value=1e-59, Identity=79%"; Hit description =Chromosome chr5 scaffold_2, whole genome shotgun sequence
MDTGIIGKPHSQGEGLAAVFGNGLSTACVVNIGAQVTSLICIEEGELDAVAVVHSYAEKVPAVSHKTRLSALNVPPMGLFYPTLLTPDVYPPPPRTWFHDYEDMLEDTWHIDFSRRSDMPDTFYPNVNGGLPMWESYPVFSTKPKKEEKVGLAEAITNCILSTGRIDIQRKLFCSIQLVSFTC

SEQ ID NO: 180181 - protein, 147 aa, Glycine max
  Coding DNA Sequence Number=SeqID_88496
  Gene Ontology: Mol. function=dihydrolipoyllysine-residue acetyltransferase activity; Cellular component=pyruvate dehydrogenase complex; Biological process=pyruvate metabolic process
  Homolog annotation: Hit_ID=A7QZS8; Match level="QueryCoverage=100%, HitCoverage=19%, E-value=3e-32, Identity=55%"; Hit description =Chromosome chr13 scaffold_286, whole genome shotgun sequence
  Pfam annotation: Domain name=2-oxoacid_dh; Domain location=5-147; Score=-149.3; E_value=0.0094; Accession=PF00198.14; Description=2 -oxoacid dehydrogenases acyltransferase (catalytic domain)
VKELAAKARAGKLKPHEFQGGTFSIRVDVDVAKWIVNLPCAEHTLDENMLFWKIFQSAWFTSLRLVTQVVDPCEQDCKMSKACILAVGRGNKVVEPVIGTDGIEKPSIATKLSLTLSADHRVFDGKVGGAFLSALQSNFSDIRRLLL

SEQ ID NO: 180182 - protein, 148 aa, Glycine max
  Coding DNA Sequence Number=SeqID_88497
MELGLGLGLGLGEGADAAVHGGDVAGDAVAGDLHEDDGVGGVDQVTVPVADELPEFLLLVLDLLPRRRLRLPDLGDGLRAEEGLGVAAAEGEDAVLVGRLGIDLSGGGRWRKESGKFGERSLGRGEREKFKESFEKDNFLCERRRFYG

SEQ ID NO: 180183 - protein, 103 aa, Glycine max
  Coding DNA Sequence Number=SeqID_88498
MACHMEAAPPAERKSLQAVEWRRRGGGEAEGERGAWDRRGREAWTREKSQGLERVAQSTPSMGDGGLSCARFVGCYPTHVVQSSMLPILRLLFFSAVICSLTS

SEQ ID NO: 180184 - protein, 537 aa, Glycine max
  Coding DNA Sequence Number=SeqID_88499
  Gene Ontology: Mol. function=DNA binding; Cellular component=nucleus; Biological process=regulation of transcription
  Homolog annotation: Hit_ID=A7QBJ5; Match level="QueryCoverage=75%, HitCoverage=85%, E-value=1e-94, Identity=45%"; Hit description =Chromosome chr13 scaffold_74, whole genome shotgun sequence
MGDPYGLPEDLRRLIPARSTHLNPSDTHLIEPLCVHHGLSSAVAAATASATPPITYDANMVGDVFFPRGFTHHFAHHHDYSSSSGVNPVATTATATATTTVSDHAFCSMESAEKGWFGFDSGNNRWPRQETLSLLEIRSRLDSKFRENNQKAPLWNEISRIMAEEFGYQRSGKKCKEKFENLYKYYKKTKEGKASRQDGKHYRFFRQLEAICGDQANNTHAHASTSDKTHRAGGNTAATIQKQTFTTNQDHNNGDSNNNPKCSESLSISNSSQFETSSSENNDEDLSAIAFMMKQSRDEKQKGLDHTHRPSDHRRVRKSWRTKVEEIVDSHMRKIIQTQDAWMERMLSVVEQREQEMASREEERKRKESMWFDQQVHELWAKEKAWVEARDAALIEVVRKHIGIGIGLEALPLVEEESPNKNKSQGSIDANEFPSEGVDPGRSSSSRWTEMEISNLMQLRTSFEQRFRENNNGYMENGVWDEIAAKMACLGFDRSASECKQIWEEISISLRRTVDECDDGAKRRPWYLGLKLTDDDL

SEQ ID NO: 180185 - protein, 1086 aa, Glycine max
  Coding DNA Sequence Number=SeqID_88500
  Gene Ontology: Mol. function=nucleoside-triphosphatase activity; Cellular component=integral to membrane; Biological process=transport
  Homolog annotation: Hit_ID=A7QBF4; Match level="QueryCoverage=99%, HitCoverage=99%, E-value=0.0, Identity=50%"; Hit description =Chromosome chr13 scaffold_74, whole genome shotgun sequence
  Pfam annotation: Domain name=ABC2_membrane; Domain location=471-676; Score=183.3; E_value=6.4e-52; Accession=PF01061.15; Description=ABC -2 type transporter
  Pfam annotation: Domain name=ABC_tran; Domain location=158-369; Score= 5.7; E_value=2.5e-07; Accession=PF00005.18; Description=ABC transporter
  Pfam annotation: Domain name=ABC_tran; Domain location=826-1016; Score=106.9; E_value=6.2e-29; Accession=PF00005.18; Description=ABC transporter
  Pfam annotation: Domain name=PDR_assoc; Domain location=681-748; Score=130.8; E_value=4e-36; Accession=PF08370.2; Description=Plant PDR ABC transporter associated
  Pfam module annotation: Pfam domain module=ABC2_membrane::ABC _tran::ABC_tran::PDR_assoc; Domain location=471-676::158-369::826 -1016::681-748
MEEGVDADEVVRSVSSLRMSIGSMSRRSWVSASVSEMWGAGHGGDVFERSTRVDDGDNDEEELMWAAIERLPTFERLRKSIVKRALEESGRFNYEEVDISNLGFQDKKKLLHAILRKVEVDNETFLRRIRERIDRVAIEIPKVEVRFEHLFVEGDAFNGTRALPTLVNSTMNAIEVSGRVTYCGHELSEFVPQRTCAYISQHNLHHGEMTVRETLDFSGRCLGVGTRHELLLELIKREKQSGLKPDPEIDAFMKATAVEGQETSLITDYVLKVLGLEICADTLVGDEMRRGISGGEKKRLTTGEMLVGPAKVFLMDEISTGLDSSTTFQIVKFLRQLVHVMDVTMIISLLQPAPETYDLFDDIILLSEGHIIYQGPRENVLNFFESVGFKCPERKGVADFLQEVTSRKEQEQYWFARDKPYRYVSVPEFVAHFNNFGIGQQLSQDLQVPYDRAETHPAALVKDKYGISKLELFKACFAREWLLMKRSAFVYIFKTTQIMIMSLITMTVFFRTEMRSGHLEDGRKYYGALFFSLTNIMFNGMAELSLTIFRLPVFFKQRDSLFFPAWAFAIPIWIFRIPLSFVESGLWVVLTYYTVGYAPAPTFFCSHQMGMSLFRFIAALGRTLVVANTFGFFVLLLVYVLGGFIIAKDNLEPWMKWGYYISPMMYGQNAIAINEFLDERWSAPNTDHRIPEPTVGKALLRIRSMFTEDYWYWISIGALLGFSLLFNICFIIALTFLNPYGDSKSIILEEENEKKGTTEDSSASTDKSFESTATTKRGMVLPFKPLSLAFDHVNYYVNMPTEMEKHGVEGSRLQLLRDASGAFRPGVLTALVGVTGAGKTTLMDVLAGRKTGGYIEGSISISGYPKKQATFARISGYCEQNDIHSPRITVYESILFSAWLRLGKEVKREIKKMFVEEVMNLVELHPVRDFQVGLPGIDGLSTEQRKRLTIAVELVANPSIIFMDEPTSGLDARAAAIVMRAVRNTADTGRTIVCTIHQPSIDIFESFDELLLMKRGGQIIYNGPLGQQSQNLIAHFEAFPEVPRIKDGYNPATWVLEISTPAVESQLRVDFAEFYTKSELYQLSVD

SEQ ID NO: 180186 - protein, 352 aa, Glycine max
  Coding DNA Sequence Number=SeqID_88501
  Gene Ontology: Mol. function=metallopeptidase activity; Cellular component=vacuole; Biological process=proteolysis
  Homolog annotation: Hit_ID=A7QLJ4; Match level="QueryCoverage=81%, HitCoverage=57%, E-value=1e-130, Identity=79%"; Hit description =Chromosome undetermined scaffold_119, whole genome shotgun sequence
  Pfam annotation: Domain name=Peptidase_M18; Domain location=61-352; Score=142.8; E_value=9.5e-40; Accession=PF02127.6; Description =Aminopeptidase I zinc metalloprotease (M18)
  Subcellular localization annotation: CTP_CleavageSite=45; ConfidenceScore=5.67e-01
MASITGPQILLHSGSPWLKQTMKPSSSPFLLFPKHTPRRTFCSINSNSKGSSSIVPDLLHYLNHSWTQFHATAEAKRQLLAAGFHMLDENHDWHLKPGGRYFFTRNMSCLVAFAIGDKYNVGDGFHVIAAHTDSPCLKLKPKTASCKCNYSMVNVQTYGAGLWYTWFDRDLSVAGRVILRSSHNSYVHKLVKINRPILRIPTLAIHLDRTVNQDGFKPNLETHLHPLLSMKPEDTSLESNSKEKNSALSSKAHHHRLLMQVLSDELNCDIDDIVNIELNVCDTQPSCLGGGNNEFIFSGRLDNLASSYCALRALIDSCQSPGDLASESAIRMVALFDNEEMSDFVPFLLANK

SEQ ID NO: 180187 - protein, 305 aa, Glycine max
  Coding DNA Sequence Number=SeqID_88502
  Gene Ontology: Mol. function=nucleic acid binding; Cellular component= intracellular; Biological process=regulation of transcription
  Homolog annotation: Hit_ID=A7P341; Match level="QueryCoverage=76%, HitCoverage=85%, E-value=7e-95, Identity=69%"; Hit description =Chromosome chr1 scaffold_5, whole genome shotgun sequence
  Pfam annotation: Domain name=zf-C2H2; Domain location=143-165; Score =21.3; E_value=0.0036; Accession=PF00096.17; Description=Zinc finger, C2H2 type
  Pfam annotation: Domain name=zf-C2H2; Domain location=228-250; Score =20.4; E_value=0.0068; Accession=PF00096.17; Description=Zinc finger, C2H2 type
  Pfam annotation: Domain name=zf-C2H2; Domain location=254-279; Score =3.8; E_value=4.4; Accession=PF00096.17; Description=Zinc finger, C2H2 type
  Pfam module annotation: Pfam domain module=zf-C2H2::zf-C2H2::zf-C2H2; Domain location=143-165::228-250::254-279
  Subcellular localization annotation: CTP_CleavageSite=52; ConfidenceScore=5.37e-01
MFIYGLSRPSTLKFSNQNSTLSLTALSHQITMQKTYSFSCISSCGSDSACLEADEVNNEDSISLSLGPPSQHKFKSRASNPKHSSTMRDHQQKPSSDDLSGVTVALHIGLPTPTDATKPSSPPIHGRYWIPTPQQILIGPTQFSCTVCNKTFNRFNNMQMHMWGHGSQYRKGSNSLRGSKAGSLMLRLPCYCCEEGCKNNINYPRSKPLKDFRTLKTHYKRKHGEKPFECRKCHKPFAVRGDWRTHEKNCGKLWFCVCGSDFKHKRSLKDHVRAFGNGHASHNLSEERGDEGGDDDSEVAVFTFK

SEQ ID NO: 180188 - protein, 252 aa, Glycine max
  Coding DNA Sequence Number=SeqID_88503
  Gene Ontology: Mol. function=leucoanthocyanidin reductase activity; Cellular component=cytoplasm; Biological process=regulation of nitrogen utilization
  Homolog annotation: Hit_ID=Q3KN80; Match level="QueryCoverage=93%, HitCoverage=66%, E-value=1e-112, Identity=82%"; Hit description =Leucoanthocyanidin reductase
  Pfam annotation: Domain name=NmrA; Domain location=1-196; Score=51.8; E_value=2.4e-12; Accession=PF05368.4; Description=NmrA-like family
MLQRFLPSEFGHDVDKADPVEPGLTMYKEKRLVRRVVEESGVPFTNICCNSIASWPYHDNCHPSQLPPPLDQLQIYGHGNVKAYFVDGIDIGKFTMKVIDDVRTVNKNVHFRPSNNCYSVNELASLWEKKIGRTIPRVTISEDDLLAVAAENCIPRSIVASFTHDIFIKGCQVNFNIDGLGDVEISTLYPEEAFRSLEDCFDAFAIMIDDKIHKGENKIAGTESVVEAVPFKASCGEEPPPKKCSKFVVTNY

SEQ ID NO: 180189 - protein, 122 aa, Glycine max
  Coding DNA Sequence Number=SeqID_88504
MANKHDEGSETVKRTLSPYDLSLNDNPGSVITQVQTQGVYQGRGRDISVRANAAQTSNGGTILPAINTDKGELTDLKLLHELKVVKGCPVGLPNGEQAVATKEGTVTLEEGLKLINICQKKS

SEQ ID NO: 180190 - protein, 355 aa, Glycine max
  Coding DNA Sequence Number=SeqID_88505
  Homolog annotation: Hit_ID=A5B731; Match level="QueryCoverage=96%, HitCoverage=37%, E-value=1e-93, Identity=57%"; Hit description =Putative uncharacterized protein
MEVRGNEHGLIVAASIAALTVKQLNVNDTRSERGEARIRNDQDEATEEAQVTCSIDGHTEKREEEEQEEVKLINSIINQTDDFEDDILPEFEKLLSGEIDFLSLDEKTDKEKKGGVYETEMANNTSELERLQNLVKELEDREVKLEGELLEYYGLKEQEADFVELQRQLKIKTVEIDMLKMTINSLQEEREKLQEELAHGASAKRELEAAKGKIKELQRQIQLEANQAKTQLLLLKQKVSGLVSKEEEAAKKDVEIGKKLKALNDLEVEVVELKRENKELQHEKQELTVKLNAAESRITELSNVTENEMVAKTKEEVSSLRHVNEDLLKQVEGLQMNRFSEVEELVYLRWVNACL

SEQ ID NO: 180191 - protein, 107 aa, Glycine max
  Coding DNA Sequence Number=SeqID_88506
MTLRSLLCISYVIEKSLKRHKQFDFPLNLLHKIKARIAFVDFGSPYISAIMLLPKMRIHVSWELNLHHVIFEMDSLAVVHIVPRGSFISALLKPLFKGILNQLLMRV

SEQ ID NO: 180192 - protein, 390 aa, Glycine max
  Coding DNA Sequence Number=SeqID_88507
  Gene Ontology: Mol. function=protein serine/threonine phosphatase activity; Cellular component=protein serine/threonine phosphatase complex; Biological process=protein amino acid dephosphorylation
  Homolog annotation: Hit_ID=A7QTV5; Match level="QueryCoverage=98%, HitCoverage=100%, E-value=1e-120, Identity=58%"; Hit description =Chromosome undetermined scaffold_171, whole genome shotgun sequence
  Pfam annotation: Domain name=PP2C; Domain location=88-362; Score =143.5; E_value=5.9e-40; Accession=PF00481.12; Description=Protein phosphatase 2C
  Subcellular localization annotation: CTP_CleavageSite=49; ConfidenceScore=5.08e-01
MVCRSCVRSLVVQAGTFANRVRINGFGRSLQAVQSFSHWPIREYKTTTRMMVDTGSMSRAGPLVDTMPEKDDDGRFASGGWKSDDGRLSCGYSSFRGKRVTMEDFYDIKTLKIGGQSICLFGIFDGHGGSRAAEYLKEHLFDNLLKHPKFLTDAKLAISETYQQTDANFLDSEKDTFRDDGSTASTAVLVDNHLYVANVGDSRTIISKAANALSEDHKPNRSDERKRIENAGGVVMWAGTWRVGGVLAMSRAFGNRMLKQFVVAEPEIQVILDYCLQPERLSIRVATSTVLPLSGTYYAPRKVAQYGPSSWKKGTCETLCNIQFSRVPDVDAVSLARTEEEPEAAARKLTEAAFSRGSADNITCIVVQFHHEKAELANPDKAEAASAQHE

SEQ ID NO: 180193 - protein, 78 aa, Glycine max
  Coding DNA Sequence Number=SeqID_88508
MGAKHLTRTKERSHVIKQRSPDEIRRVHPLWISSSGRYIHLVVQREQGRVHPLWIFACKGFYKVERNLKNRWLLGDWM

SEQ ID NO: 180194 - protein, 72 aa, Glycine max
  Coding DNA Sequence Number=SeqID_88509
MTLQGEDESRTNSPPKEAMHKSLKVGEDEWKEREKGGHEIYASNELWFSPLIQDQVQDSQLSVLRCHEACKT

SEQ ID NO: 180195 - protein, 76 aa, Glycine max
  Coding DNA Sequence Number=SeqID_88510
MYKDNWTQHWPMGSEIYPEVHENPRAFFSSSSSIFLEPLAHGSSDWSLPREDCINLFLFVLLEEAMKIAKDEDGLV

SEQ ID NO: 180196 - protein, 127 aa, Glycine max
  Coding DNA Sequence Number=SeqID_88511
MMITKDDDKGDEKKLKDQSKINSSKSKINQEEFKTQQESLESRIKIQGSRSQESRSRFKTQDSRMKRRLNQDKYIYLGLTENKRGYISYGSVLVEGTSTRVSKRTREDMNVRGLRVMQRGADGGISM

SEQ ID NO: 180197 - protein, 107 aa, Glycine max
  Coding DNA Sequence Number=SeqID_88512
  Homolog annotation: Hit_ID=Q2HRM6; Match level="QueryCoverage=49%, HitCoverage=13%, E-value=4e-07, Identity=50%"; Hit description=RNA -directed DNA polymerase
EFKDVFSKEIPHGLPPSRSIEHQVDLLLEASLPTSQLTTASPETQHKDAQVKVEYVKRLYDQVKEGMMRIMKLAKYRLKAQVEKDESLSGEGQSPRVEKDEGPSGEG

SEQ ID NO: 180198 - protein, 445 aa, Glycine max
  Coding DNA Sequence Number=SeqID_88513
  Gene Ontology: Mol. function=dimethyl sulfoxide reductase activity; Cellular component=plasma membrane; Biological process=electron transport
  Homolog annotation: Hit_ID=A6T8U0; Match level="QueryCoverage=100%, HitCoverage=54%, E-value=0.0, Identity=94%"; Hit description =Putative dimethyl sulfoxide reductase, major subunit
  Pfam annotation: Domain name=Molybdopterin; Domain location=1-399; Score=334.6; E_value=1.7e-97; Accession=PF00384.13; Description =Molybdopterin oxidoreductase
MTRSSPSASPVMRLMNCYGGSLNQYGTYSTAQIACAMPYTYGSNDGNSTSDIENSKLVVMFGNNPAETRMSGGGITWYLEQARERSNARMIVIDPRYTDTAAGREDEWIPIRPGTDAALVAGIAWVLINENLVDQPFLDKYCIGYDEKTLPADAPANGHYKAYILGQGDDATAKTPQWASRITGIPADRIIKLAREIGMTKPAYICQGWGPQRQANGELSARAIAMLPILTGNVGINGGNSGARESTYTITIERLPVLENPVKTAISCFSWTDAIARGPEMTATRDGVRGKEKLAVPIKFLWNYAGNTIINQHSDINKTHDILQDESKCEMVVVIENFMTSSAKYADILLPDLMTVEQEDIIPNDYAGNMGYLIFIQPATTAKFERKPIYWILSEVAKRLGDDVHQRFTEGRTQEQWLQYLYAKMVAKDPALPGYDELKKMGIYK

SEQ ID NO: 180199 - protein, 169 aa, Glycine max
  Coding DNA Sequence Number=SeqID_88514
MHSEAEALEHTKKRDIGHQSVSLENMTRDSTVLKIGDSVKVVIKQDMKGRKHKYGFNNNKREKTEKKKVMDDETGDKHELYMLDLVASIILRGIGLECKIDCNNINEIREERMQTQFYTGSATSRAYIQYSSNPLEISTIFVNPLQSLNHTGTTHPLCQMLYNKRLTVS

SEQ ID NO: 180200 - protein, 117 aa, Glycine max
  Coding DNA Sequence Number=SeqID_88515
MHLTETCMQVGNSDIYGFLEPQSIQRSGQSQFESESYIKSWMQISWSLPKRVPLQRTLADGGHPAQGTPSCLPKSKASARWIVVKCNRQKGSTKCGYYVMHWMSTIILGTFRNNWEA

SEQ ID NO: 180201 - protein, 55 aa, Glycine max
  Coding DNA Sequence Number=SeqID_88516
MTKLGLCLSSGPPPLDDKRVRITGQYDKDYGAVDKSKALAPTYPPMRNSDLRSSG

SEQ ID NO: 180202 - protein, 97 aa, Glycine max
  Coding DNA Sequence Number=SeqID_88517
MDFYKVERNLKDRRSLGDWRAKLSYYHEESGCDKLVVYMCFNAVLIEFSLTRGICRRCLIRIRLNYHEESGFSILGDTIRTHGHCWIENIFSASGTY

SEQ ID NO: 180203 - protein, 172 aa, Glycine max
  Coding DNA Sequence Number=SeqID_88518
  Pfam annotation: Domain name=zf-CCHC; Domain location=47-64; Score =21.5; E_value=0.00084; Accession=PF00098.14; Description=Zinc knuckle
MALTLIQKKDQGQGILGVTPSKPKYDKGKTIEEQPLKASMQEKTSSMKCFKCLGRGHITSQCPTKKTMIMRSQEIYSSQDEATTSPSSSESEEAKEEESSEEIYPQEEGQPLMVKEECKEVSVSSKRLAKKERHFEIKTNIKEISPLRQPPHFLLCKKTLVSNRIPAARGIH

SEQ ID NO: 180204 - protein, 164 aa, Glycine max
  Coding DNA Sequence Number=SeqID_88519
EDPEVAKFREQGLKFLLEMEFLFKDSRQYEGFNTRTEETNNNIDDNTDMEVNEPEIDTTTQNTSSAKENGQRKRGGEGDKRIGVGAKLSSQLDRIIQTFESSVSAQDPTSITACVAKLKDLPGLERGSELFYKATKLMKKRANRITFVALEEPELQLGWIKSET

SEQ ID NO: 180205 - protein, 134 aa, Glycine max
  Coding DNA Sequence Number=SeqID_88520
  Subcellular localization annotation: CTP_CleavageSite=17; ConfidenceScore=5.24e-01
MKNSEESSRNRSRKHLRSVTEAPRLGFFSRKFFSSLISRESSNNRRAEQFTAFCWNPLEGQEGLNVAKLYGLRHDALFDFWNIAKLYGLRNNALFPSGMSRNFTNYLTTGVKYLEAVKQRLHATKQWSPNEIRV

SEQ ID NO: 180206 - protein, 236 aa, Glycine max
  Coding DNA Sequence Number=SeqID_88521
  Homolog annotation: Hit_ID=A5AKV1; Match level="QueryCoverage=94%, HitCoverage=36%, E-value=2e-08, Identity=23%"; Hit description =Putative uncharacterized protein
MTLTIPELFLRPYQVRWDATVFEVVNPDFPLYIKHKDLSEIAHDGQCLSISVLQLWILHLTETCMRAGNSDIYGFLEPQSIQRSGQSQFESESYIKSWMQSSQRDVYLGAYLNGFHCSGHWQMVVILPKEHLVVWFCSLHNRPDNYLKGIINSAIKVLMMLHSLNQRLLLGGLSSRQKGTTECSYYVMHWMSTIILGSFRNNWEAYFNDPRPLEPERLKALRIQWAQFYLRVRDQA

SEQ ID NO: 180207 - protein, 84 aa, Glycine max
  Coding DNA Sequence Number=SeqID_88522
MGTPGLLHDKHTLHLSRILGKMEVEEPWLGLWQPLNYRVDMGASQHRVPVSRLIRQALKNVVFHILAKPICWLSECPLSVTLMG

SEQ ID NO: 180208 - protein, 169 aa, Glycine max
  Coding DNA Sequence Number=SeqID_88523
  Homolog annotation: Hit_ID=Q2HW90; Match level="QueryCoverage=90%, HitCoverage=34%, E-value=3e-14, Identity=32%"; Hit description =Putative uncharacterized protein
MGPLQMQVFCKAYRKILDLTIAEISTEAIVSLTQYYDQPLRCFTFGDFRLVRTVEEFKEILGCPLGGRKPYLFSGFLPSLSKIAVVVTPFGKRIGSRQARDMANEEEWVPFMDVLALLIFGVVLFPNMDGLVDLAAIDAFLAYHHSKEIPVVAILADLFDTFDRRCDEE

SEQ ID NO: 180209 - protein, 278 aa, Glycine max
  Coding DNA Sequence Number=SeqID_88524
QLGYPMRGAPTEESLSPFLVRNLGAQSLKAIQRVHKAWRSPLRKDKELRGIRNGVIGGYHGWLRIHTWGLDWLSKLKVIDEENFEALEEDEEVRALKLELGKARLANEKFKSAATHIRKECTELQEENAATARALEQETKRARKEEYGREKFRGALWGPKGVWLNTLEATEQSMLAITGQYKEELNQSMAHEQKLVEDFAQVYAEKKARRRVIDALHQEATMWMDRFALTLNGSQDLPRLLAKAKAMAEVCTAPKEIHGLINYCQHMIDLMAHIIRNR

SEQ ID NO: 180210 - protein, 246 aa, Glycine max
  Coding DNA Sequence Number=SeqID_88525
  Homolog annotation: Hit_ID=A5BSR3; Match level="QueryCoverage=29%, HitCoverage=23%, E-value=2e-07, Identity=40%"; Hit description =Putative uncharacterized protein
MDEKRKKKLEEATQFGSTDTIIDPPSPIKRHVKWKLARTKKTSDMTYEAAKEITDKIDALEEQASQGSFVTHGRHDILAAAIRRPEHPVRVHAVGAGITIKQYFGSASRTSSIAPEYLQQLTQQIKDQLEDSITEKVTRRLMLSLSQMQLQGLALPPEPDVGPSAARVSTKESYVDPSGNDPNTDDSYKCGLYIEEYPSRLVALGRVYEGSTTIHNIHLLHDQVKVGVEEIRDADAPIPVPTKEVK

SEQ ID NO: 180211 - protein, 727 aa, Glycine max
  Coding DNA Sequence Number=SeqID_88526
  Gene Ontology: Mol. function=lyase activity; Biological process =phosphonate transport
  Homolog annotation: Hit_ID=A8G937; Match level="QueryCoverage=44%, HitCoverage=90%, E-value=1e-127, Identity=72%"; Hit description =Phosphonate metabolism
  Pfam annotation: Domain name=PhnG; Domain location=2-143; Score =225.6; E_value=1.1e-64; Accession=PF06754.3; Description=Phosphonate metabolism protein PhnG
  Pfam annotation: Domain name=PhnH; Domain location=144-318; Score =217.1; E_value=4.1e-62; Accession=PF05845.3; Description=Bacterial phosphonate metabolism protein (PhnH)
  Pfam annotation: Domain name=PhnI; Domain location=317-662; Score =668.5; E_value=5.4e-198; Accession=PF05861.3; Description=Bacterial phosphonate metabolism protein (PhnI)
  Pfam annotation: Domain name=PhnJ; Domain location=642-727; Score= -39.4; E_value=5.1e-08; Accession=PF06007.2; Description=Phosphonate metabolism protein PhnJ
  Pfam module annotation: Pfam domain module=PhnG::PhnH::PhnI::PhnJ; Domain location=2-143::144-318::317-662::642-727
MKQQTARQHWLSVLAHSEASALASHWQSLQLTPAFERLRPAETGLTRLQARMGGSGKRFVMGDATVTRAVIRLHDGTLGFSYVLGRDKAHAERCALIDALLQQPETQALLQEKIIAPLAALREEQRQLRAREIASSKVDFFTLRAFRRILKAMSEPGVMVSLPLAQGWGDLSPAATAVLLTLVDQESALWLDRRVDSDILRSNLRFHTGVPIVDERDAPFALTHAAANPDPACFAAGDNLSPEKSTTLIVEVPSLNGGLTLRLSGPGLREPRAIAPQLPAAILTYLRERPHPFPQGVDLIFTCGEAMRALPRTTDVEAIASAHQLQADMRRGDRSVAELGCGQVAQQLGLAVDRVMTEGGIFDTQLAALAIKQASGDLVEAIFLLRAYRTTLPRLADSLALETAEMRIERRISAVYKDLPGGQVLGPTYDYSHRLLDFTLLANGETPAAARDDQALAQRCPHVFSMMTREGLAAREEDDGSEPCDITRQPPGYPASRAARLQQLVRGDEGFLLALGYSTQRGYGRNHPFAGEIRTGYLSVSICPEELGFEIEIGEILLTECEMVNGFTTQGDSAPHFTRGYGLVFGRAERKAMAMALVDRALQAPEYQERIAGPAQDEEFVLSHADNVEAAGFVSHLKLPHYLTGYNNGYLDEQTKRTIRRAILKAVAIPGYQVPFAGREMPMPYGWGTAGIQITASIIGDSDVLKVIDQGADDTTNAVSIRRFFQR

SEQ ID NO: 180212 - protein, 100 aa, Glycine max
  Coding DNA Sequence Number=SeqID_88527
MTGHDWSHIIWLLLVGSSRQTLTHKEGGDMVSSPGQAELAWVSNPCTQIIKKRGRGTLLHPKTSPPHLKERTRRIEVLAPSSHFRLPFAFIFGVIIHSNK

SEQ ID NO: 180213 - protein, 27 aa, Glycine max
  Coding DNA Sequence Number=SeqID_88528
MKLSSWLCAALLLSSASALAAPDSCER

SEQ ID NO: 180214 - protein, 286 aa, Glycine max
  Coding DNA Sequence Number=SeqID_88529
  Homolog annotation: Hit_ID=Q1RU80; Match level="QueryCoverage=34%, HitCoverage=77%, E-value=8e-08, Identity=37%"; Hit description =Putative uncharacterized protein
MVVADIAMVVANIACFLLRGPSCWDRTKSSDRVFEVTITLDNVSSLLHLPVVGDLHAFQPLHVDDAVQMLVDLLMVSAEAARTNKGKCRGPYVRLKWTGKYAWGVAALVHMYNHLNDASISTSRQLGGYIMLLVGYTSTFPQSRSPLLIRTTTRIHRMPGAPGPTPDSGFRMSVGSHMGSTDRVMRQFGYTQTIPAPPVDSWVSYDDIHDGWMHYSDHMVVAETNIPHVPKPGAPSTSARPVVDEPRHAMVKVCYGIAERLERHLSLGVVTPGSSTHEVIEECLRM

SEQ ID NO: 180215 - protein, 169 aa, Glycine max
  Coding DNA Sequence Number=SeqID_88530
  Homolog annotation: Hit_ID=A2Q4S5; Match level="QueryCoverage=88%, HitCoverage=22%, E-value=8e-23, Identity=40%"; Hit description=IMP dehydrogenase/GMP reductase, putative
MARTYLLHLLGCTLFANKSATNVHVVYLEALRDLNMTERYAWGVAALVHMYDQLNDASVSHNRQLGGYITLLQHFPSVADSTADQEYDEDSPRACRWITTKKIMKSIRTPAYRERLDRLRIPDVCWIPYGEHREVRDFHVRSCYSGLLRWGPVVVYYRPERVVRQFGYT

SEQ ID NO: 180216 - protein, 109 aa, Glycine max
  Coding DNA Sequence Number=SeqID_88531
MRGVWGRNKFRGALWDSNSKLKLRRAETDQSRVEGMILEDKLKACQRSKRSLSEQLSRTEENMWAIIDQYKEKLSLAATHEQRLEDEYAKVSVLQAKRETRERVIDSLH

SEQ ID NO: 180217 - protein, 134 aa, Glycine max
  Coding DNA Sequence Number=SeqID_88532
MAFLGETNSQTIVNSRLAFIYPNGSIIHNDTGVYFQTSTPVPIRVPNRCHFASLKTRIHNTLQLSDKQFLDEIHYRKPFTDTGKNPKKFEIPSTCTIDELKNLIKQVAPKGIPPLGISRITNGKTIVFPPTSSV

SEQ ID NO: 180218 - protein, 122 aa, Glycine max
  Coding DNA Sequence Number=SeqID_88533
  Subcellular localization annotation: CTP_CleavageSite=61; ConfidenceScore=5.05e-01
MFAHSIKGCRPLGRTCGVLIPSPCVNTTPEPFHLKVRRSRLFRFFRHFPQINVGGDSARIPFMEHASRESRVVLPPKGEFKKTNKQKAGILKSKIRDTRLPPWSASLTSLAEREIMIDRSWA

SEQ ID NO: 180219 - protein, 87 aa, Glycine max
  Coding DNA Sequence Number=SeqID_88534
MTDIVCAENYLCISARHLASRVSMTDTAEDDVNLRVLTGSLAAIDKGCRREDDVSPHASGLSGHWIAKGVCGLPSGVSACHRTLGSR

SEQ ID NO: 180220 - protein, 111 aa, Glycine max
  Coding DNA Sequence Number=SeqID_88535
MVITKDDDKGDDKKLKDQSKNNSSESRTIQGSRSQESRFKVQDLKNQDQDSRIKRRLNQDKGYIYLGLTENKRGYISCRSVLVEGTSTRFKENKGGYIPCGSLLVNGFLQG

SEQ ID NO: 180221 - protein, 47 aa, Glycine max
  Coding DNA Sequence Number=SeqID_88536
MAEVSTEAIASLAQYYDQPLRNWTEESKSKMGWLEYSSKAFTMLLRE

SEQ ID NO: 180222 - protein, 204 aa, Glycine max
  Coding DNA Sequence Number=SeqID_88537
EFNPYNHYEEERALDLESVFEEFMAYHASSKANQNSMQNHEIHFGKSYSLEDYQREEELQTYYQKEAEREVTQAVGRREEEFVEVEAQEKSLVNEHDLKEEDKEKVQQWEQCSQVHTQQENNLQVNTFPHQLIVKEERHEDHEVPIILGQPCLSTASCVLDMGKGKLELSVETLELSVDQKISFDLFEAMKHPDDSEHVLKKKR

SEQ ID NO: 180223 - protein, 97 aa, Glycine max
  Coding DNA Sequence Number=SeqID_88538
  Subcellular localization annotation: CTP_CleavageSite=27; ConfidenceScore=5.04e-01
MHALLGSFNSGNWSDSKVLDSAGLSCRAFARNQGAISQLKAKLHGESKNNSRVQDKNQEEFKTQEESLESRIKIQGSRSQDSRIKRRLNQDKYEKFF

SEQ ID NO: 180224 - protein, 79 aa, Glycine max
  Coding DNA Sequence Number=SeqID_88539
MLHSPHKDDYTFLDFNPIFHHLHHQSNTPPNLAHQADPTSRPRPVASTDPPQPTHSSTFGTVTLHALDQHPGSPPSFPM

SEQ ID NO: 180225 - protein, 75 aa, Glycine max
  Coding DNA Sequence Number=SeqID_88540
  Homolog annotation: Hit_ID=Q8H6W2; Match level="QueryCoverage=92%, HitCoverage=70%, E-value=3e-08, Identity=44%"; Hit description=Gag -protease polyprotein-like protein
MVSSNFLFPEGNSINRPPIFNGVGYHYWKTRMQIFIEAIDLNICKAIEFDPYIPTMVAGNVGSSGLRIIKKGGLN

SEQ ID NO: 180226 - protein, 69 aa, Glycine max
  Coding DNA Sequence Number=SeqID_88541
MASNGGELVLDSSSPLSGISNHLSSFSIQLPLNIKKQRTPLMKKIQGLQAPHGATSCGIRASSSRFFLE

SEQ ID NO: 180227 - protein, 169 aa, Glycine max
  Coding DNA Sequence Number=SeqID_88542
MKGTFYPELVKVFYTYACVDLEGNLFSIVNEVDMVIDAAMWKEVVGLDMGEELDESLRSWWTDCIRQNVGLPHYLNSHSEMNWVLLIKGIMLKSHRLVDYEFPYAVVASKFIDYFNVDVSNEIVDFTEASSENTKRHLKKLEIKFVDHEWIMTRQSTAGNFNQMEDVAK

SEQ ID NO: 180228 - protein, 50 aa, Glycine max
  Coding DNA Sequence Number=SeqID_88543
MTNLWLSKCYLAKPRWQPGKEKAQLPNLKLSMILGDSNLWKLGIDTRATF

SEQ ID NO: 180229 - protein, 106 aa, Glycine max
  Coding DNA Sequence Number=SeqID_88544
MKKQQWRRRFSGRQMRRGERRCHPLGNKPWKKELHHQECVLDKKLGEDASMEEKKERRGEHEIEGIKEGEKWNFEVCLIRLSFIKVTISVTHASIYKLGSFLEKLS

SEQ ID NO: 180230 - protein, 67 aa, Glycine max
  Coding DNA Sequence Number=SeqID_88545
MKTKTRSRITNNIVSEIEQEAPYQDDELVGLQEVLELNPNVINESLADVDGGGENLMNHSKLVEGVS

SEQ ID NO: 180231 - protein, 213 aa, Glycine max
  Coding DNA Sequence Number=SeqID_88546
MGSSQKPSFKKRFYQVKIKSLEVTSLRELGQLMGQLQRQAFRKAYAVEVLHLWGLLAITNGIRPPKASRKWGGRNTEKIFGAVDVFLAYHNHKESPVVAMLADLYDTFDRRCPSIRYKVTARASKKERRIGTNSWLAWGGDRELRGSSNGIIGGYHKWLRVRTQGLDWLPNLKTVRDDEVKASEESDEVQALKAELERARVVEEKFKSIAIKV

SEQ ID NO: 180232 - protein, 337 aa, Glycine max
  Coding DNA Sequence Number=SeqID_88547
MAKFDPEIVLEFYANAWPMAEGVRDMRSWVRGQWIPFDADALSQFLGDPLVLEEGQQCEFSQRRNRADDFDEEAIAQLLCIPGQDFTRTTAGRRVRIMRTSMTTLTQTWITLLVSNVLPSDHNSDLPLPKCQLVYAILTRMSVNVAQVIADAIYMFTGMAPTRHPLDPDKSNRALGFPALITGLCQSYGVPVTHSKVIRPPITRAFIEKYCTPRQAQGDAHQAAGAPPPPRQADPAGPLGVERYLEHLVCQQAANHRGQVQIHECLYRFSLSQHEQGSARFVCPTPEQFGAEVAWPGDWPDAQAGEEPTGSPGEAHESCMDEDMTDLLGFLGGSGAA

SEQ ID NO: 180233 - protein, 109 aa, Glycine max
  Coding DNA Sequence Number=SeqID_88548
MEFGLRCDALNNSLFKVALGMTLREEPLLMSTLATMWSKHLTKTCKALLCPLPSTGISSYAKELGHLLSGYSLLAKVVPFLGNLSNQDLVIWGQARLIALAHIRLCFPF

SEQ ID NO: 180234 - protein, 365 aa, Glycine max
  Coding DNA Sequence Number=SeqID_88549
  Homolog annotation: Hit_ID=Q6WAY6; Match level="QueryCoverage=95%, HitCoverage=72%, E-value=1e-28, Identity=29%"; Hit description =Putative uncharacterized protein
MVEVPIEAIASLAQYYDQPLRCFTFGDFQLSPMVEEFEEILGCPLGGRRPYLFSGKCLEAKARTLAGRGEWAPFIDILALLIFEGVLFPNVDGLVDLAAINAFLAYHDHKESPVVAMLADLYDTFDRRCEKSKKGGANWDQLLATKQGASVNWFPRWNEGRTGVLISCGGFPNVPLMGTRGCISYNPVLAIRQLGYPMRGAPLGDELAPVISRGFNKTNMETLQKVRKAWEVLTAKRKEVEALEEDAEVQALRAELEQAQTIKERFKSAALKIRKENAELRDINIATTKALEQETKRARREEHGQNKFRGALSKRSLSQRLGERETNMLAIITKYQEELNLVAAHEHRVVDEYAQVYAENEARGR

SEQ ID NO: 180235 - protein, 228 aa, Glycine max
  Coding DNA Sequence Number=SeqID_88550
  Gene Ontology: Mol. function=motor activity; Cellular component=cell projection
  Homolog annotation: Hit_ID=UPI00016621D1; Match level="QueryCoverage =96%, HitCoverage=40%, E-value=5e-21, Identity=35%"; Hit description =UPI00016621D1 related cluster
TLVFRGLFALAFRGLHVLTFRGLHVLAIRGLHVLAIRGLHALAFVGLHALTFKGLHVLAFRGLHVLTFRGLHVLTFRGLHVLAFRGLHILTFRGLHVLTFRGLHVFAFRGLHVLTFRGLHVLTFRGLHVLSIRGLHTLTFIGLHTLTSRGLHVLAFRGSCTFTFKGLHVLASRGLHVLAFRGLHALASRGLHALNFRGLHVLTFKGLHVLVFRGLHVLTLLKPTRPRL

SEQ ID NO: 180236 - protein, 165 aa, Glycine max
  Coding DNA Sequence Number=SeqID_88551
MWIVASGNRLPKVSNRLQGLKIEDRRLRWSLIVMAAQLIRDRVEMECLEGAWETLEGNTRCRFRGTIRFTATSLVHPDEPARTLQRTVEWILPTPTPYRLVEPVQVIERVMRIHFLRWILPRKSCRHLRQTLRRIVARGRWRSAEALHPSGQLYGLVLYFEGGCI

SEQ ID NO: 180237 - protein, 106 aa, Glycine max
  Coding DNA Sequence Number=SeqID_88552
MKTMIMRGQDEATTSPSSSESEEAKGEKSSEEIYPQEEGQPLVVKEKCKEVSVSSKSLAKEGTYFSIKTNIRETFPLRQPPHFLFCKKTLASIATPLGLEFIPQLK

SEQ ID NO: 180238 - protein, 76 aa, Glycine max
  Coding DNA Sequence Number=SeqID_88553
SVLDTVLIGCKGPFPREDLEDLWARARKAKEALQQVLSILFEYKPKFQGEKSKGPIGNLGISLLGDQMVADLLAVG

SEQ ID NO: 180239 - protein, 287 aa, Glycine max
  Coding DNA Sequence Number=SeqID_88554
  Homolog annotation: Hit_ID=Q6WAY6; Match level="QueryCoverage=37%, HitCoverage=19%, E-value=3e-14, Identity=38%"; Hit description =Putative uncharacterized protein
RASVNWFPRWKEGRTEILISCGGFPNVPLMRTRGCISYNPILAIRQLGYPMRGAPLEEELAPIIARGFNKTNVEALQKVRKSWEMVQKKDKELRGSNNGPIDGFRKWLKAHMQGLDWLPSLRTTKGEEVEAPEEDKEVQALRAELEQAQTVKESELKLRREERDQSRVDSLILKDELKICLRSKRSLSQRLCETETNMLAVISKYQEELKLATAHEHKVADEYARVYAEKRARGRVIDSLHQEATIWMDRFALTLNGSQELPRLLAKAKAMADTYFAPKEIHRLLSY

SEQ ID NO: 180240 - protein, 375 aa, Glycine max
  Coding DNA Sequence Number=SeqID_88555
  Homolog annotation: Hit_ID=Q6WAY6; Match level="QueryCoverage=91%, HitCoverage=57%, E-value=6e-41, Identity=32%"; Hit description =Putative uncharacterized protein
MGTNQNGKSFYQVKVKILDVTSLKELGRLMGPPQRQAFRKVYEKILDLTAAEVFTEAVVSLAQYYDQPLRCFTFGDFQMVPTIEEFEEILGCPLGGRKPYLFSGFLPSLSKIAAVVGDSARELDRMKQTRNGVVGLPWKYLEGKARDMASQDKWGPFADILALLIFGVVLFPNMDGLEDLAAIDAFLAYHHGKESPVVAILADLFDTFDRRCEKNSARIVCYLPALCVWLVSHLFQQDTRHPCPLQSYRSCAEKGRVDWDQHLAGIGGNAINWFPRWKEGKEGVLFSCGDYPNVPLIGTRDCINYNPALAIRQLGYPMRGAPTEESLSPFLVRDLGAQSLKVIQRVHKAWRSPLKKDKEIRGIPKTVSSVVIMDG

SEQ ID NO: 180241 - protein, 236 aa, Glycine max
  Coding DNA Sequence Number=SeqID_88556
  Gene Ontology: Mol. function=nucleotide binding; Cellular component =cytoplasm; Biological process=mitotic chromosome condensation
  Homolog annotation: Hit_ID=A8AIF5; Match level="QueryCoverage=95%, HitCoverage=15%, E-value=1e-114, Identity=94%"; Hit description =Chromosome partition protein mukB
MSDKALGALRLAVADNEHLRDVLRMSEDPKRPERKIQFFIAVYQHLRERIRQDIIRTDDPVEAIEQMEIELNRLTEELTAREQTLAISSRSAANIIRKTIQREQNRIRQLNQGLQAVSFGQVRSVRLNVNVRETHAMLLDTLSEEHEQHQDLFTSNRLTFSEALAKLYQRLNPQIDMGQRTAQTIGEELLDYRNYLEMEVEVNRGSDGWLRAESGALSTGEAIGTELGRGVTASAR

SEQ ID NO: 180242 - protein, 166 aa, Glycine max
  Coding DNA Sequence Number=SeqID_88557
  Homolog annotation: Hit_ID=Q69F85; Match level="QueryCoverage=73%, HitCoverage=7%, E-value=2e-07, Identity=30%"; Hit description=Gag -pol polyprotein
MDKLQERAKGYIQIEEISRLRNEVQQAGQKRDKREGVTKIDSHKSDKRHKSYNCITILEEFFNAEVPIKLPPPLPCKLGLDKTKYYRYHHRYGYNIEDCWALKDKIEELIQAGYLAQFVKRTNIHSARARHGGHQEDQHRNQDVDRRRDRVEDRGRQRLYQQKREL

SEQ ID NO: 180243 - protein, 173 aa, Glycine max
  Coding DNA Sequence Number=SeqID_88558
MIIDQSLFFSLTKLPSQGAPFEGTIVDDWKFDYSSHDARRMIDWAHLVRYRMHKALRANAPLPYPQLVTLFLHHFQIPLDDEPFVQVKRSFAIGAGAVTSFGYRKDRDGQWLKKDALPQQDERTPSPPQRYDSSALMNEVLSELRGLRTYVGERFDSLDGHFEGMDTHITQFD

SEQ ID NO: 180244 - protein, 76 aa, Glycine max
  Coding DNA Sequence Number=SeqID_88559
MSQNFMDYYAIIPSLTSGILRNFTDCTIMLPFDSQHVAELHGLPNDGCHVPRSGHAKVASHQTDGPRTKLGYDNQQ

SEQ ID NO: 180245 - protein, 222 aa, Glycine max
  Coding DNA Sequence Number=SeqID_88560
  Homolog annotation: Hit_ID=A5APR7; Match level="QueryCoverage=20%, HitCoverage=5%, E-value=2e-08, Identity=61%"; Hit description =Putative uncharacterized protein
  Pfam annotation: Domain name=RVT_2; Domain location=103-221; Score= -173.7; E_value=0.0029; Accession=PF07727.5; Description=Reverse transcriptase (RNA-dependent DNA pol
MLQPCGIDIGLKEHSNQVYLPPRPRLQRVRQGLSLLTQRFPKIPQGFPLVVLLVFPSVGEKENGLKPQCHCLRVRGISISTDIILQIPIVGLGVCGKKRVLGDEEGRTNLRERKSVKTYRKYVSSAFLNGYLEKEIYMTQPPGCEFSNNQLVCSLQKAIYGLDQAPRACLLLLNLSSLLGHHADWASLIKTIEGPHLARVNLVDQGNMISWWTKYELTCLRG

SEQ ID NO: 180246 - protein, 68 aa, Glycine max
  Coding DNA Sequence Number=SeqID_88561
MKLPTKGGKPNSKGDRGLSEDEEFGLGMTSTSGVATPPSPKSTRLKVEMIKLGDQMRRMSYEDKGWRE

SEQ ID NO: 180247 - protein, 97 aa, Glycine max
  Coding DNA Sequence Number=SeqID_88562
  Subcellular localization annotation: CTP_CleavageSite=40; ConfidenceScore=5.32e-01
MWYDTKGAIPSNSAMYLLTSKGIPFSYPLSSATASNTFIDCNKLTGPSTKQLGKSNLKRKPSTELMQKLDAQLLFGLTKKIDAKFVIKSVMQWQISP

SEQ ID NO: 180248 - protein, 80 aa, Glycine max
  Coding DNA Sequence Number=SeqID_88563
MASGLYSFSCKAEEWSRVWLDYIRLNFKPLECLQILYVREAALVNEDLRHHEVGNYDGDNHGVVLVDRVDVEAKTLPLMF

SEQ ID NO: 180249 - protein, 465 aa, Glycine max
  Coding DNA Sequence Number=SeqID_88564
MDLKLVVPHRGGCDQGGLQDLAHQIENEPVACQVYFVNPRWYIIPPSSEPTCSKRGCLVSRSGNLDKCKSCRFVRFAKLPNLDKCCPGCFCKDVWGGHAFGFAGKIRRIRRVQCMRVALACVSLVKWARTGHMQPLVDPKAISIGDSSSEKTHHGASNSESSSLERLTILHYVGGGTFRLHRRVQPLTSSLDGESILVTIVSPIVACHKWVRDNVLKYQDCFFKILVTNVMVDGLPLMFNWDEEPCFPFYWQPDPTRFKLFDEDLLTLVERVDKAILEQLPTSLDARAILSLLLIGDPLVALDGKMPYLVLFCVQGRTVPPSIVIPPIGERGQPTVGVGPTDKVVEVFPNMPSSILAKRKCDDGVGVSPLEFARSSFGSISCPGYCSAVATTIVVAASTPPPPPAMSIQEIYGSLAIEVSAPTTLASPVGVPPSTIVVPLLSVGVATTSALVMLPPPSSAPSIPP

SEQ ID NO: 180250 - protein, 258 aa, Glycine max
  Coding DNA Sequence Number=SeqID_88565
LGRIDGDPVLRETRIWATWEYVSSDGGGQQGMVGLCALCGCGKLVVHHRPTATYGTWRYVAGVRRPWGRQVGRAPGSQQIKGTKTTKQGGLWWLASCELLLICGLWPLVIDYQGLENEASGNRLPACVIDYTEGWVIGNRLPASGNRLPRLCNRLPEMKSLKILLLIACSGYETHCVATYRLVEPVQVIEVTSSEEDPEEDLEELPPEPAVDALDFLEGDEDPLLEVDSPEEVMSASEADSTEDSGPGEMATSGGSSS

SEQ ID NO: 180251 - protein, 145 aa, Glycine max
  Coding DNA Sequence Number=SeqID_88566
MVDEVENGVVNTVLIAIIATTMGKLKSNVSPRSTYQTMMGVGHESRGLYQLSRLAFHYFWPLYLRLHSVRRVINKDLVSQPILRREGDAGFTGVSSKGGRRAEPPPTFIRGKRRTCGLRTLIVKGSGVVFTHREGISTPRVRHKG

SEQ ID NO: 180252 - protein, 201 aa, Glycine max
  Coding DNA Sequence Number=SeqID_88567
  Homolog annotation: Hit_ID=A2Q142; Match level="QueryCoverage=52%, HitCoverage=37%, E-value=3e-07, Identity=33%"; Hit description =Ovarian tumour, otubain
MGEDSWSLVRTHLLIELGKFSKDYIKLFGGTNIFEELRMSLHVDGLTKVTMDKWMDIIDIGYVIASRLKLSALGLFVMLTYPDQIFRCCPPLAKVNTKGAPKKSMNRNPRSTKRDPSYWEYVDGFHSQQNSNSLVKHSASSSEQPNPRRIMPMLDQFQPFIHDIIDNIVDVQADGNCGYWSVSSLLVWVKTLGRWSAPICL

SEQ ID NO: 180253 - protein, 126 aa, Glycine max
  Coding DNA Sequence Number=SeqID_88568
MKKILGLQAPMELTSYVSYMMPMRKDQAHGILGAAPSKCKEDKGHIASQCPTKKTMIMKGQDIYSSQEETTSCPSSSGSEDEVRGEESSEEVYPHEEGDFLMVRRLLGGQSCDLSQSQRENIFHTR

SEQ ID NO: 180254 - protein, 142 aa, Glycine max
  Coding DNA Sequence Number=SeqID_88569
  Homolog annotation: Hit_ID=A6N1F2; Match level="QueryCoverage=39%, HitCoverage=70%, E-value=1e-13, Identity=67%"; Hit description=Imp biosynthesis protein
VEENASSQSSSTRRYSAEVIHAILPGKARTPSTNGYLYPKPTQCRKVKEVGDLMTGEPTTEAPVNGGRNYNGPKVAKFLVGLGEIDMSVKMRTTCTWTERPYEASLFPGIGFGLFLRSLGGGQRRPPSGGARAISEIPLWKS

SEQ ID NO: 180255 - protein, 105 aa, Glycine max
  Coding DNA Sequence Number=SeqID_88570
  Homolog annotation: Hit_ID=A5APE9; Match level="QueryCoverage=35%, HitCoverage=3%, E-value=2e-09, Identity=83%"; Hit description =Putative uncharacterized protein
  Pfam annotation: Domain name=Ald_Xan_dh_C; Domain location=16-97; Score=-29.3; E_value=0.012; Accession=PF01315.13; Description =Aldehyde oxidase and xanthine dehydrogenase, ab hammerhead domain
  Subcellular localization annotation: CTP_CleavageSite=43; ConfidenceScore=5.32e-01
MSRNLTDYGIVPSLASGMLRNFTDCALTLPFNSRMSRNFTDCLTMSVKYLEVSSEGRIPPNRWSPDEIRVIGVVVADTHENAKIAARRVHVEYEELPAILSIRDA

SEQ ID NO: 180256 - protein, 357 aa, Glycine max
  Coding DNA Sequence Number=SeqID_88571
  Gene Ontology: Mol. function=transferase activity; Cellular component= integral to membrane; Biological process=metabolic process
  Homolog annotation: Hit_ID=Q5GXZ0; Match level="QueryCoverage=38%, HitCoverage=27%, E-value=5e-51, Identity=70%"; Hit description=GumD protein
  Pfam annotation: Domain name=Bac_transf; Domain location=1-187; Score= 42.4; E_value=2.2e-12; Accession=PF02397.7; Description=Bacterial sugar transferase
  Pfam annotation: Domain name=LMWPc; Domain location=170-310; Score =170.2; E_value=5.3e-48; Accession=PF01451.12; Description=Low molecular weight phosphotyrosine protein phosphatase
  Pfam module annotation: Pfam domain module=Bac_transf::LMWPc; Domain location=1-187::170-310
DIIEAGVAVILLAPLFAVLAIGVKLSSPKPVLFRQKRHGLGGKELWMLKFRSMRVHAEGAGQITQATRGDPRVTRFGAFLRRSSLDELPQFFNVLGGNMSVVGPRPHAIQHNDHYERVIERYMHRHYVKPGITGWAQSDAGCTDHFDDGLQSAGPEIGILGEAAAGMWRHNILVVCVGNICRSPSAEVMLREAVSGRGITVSSAGLGALVNHGVDATAQALLTEHGLDGSSHRARQIDRGILAASDLVLVMERKHVHRIIEIAPEASGKTFLLGKWQSDREIPDPYRQQRAAFEHVYTLMDEGVKSWTNGREPSGSRLLSFPDVTQIVVEEALVAITSHAVQAVLAAEHGATIADQR

SEQ ID NO: 180257 - protein, 191 aa, Glycine max
  Coding DNA Sequence Number=SeqID_88572
  Subcellular localization annotation: CTP_CleavageSite=43; ConfidenceScore=5.03e-01
MDHAQHQNSDLPLPKCQLGSSPHDTQWTRRSPTGLWGFQLWLWASVNPTGCPSPPQQGIAPARHPVDPEKSNRVLGFPALITGLCQFYGVPVAPNKVIRAPINRDFIKKYCAPQAGTGRDTTAAWGWPAAGNRRTAATSRAPQLIYKGWSVAYDPWSTSRRPSPKPKVSKSTRSMTNKSSRVQLKTLKKRY

SEQ ID NO: 180258 - protein, 187 aa, Glycine max
  Coding DNA Sequence Number=SeqID_88573
  Homolog annotation: Hit_ID=A5BKT6; Match level="QueryCoverage=42%, HitCoverage=9%, E-value=2e-10, Identity=43%"; Hit description =Putative uncharacterized protein
MGEGNIRNQYKAQIKNVLYVDGLKHNLLIISQLYDKGFKIEFNKHCFLIDEAISGEVVHIGKRIGHIYMLKIEHASFHELSCLGYTDKHASSQSSSQKRLSMDDPKESHLTAVKRIIEYLKGTTKEEHKWDMPPIRKLACILELQEAGLCSTFDVAPCGACRPWIFSINGVPYFLKINGSGMEKEER

SEQ ID NO: 180259 - protein, 152 aa, Glycine max
  Coding DNA Sequence Number=SeqID_88574
QHSAQRPQRQSPPAKVSVGLCRPDMGIAPTRHPVDPEKSNRALGFPALVTGLYQSYRVPVPPRQGYVIIGIAPARHPVDPKRSNRVLELSSSNYESLSVLRRRNTTAALGWPVAGNRHTATTSRVNLSSSAKRLERCLRHMADQQATKSKAK

SEQ ID NO: 180260 - protein, 105 aa, Glycine max
  Coding DNA Sequence Number=SeqID_88575
MNPFFKVKRSFSIGVGAITSFGYRKDVDGQWVRKQDLSLPIPDERTPSPPPQRTDSTSLLTEVLTELRDLRAFVDERFDAMDTRITRLEDDMSFIRRCFNPPVNS

SEQ ID NO: 180261 - protein, 156 aa, Glycine max
  Coding DNA Sequence Number=SeqID_88576
MDNHSWCYPACIQCHRKIDIQTGPFTCGCGKDNDQPVLSMYIARYRVEVMDGDLDLNVSPQALDRLLGYVLAFKVRIQSKFKNVVVLRYSNELDLINVVLEMLADIDHDPVAGFPLTPKKRIPSDEVDDELGSSQISLAQLSSNKLTRHSDKCVFS

SEQ ID NO: 180262 - protein, 300 aa, Glycine max
  Coding DNA Sequence Number=SeqID_88577
  Gene Ontology: Mol. function=transcription factor activity; Cellular component=cytoplasm; Biological process=regulation of transcription, DNA-dependent
  Homolog annotation: Hit_ID=P45600; Match level="QueryCoverage=99%, HitCoverage=92%, E-value=1e-160, Identity=95%"; Hit description=HTH -type transcriptional regulator cysB
  Pfam annotation: Domain name=HTH_1; Domain location=7-40; Score=20.8; E_value=0.005; Accession=PF00126.18; Description=Bacterial regulatory helix-turn-helix protein, lysR family
  Pfam annotation: Domain name=LysR_substrate; Domain location=64-272; Score=161.3; E_value=2.5e-45; Accession=PF03466.11; Description=LysR substrate binding domain
  Pfam module annotation: Pfam domain module=HTH_1::LysR_substrate; Domain location=7-40::64-272
FVYLVNRGISKQVRMLEDELGIQIFARSGKHLTQVTPAGQEIIRIAREVLSKVDAIKSVAGEHTWPDKGSLYIATTHTQARYALPGVIKGFIERYPRVSLHMHQGSPTQIAEAVSKGNADFAIATEALHLYDDLVMLPCYHWNRSIVVTPDHPLAGKGSVTIEELAQYPLVTYTFGFTGRSELDTAFNRAGLTPRIVFTATDADVIKTYVRLGLGVGVIASMAVDPVSDPDLVRLDAHDIFSHSTTKIGFRRSTFLRSYMYDFIQRFAPHLTRDVVDTAVALRSNEDIEEMFKDIKLPAK

SEQ ID NO: 180263 - protein, 36 aa, Glycine max
  Coding DNA Sequence Number=SeqID_88578
MDARISINIGSTVLHEGIIVDIISLLSRDIEIWPNS

SEQ ID NO: 180264 - protein, 116 aa, Glycine max
  Coding DNA Sequence Number=SeqID_88579
MSVLELYVEKDIAGGSMFHAANSVTSCGHNVSHHESKLPRNISNLHDDEDDDDNYLASNSYVEESFDEDDIVDGISDTDDEVTDIVEPVSIIHPTEGVPGIQNPFWNDALHYNNIN

SEQ ID NO: 180265 - protein, 378 aa, Glycine max
  Coding DNA Sequence Number=SeqID_88580
  Gene Ontology: Mol. function=nucleoside-triphosphatase activity; Cellular component=plastid stroma
  Homolog annotation: Hit_ID=Q0ZIV6; Match level="QueryCoverage=97%, HitCoverage=19%, E-value=1e-137, Identity=61%"; Hit description =Protein ycf2
MSHTNGFGSTTMGSNVRDLVALTNEALSISIIQKKSIIDTNIIRSVLHRQTWDFRSQVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRVTLLLRSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKHWFIKNTQEKHFELLIHCQRWLRINSSLSNGFFRSNTLSESYQYLSNLFLSNEALLDQMTKTLLRKRWLFPDEMVVAICSNNESLV

SEQ ID NO: 180266 - protein, 110 aa, Glycine max
  Coding DNA Sequence Number=SeqID_88581
MYSSCLRFTLHKSSDHNSFVEAKLHDDDKGDDKKLKDQSKNNPSNQVRIKNNSRVQDRIKRRIQDSRGKLRVKNQDSRFKISRIKIKIQDSREGLIKISMKSFSQKLSST

SEQ ID NO: 180267 - protein, 45 aa, Glycine max
  Coding DNA Sequence Number=SeqID_88582
MNPLSCEMWKELQTKVAELLKAKPQKRELHQGRGGNYYQAAQTSG

SEQ ID NO: 180268 - protein, 77 aa, Glycine max
  Coding DNA Sequence Number=SeqID_88583
  Gene Ontology: Mol. function=nucleic acid binding; Biological process= DNA integration
  Homolog annotation: Hit_ID=A5C0G9; Match level="QueryCoverage=100%, HitCoverage=29%, E-value=3e-13, Identity=37%"; Hit description =Putative uncharacterized protein
MGEGKIGNQHKNEIKNMLYVDGLKHNLLSISQLCDKGFKIEFNKNCCLICETKNDEFWHRRAGHINMHRLNHLVKKD

SEQ ID NO: 180269 - protein, 66 aa, Glycine max
  Coding DNA Sequence Number=SeqID_88584
QPANLPTPVLDLPTDPSTPLLDLPEDPSTPVLGLTTTPLATPVLHLADEEGTQDQETQQDDQSQEF

SEQ ID NO: 180270 - protein, 55 aa, Glycine max
  Coding DNA Sequence Number=SeqID_88585
MMTLCKPRRRHQRAIIVIVLSVGNLDTSKRIAQSVSLGSKRKVSLMLMDSLQSKP

SEQ ID NO: 180271 - protein, 80 aa, Glycine max
  Coding DNA Sequence Number=SeqID_88586
MTEPLDESISFFLIKVDPWVLVPITFRGPYVLAIRGLHILVCRGLHTLAFRGLHVLIFSVLHIHTLREYKGSRPQDAQWT

SEQ ID NO: 180272 - protein, 213 aa, Glycine max
  Coding DNA Sequence Number=SeqID_88587
  Gene Ontology: Mol. function=RNA-directed DNA polymerase activity; Biological process=RNA-dependent DNA replication
  Homolog annotation: Hit_ID=Q0ZCD0; Match level="QueryCoverage=74%, HitCoverage=13%, E-value=3e-09, Identity=26%"; Hit description =Integrase
MERSMIDATSGGTLGDMTPVEARNLTEKMASNSQQFSARNDVIVLRGVHEVAIDSSSSAENKKLEGKLDALVNLVTQLAMNQKSASAPIARVCGLCSSADHHTDLCPSLQQSGVNKQPEAYAANIYNRPPQQQNQQQQNNYDLSSNRYNPGWRNHPNLRWASPPQQQQLVPPFQNVAGPSKPHANDYPEYAISARDKSLYSESNKSDGADGYS

SEQ ID NO: 180273 - protein, 59 aa, Glycine max
  Coding DNA Sequence Number=SeqID_88588
  Pfam annotation: Domain name=Ycf4; Domain location=1-58; Score= -120.6; E_value=0.043; Accession=PF02392.7; Description=Ycf4
MAFYGIAGLFSSFYFGSIIFWDIGGGFDIFNKKGKKMRRYLISKSDYYIPNPKCSLVYS

SEQ ID NO: 180274 - protein, 31 aa, Glycine max
  Coding DNA Sequence Number=SeqID_88589
MENVMMRLRRPKKHHFLVNHALEENARIMHE

SEQ ID NO: 180275 - protein, 43 aa, Glycine max
  Coding DNA Sequence Number=SeqID_88590
MDEDQWMYDYTMSQEVHMDYDNEEECGVNEPHVDCSNAFNTCQ

SEQ ID NO: 180276 - protein, 494 aa, Glycine max
  Coding DNA Sequence Number=SeqID_88591
  Pfam annotation: Domain name=DUF1777; Domain location=15-207; Score= -85.1; E_value=0.086; Accession=PF08648.3; Description=Protein of unknown function (DUF1777)
  Pfam annotation: Domain name=RRM_1; Domain location=160-230; Score =23.9; E_value=0.00062; Accession=PF00076.13; Description=RNA recognition motif. (a.k.a. RRM, RB
  Pfam module annotation: Pfam domain module=DUF1777::RRM_1; Domain location=15-207::160-230
MDFITSEDHGCAPFSRDSQRKRQRERQRERQREKQGERQGERQRERGRERVPRSEREIGRDRTRRKETWSENRRTRSGSSWRRRSMDRTTNPYGRARTNVPGRVPPYADEDNWTTVVTRRSAKARKKQLLMGRQSKNLESGGHSKYYNLNWRNNPDITSFYFTHFPDEANEELLWGYFKKWGDVREVYIAKRLNKEGRRYGFVRFKGVSDVKGLEVRLDNIFINDCKLFVNLPRFERLALKTDLQKKSFIGRKPLDRPNKHCGVITGPPTRSYADVTASGAYTGGTKREEATITTILINPEEGRGYWCNEAWVGRLKKVIEVGTLEDRIAWELGYNTRINFLGDDMVLFPGMPDQKAQHIIRAETEIGNSLFYSLKKWTSDCRPKNRVVWLQVWGFPIQLDDDTEDRYGLYRARLLVRTPLPLSIRTKVRVCVGDLEYRVWIVEETGLDGGLTRKGNSPSEGWSEEISSDDVADGIIDDGDTMSSFSPESPYRK

SEQ ID NO: 180277 - protein, 65 aa, Glycine max
  Coding DNA Sequence Number=SeqID_88592
MHHKHARVQAVLSMAEHDRRLKFHHINTSLHLMVPPWQASLHKLPVVVGKKSAMPFHHGGAMAAI

SEQ ID NO: 180278 - protein, 213 aa, Glycine max
  Coding DNA Sequence Number=SeqID_88593
  Gene Ontology: Mol. function=binding; Cellular component =intracellular; Biological process=mRNA processing
  Homolog annotation: Hit_ID=A7PFB2; Match level="QueryCoverage=97%, HitCoverage=24%, E-value=1e-63, Identity=60%"; Hit description =Chromosome chr11 scaffold_14, whole genome shotgun sequence
  Pfam annotation: Domain name=TPR_2; Domain location=180-213; Score =19.3; E_value=0.014; Accession=PF07719.8; Description=Tetratricopepti de repeat
MDERADIASGPVWMEYIAFLKSLPAINAQEESHRMTTMRKVYQKAIVTPTHHIEQLWKDYENFENSVSRQLLFFVGIRLEYFKGMQFDDKSQLTITTVTAHSFISILVSSFMASASIPPPPPPPVNGGTPLGSVEEMQWMAWKRLLSFEKGNPQRIDTASSNKRIIFTYEQCLMHMYHYPDIWYDYATWHAKGGLIDSAIKVFQRALKALPGL

SEQ ID NO: 180279 - protein, 163 aa, Glycine max
  Coding DNA Sequence Number=SeqID_88594
MISITKHNQNHTFLPITTNQSTQQEHSLQLETIAEAARIWVWPPRRANAEQHRNNTNEQKILLGALYSLTNETDGFLRPQRRCKQPRARFPTTVLSLSRRWGASGRGKVLWEDADSRELMTEQRPQETTPEIVRGRRTQTSEAVMLVISSPRKRGMRKIGERK

SEQ ID NO: 180280 - protein, 142 aa, Glycine max
  Coding DNA Sequence Number=SeqID_88595
  Gene Ontology: Mol. function=binding; Cellular component =intracellular; Biological process=mRNA processing
  Homolog annotation: Hit_ID=A7PFB2; Match level="QueryCoverage=71%, HitCoverage=11%, E-value=6e-27, Identity=63%"; Hit description =Chromosome chr11 scaffold_14, whole genome shotgun sequence
MVRTLTPCSCVVDDKPSGGDKYNVETAEILANEAQHLPVAEATPIYEQLLLLFPTAVSVLVECFGWLLLEEMQYVEAHMAANNDDATKQIFSRCLLNCLQIPLWYIVCIILFMALAGEVSGKRMGYKLTACRVAVFLFDQPK

SEQ ID NO: 180281 - protein, 18 aa, Glycine max
  Coding DNA Sequence Number=SeqID_88596
MELWVNEVNARVTEVLMR

SEQ ID NO: 180282 - protein, 149 aa, Glycine max
  Coding DNA Sequence Number=SeqID_88597
MDKKFSKSSKKVDNNNNYTCFEYAKSINHLSTSEEIEVNSDFEELLEAFNEMHEEAQKLAVLNKKLKSELNLHVNKLASTQDEFNKLKQENEKLVSKCKAIACDDTSTSFNMDDYKFLQTKFESFKKDHHVECMKLHTELSYLKDLLEN

SEQ ID NO: 180283 - protein, 44 aa, Glycine max
  Coding DNA Sequence Number=SeqID_88598
MPLQGEDDSRRSSPPKEAMDKSLEVGEEEWRENERGSPKFVPQK

SEQ ID NO: 180284 - protein, 99 aa, Glycine max
  Coding DNA Sequence Number=SeqID_88599
MASRKRKSTTSRPQPNYDTRRFTLEEAWNRYADNTLDRNILPERNMKLYIMEFDEFRRELERRNLHKHLTNLADGSIDVTVVKEFYANLYDPEDNSPKQ

SEQ ID NO: 180285 - protein, 114 aa, Glycine max
  Coding DNA Sequence Number=SeqID_88600
  Subcellular localization annotation: CTP_CleavageSite=22; ConfidenceScore=5.51e-01
MFPWAISRRFSTVLHRSSFVLRRSSVFNRLSSLVTDAWGANTFPVRKYNSRTFHLKFVDHVFFWFFQRFPQINVGGDSAHFPFLEDASVSLASPSRRRVGCDSWRLQWGLLLES

SEQ ID NO: 180286 - protein, 164 aa, Glycine max
  Coding DNA Sequence Number=SeqID_88601
MGDFIRRLSFSENTETFSSLTSYPELRRSEFLIGGYVGARASLLSTTPLSVTMTQELVARGDTLRLSAPFCHPEAAGPMTCGDKIWSFRTPLPFRHSRVRWHAETKCGHSAPLCHPEAAGPMTCGDKIWSYRTLLPFRHSCVRWHAETNDGHAAPLVNRGRQAR

SEQ ID NO: 180287 - protein, 176 aa, Glycine max
  Coding DNA Sequence Number=SeqID_88602
MISMSADARQVIGQLWLTGKYAWGVAALVHMYNHLNDASISTSRQLGGYIMLLVGYTSTFPQSRSPLLIRTTTRIHRMPGAPGPTPDSGFRMSVGSHMGSTDRVMRQFGYTQTIPAPPVDSWVSYDDIHDGWMHYSDHMVVAVVPEVPETNIPHVPKPGAPSTSARPVVDEPRHAM

SEQ ID NO: 180288 - protein, 208 aa, Glycine max
  Coding DNA Sequence Number=SeqID_88603
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=9e-17, Identity=29%"; Hit description= UPI00006A17C9 related cluster
  Subcellular localization annotation: CTP_CleavageSite=81; ConfidenceScore=5.26e-01
VVMLVRMVRTLLFAAARVKSCPSMHSSCVIASLSGCARTVGPPPISGGGPGTVWIWSPLKVRTRSPLKARACSPLKFRTCRLSKARECSPMMARTCNPLKVRACSPTKVKAHDPLTARTCSPLKLKVHDPLKARTCSPLKVKARTYSPLEVRACSPLVVRTCSPLKVRACSPLKARTCSPPEVRACSPLMVRTCSPLKARTCSPLNGE

SEQ ID NO: 180289 - protein, 265 aa, Glycine max
  Coding DNA Sequence Number=SeqID_88604
  Gene Ontology: Cellular component=integral to membrane
  Homolog annotation: Hit_ID=A9C2L6; Match level="QueryCoverage=92%, HitCoverage=89%, E-value=1e-26, Identity=34%"; Hit description =Putative uncharacterized protein
  Pfam annotation: Domain name=DUF81; Domain location=3-260; Score =29.4; E_value=2.7e-07; Accession=PF01925.10; Description=Domain of unknown function DUF81
MIFGLFVCGLLSGVTTWLFGFGGGFVTVPLLYLLLSHQGAVGGQAMQIAVATSALVMLCTSLLASGRHLRAGTVHWRSLLPILGGIAIGGIAGAALALKVNGEWIRWLFILYLAVTIVDCYARPGFMAPSTACAPSSAGRETILGGGIGLIAAFLGVGGSVMTVPLMRRRGATMAQAAAMANLLTLPLAATASLTWLLMAPMAALPSGFIGNIWWLAAGLLVAGSWLGLRGASRWLAKLPDRWHVRIYPLLLLLVLLAMGFGGVG

SEQ ID NO: 180290 - protein, 231 aa, Glycine max
  Coding DNA Sequence Number=SeqID_88605
  Homolog annotation: Hit_ID=Q6WAY6; Match level="QueryCoverage=96%, HitCoverage=38%, E-value=3e-24, Identity=33%"; Hit description =Putative uncharacterized protein
MGSSQMPSLKRRFYQVKVKSLGTTSLKELWQLMGQLQRQAIHKAYGKIWDLAMVEVSTAAIASLAQYYDQPLRCFTFGDFQLSPMVEEFEKILGCPLGGSKPYLFSGFYPSLARISKIVQISAQELDHRKQVENGVVGIPRKYLEAKARILAGKGEWAPFIDILALLIFGGVLFPNVDGLVDLAAIDAFLAYHNHKESPVVAMLADLYDTFDRRCEKSNTRIVCCTPALYV

SEQ ID NO: 180291 - protein, 26 aa, Glycine max
  Coding DNA Sequence Number=SeqID_88606
MKEKVRKEVLKLLEVGLIYLISDSAW

SEQ ID NO: 180292 - protein, 53 aa, Glycine max
  Coding DNA Sequence Number=SeqID_88607
MTIICLCVPPDMIASGWRKEFVSARFSPNLRNLNHKGRRICLCAFITRLAAPE

SEQ ID NO: 180293 - protein, 178 aa, Glycine max
  Coding DNA Sequence Number=SeqID_88608
MASRIRKSIGSRPTAQYDTRRFHSLDAWNRYTNNVLGRNILPERKVKIYHTKFDDFKTELERCNLHKRLTNLVDGSIDVALVKEFYANLYSFEGPSPKQAKVRGHLVKINTNSLNTFLETPVVLAKGETLPTYSIYNRQPSDPREIEAALCIPGRGFILNVAAHPGRIMRKDLTTLAQ

SEQ ID NO: 180294 - protein, 268 aa, Glycine max
  Coding DNA Sequence Number=SeqID_88609
MAPRKLASKRSRKDKAAEGTSSAPEYDSHRFRSTVHQQRFEAIKGWSFLWERRVQLRDDEYTDFQEEIGRRRWASLVTPMAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPSDHNSDLPLPKCMAPTRHPLDPDKSNRALGFPALITGLCQSFGVPVAPTKVIRPPITRAFIEKYCTQRQA

SEQ ID NO: 180295 - protein, 248 aa, Glycine max
  Coding DNA Sequence Number=SeqID_88610
MTQELVTCGDTLRLSAPRHSVTPSVIDEQRPMWSSTPFPEMSASSGGDFFKSHKIRRSKSLAFVGHPTRSVILTLRSSDMRRQNLVIPHPFAIQTQSCPMARKDKIWSFCTLCHPEAAGPMARGDKIWSIRTPLPFRHSRVRWHAETKFGHSAPFVIQRRRARWHAETKFGHSAPFAIQTQSCPMARRDKIWSFCTLCHPEAAGPMTRGDKIWSFRTPLPFRHSRVRWHAETKFGHSAPFVIQRRQAR

SEQ ID NO: 180296 - protein, 279 aa, Glycine max
  Coding DNA Sequence Number=SeqID_88611
  Gene Ontology: Mol. function=2-succinyl-6-hydroxy-2,4-cyclohexadiene -1-carboxylate synthase activity; Cellular component=chloroplast; Biological process=menaquinone biosynthetic process
  Homolog annotation: Hit_ID=A4WCP9; Match level="QueryCoverage=53%, HitCoverage=26%, E-value=1e-74, Identity=93%"; Hit description=2 -succinyl-6-hydroxy-2, 4-cyclohexadiene-1-carboxylate synthase
  Pfam annotation: Domain name=TPP_enzyme_N; Domain location=139-278; Score=-72.9; E_value=0.0034; Accession=PF02776.9; Description =Thiamine pyrophosphate enzyme, N-term
  Subcellular localization annotation: CTP_CleavageSite=75; ConfidenceScore=5.70e-01
MTNCVCMCSSRQPPLPGFRDSPRVRLSTTLSLSTANGTPVRPGIYRPIKASSVWRCARRASRMTPCGSTPGRASSADLTRSRSGRRSKTKPLACALCSLGINTDSRNPDSYQNSNFFYYLYCVAFLIPDNLMSVSSFNRRWAAVILEALTRHGVRHVCIAPGSRSTPLTLAAAENRALIHHTHFDERGLGHLALGLAKVSKEPVAVIVTSGTAVANLYPALIEAGLTGEKLILLTADRPPELIDCGANQAIRQPGLFSSHPSQTVSLPRPTHDIPASWL

SEQ ID NO: 180297 - protein, 60 aa, Glycine max
  Coding DNA Sequence Number=SeqID_88612
MLNEGSVGKLFYKNEKDNVQLLMCISQCSPTINHNNNPVTSFQSTPPSHGTLSIDDFERC

SEQ ID NO: 180298 - protein, 91 aa, Glycine max
  Coding DNA Sequence Number=SeqID_88613
  Subcellular localization annotation: CTP_CleavageSite=41; ConfidenceScore=5.50e-01
MAEPSKKRKGSSSTAAAAAHRRHGPSETSTTPIHPSLSSPRSSTLFSFDDQRLRYLSQFSSRIILDPKYLDVEFFNDETFDCYQVFQNSGL

SEQ ID NO: 180299 - protein, 225 aa, Glycine max
  Coding DNA Sequence Number=SeqID_88614
MDMNLGYLICHQISLTAQHDTSRLGFPALITTLCKARGVQSESRSLENLSPAINLAYINKNYWNLDDPTVAFRGPRKAKDKRSEVPTTLVPPETITPSSSTAPVPPIQAPAIPLASTQIPLLDSLSTGPSDFVFTPQMLHSMLQSLHRGQSIIIQSLQAQPSPSGGGGASVAQEPEPEEPAAAAEETSRDQIPEPSPVPIPDDVIPFALASELEQPIPQDSQATQ

SEQ ID NO: 180300 - protein, 132 aa, Glycine max
  Coding DNA Sequence Number=SeqID_88615
MRAHPEREAIMHLLCIPGQDFPRAAAKRRVRIICTNMTTLTWMTLLFSKILPSDHNANLPLQMYQLGSCPQDTKWTQRSPTGPWGFQLWLWASVSPTGCPFPQRGIAPTKTPSGPGEVQQGPGVSSSGYKPL

SEQ ID NO: 180301 - protein, 171 aa, Glycine max
  Coding DNA Sequence Number=SeqID_88616
MLLVQSNPSLAVKERVAAVRRRAAAISGGFLRRDQGLDRLEKCDPTLQLSPPSTVARASTRRFFFSRLPTRATHAPRAGVGSCHFRSWQLHRHFQGLFQASPPASGKPFGQLLSVFLSCVLGFVVWLLNGLFWTYFFVFRDFNYHHCKAELEKLSFVVCFRGVVVPWSRTP

SEQ ID NO: 180302 - protein, 143 aa, Glycine max
  Coding DNA Sequence Number=SeqID_88617
MKADMEAMKEQMTTMMEAMMSMRKMMEVNTVTVIAASTATEVDPTHPSGLNQVNRPVLNMVGQGGRALGSMDGPHFVQVQSKHSFPPYMACLPTMHHRKLHTLPMRMSITLLPYSLRVNNPNLVMHESLNPWGRHMKYPENPL

SEQ ID NO: 180303 - protein, 96 aa, Glycine max
  Coding DNA Sequence Number=SeqID_88618
MVGYMPSSFVDLVFVGKRIEAGLRKGTFSYVASVNPGNEGPERSGERKKEGESHVVVVVPAWPNFSLAPYNPMYQYPPQQYHYSANISPTHYPPPY

SEQ ID NO: 180304 - protein, 291 aa, Glycine max
  Coding DNA Sequence Number=SeqID_88619
MRSWVRGQWIPFDADAISQFLGYPLVLEEGQECEYGQRRNRSDGFDEEAIAQLLCIPGQDFARTVAGRRVRIMRTNMTTLTQIWMMLLLSNILPSDHNFDLPLPKCQLVYAILTRMSIHVAQLIADAIYLFAGMAPTRHPMDPDKSNRALGFPALITGLCQSFGVPVRQAQGDAPQAAGAPPPPHQAGPAGSFDMEQYLRHLVCQQAANHQAHVQTHDCLYQLSLSMQSQGFASFSCPTPDQFRAEVAWPGDWPEAQAGEAPPEAPGDGEEAHEDEEMADLLDFLGGSGAT

SEQ ID NO: 180305 - protein, 377 aa, Glycine max
  Coding DNA Sequence Number=SeqID_88620
  Homolog annotation: Hit_ID=Q6WAY6; Match level="QueryCoverage=11%, HitCoverage=8%, E-value=2e-09, Identity=60%"; Hit description =Putative uncharacterized protein
IPQEGKEGVLFSCGDYPNVPLIGTRGCINYNPALAIRQLGYPMRGVPTEESLSPFLVRDLDKELRGIRNGVIDSYDGWLRVHTRGLDWLSKLKVINEENFEAPEEDEEVQALKLELGKARLAKEKFKSAATHIRKKCTELQEENVATARALEQETKRARKEEYGREKFRGALWGSNSELKLRREERDRSRVHGMILKEELAVCARSKRSLAQHLEATEQSMLAIIGQYKEELNQSVAHEQKLVEDFAQVYAEKEARGRVIDALHQEATMWMDRFALTLNGSQDLPRLLAKAKAMAEEQMKADLSTLKDQMASISEVMLKLQKTIEDKATTTGSSTVREAEPVLQPALNPGRDRNTAVCGRRYSPQAYPYGLPPDFTP

SEQ ID NO: 180306 - protein, 80 aa, Glycine max
  Coding DNA Sequence Number=SeqID_88621
MYKDNWTQPWAMGSEIYPKVHENPRAFFSSSSSIFLEPLAHGSSDWSLPREDCITIELGPHIPTIVDVSTSTTTQKPRDQ

SEQ ID NO: 180307 - protein, 155 aa, Glycine max
  Coding DNA Sequence Number=SeqID_88622
MAVIIPGKIYQHPFPKWYDPDATCAYHGKTLGHSTEKCLALKYKAAQSKPLKDVATPRRFIYEALQKGGVIPHGAHEEDSYLLHPGELHYMETCSAMEDLLQQMIDQGRLEVGDEGREEQHICMQSIDERSFGRPKPLVIYFTKDAAPQKPRYPS

SEQ ID NO: 180308 - protein, 70 aa, Glycine max
  Coding DNA Sequence Number=SeqID_88623
MVYGGGGANSDSGADDNVGGGRAIWPTWALQKAVASGGSNPARLGELGGKLLPYFAINRGRSEEENGSAP

SEQ ID NO: 180309 - protein, 222 aa, Glycine max
  Coding DNA Sequence Number=SeqID_88624
METCPAVEELLQRLMDWGQLEVSKGDREEPQICMQSEEKKVPPTPNALVICFTRNVTGSRPMYPPAPPKPTPFSYQSNKVVPWKYTPPAFRERVATEVDSLSAKVTNITGLSGVTRSGRVFAPLYSAELPSKGKAPMIQEPADVATPSKEVDPPVVKGTEKKEGLQGKTVTLEEAHEFLRLIQQSEFKDLFRTAHKLRASSCTIGKGPQRSPRSTRHLSRGF

SEQ ID NO: 180310 - protein, 109 aa, Glycine max
  Coding DNA Sequence Number=SeqID_88625
  Subcellular localization annotation: CTP_CleavageSite=34; ConfidenceScore=5.16e-01
MYINKVFKTLNLGDKIRKYSKSSGKSRTFFPQTECAMETSPLLLLPFEFESMPPPPISRSAGATLIVANWSMVAELPQQMLEVSTFVTPVAHDNSSVLLATPTNRRTYH

SEQ ID NO: 180311 - protein, 213 aa, Glycine max
  Coding DNA Sequence Number=SeqID_88626
MTLTIPELFLRPYQVRWDATVFRVFNPDFPFYIKREDLSEIAHGGQCLSISVLHLWILHLTETCMRVGNSDIYGFLEPQSIQRSGQSQFESKSYIKSWMQSSQRNVYLGAYLNGFHCSGHRQMVVILPKEHLVVWFCSLHNRPDNYLKGIINSLNQRLLLGGLSSRQKGSTECGYYVMHRMSTIILGTFRNNWEAYFNDPRPLEPERLKALRI

SEQ ID NO: 180312 - protein, 222 aa, Glycine max
  Coding DNA Sequence Number=SeqID_88627
  Subcellular localization annotation: CTP_CleavageSite=87; ConfidenceScore=5.63e-01
MSDKKGSTSNHGLNLNIPPPRVANQIPDSPTRLPIAPPTSPTSSCVSSELSLDDNSSSSSNNNNNRGCTRSPEDISMVLVGCSRCLMYMMVNEGEPNGGVNIDDNCGFGEDGSRCIGGDCGSSVSAYGYGGGGSGADGGGGNSDSGADDNGFACSLLPPLSPEKGNINAGLFLFAYEEDSNELAMKVEVFEVARSTVVAWGGGEEGKYVAVTRLDDVTLCLP

SEQ ID NO: 180313 - protein, 88 aa, Glycine max
  Coding DNA Sequence Number=SeqID_88628
MTRGNPGDLQPFDPEIDRTFHRLVRHSVHPDHSVHFEHCEHFEHFEYSVAGDSEYSDFEHSTTNSYTENMAQPPPYERTDVSSFSHIS

SEQ ID NO: 180314 - protein, 169 aa, Glycine max
  Coding DNA Sequence Number=SeqID_88629
MLPIAPVVVANIFMGCRDLLTLRILHGETFSFFNNLSSECDEESQMVKCQVAIIGMIKYEFVFSNFINCMYAIPVSFRRRDDIHSIAPGIPAMRREFCFLAVEDTSTWVVVNENKRGYISCGSVQVEGTSTWLFKENKGGYIPCGSLLVKAFTRLKRNLKDRRSLRDWM

SEQ ID NO: 180315 - protein, 265 aa, Glycine max
  Coding DNA Sequence Number=SeqID_88630
  Homolog annotation: Hit_ID=A5C279; Match level="QueryCoverage=75%, HitCoverage=80%, E-value=1e-41, Identity=47%"; Hit description =Putative uncharacterized protein
  Pfam annotation: Domain name=DUF623; Domain location=142-201; Score =92.1; E_value=1.8e-24; Accession=PF04844.4; Description=Protein of unknown function, DUF623
  Subcellular localization annotation: CTP_CleavageSite=63; ConfidenceScore=5.63e-01
MKFFNLLKSRHVRSSSSSSSRAWPSCHQPKTLSFRVTTTKINNEEDNNNNNNVVNDVVLKDINSALVSQTPESFFTESPDSASFSTTSELSRGMDPIEAVIRGLRSDRLFFDPDEASCILEAKPTTTSLEPFKNSVVLTMDSEDPHVDFRKSMEEMVETLGVEDWESLEDLLCWYLQANTKSNHEYIIGAFVDLLFDLAVPNSPCSQDDDENLHSHSHSRPSSPLSFYNSSSSPSSSCSTPYCIKGEVEEEEITPEDEAASSSNN

SEQ ID NO: 180316 - protein, 311 aa, Glycine max
  Coding DNA Sequence Number=SeqID_88631
  Homolog annotation: Hit_ID=Q2HTA0; Match level="QueryCoverage=25%, HitCoverage=11%, E-value=6e-12, Identity=50%"; Hit description=IMP dehydrogenase/GMP reductase, related
  Pfam annotation: Domain name=DUF1723; Domain location=199-248; Score =54.2; E_value=4.6e-13; Accession=PF08330.1; Description=Protein of unknown function (DUF1723)
MEVKIKTASENDFQTLPPTMHFEIQKISNLMLCVRMLQAQWHCSFSVQCGCVFFIILDSLSAPLAAFIDIEDVSATLAVKIMVRTRDLGRTLGRVIGRVLGERIIVIQMMFPIDKGPQHPHVGNRKLPLLLRMLLTWMTQLKRYSNMLEKLLMMPREHLDLKISSDGRKVQKFRRLTTKIEGLVATTGLSPLIECSLDTGDRGLISAFVKRWHKEMASFHLPVGEVTITLDDVASLLHLPIIGAFHSFEILHVDEVVLMLVELLEFSGDEARAKTVALLLLIRVQHMCMWCSWTPSETSVRVEATHGKLPP

SEQ ID NO: 180317 - protein, 407 aa, Glycine max
  Coding DNA Sequence Number=SeqID_88632
  Homolog annotation: Hit_ID=A5BSR3; Match level="QueryCoverage=29%, HitCoverage=49%, E-value=7e-07, Identity=29%"; Hit description =Putative uncharacterized protein
  Pfam annotation: Domain name=Transposase_23; Domain location=185-255; Score=16.6; E_value=1.8e-05; Accession=PF03017.5; Description =TNP1ENSPM transposase
DVRIKAQAIQKQNTAPHVLSRGGYDYLEQKLLAEKTKKKLHETAQSGSVDGVIDPPSPVRRHVKWKMARTKKTREMTTEAAKEITEKIATQGSFVPHGRQDVLAAAIGRPEHPGRVCAAGAGIRDQLEESITEKVTRQVMASFSQLQSQMQSQGPPKPLVGPGPSGPRVSTKGNCVDPSGNDPETGDSDRCGFYIEADPARLVAVGRVYEGSTLVHNTPLLPGQVKVSVDEVKDADAPVPVPTDEVSLVGQALHTFLAWPTHLVKSLSHQVAVSLPKPPPKPDPEVDDPLYLMTLTIPELFLRPYQVIWDATVFGVVNPDFPLYIKHEDLSEIAHGGQCLSISVLQLWILHWQMVVILPKVHLVVWFCSLHNRPDNYLKGIINSAIKGLDDAPQPKSKAPARWIVVK

SEQ ID NO: 180318 - protein, 21 aa, Glycine max
  Coding DNA Sequence Number=SeqID_88633
MALKLMPTTTMIMVGEYLSTM

SEQ ID NO: 180319 - protein, 182 aa, Glycine max
  Coding DNA Sequence Number=SeqID_88634
MAPTRHPLDPDKSNRALGFPALITGLCQSFGVPVTPNKVIRPPITRAFIEKYCTQRQVQGDAPQAADAPPPHQAGPAGSFDTEQYLRHLVRQQATNHRAHVHTHYCLYQMSLSLQSQGFTSFPCPTPDQFRAEVAWPGDWPEVQAGEVPAGAPAEAPDEADEACEDEEMTDLLDFLGGSGAT

SEQ ID NO: 180320 - protein, 87 aa, Glycine max
  Coding DNA Sequence Number=SeqID_88635
  Homolog annotation: Hit_ID=UPI0000ECBAF8; Match level="QueryCoverage =47%, HitCoverage=48%, E-value=1e-16, Identity=100%"; Hit description= UPI0000ECBAF8 related cluster
MALEMLLLLCSLACDSNMALFGKRILCSLGVTAQGMQAWHWPSFYNVVTGKTLALPNLIALQHIPLSPAGVIAKRPAPIALPNSSAG

SEQ ID NO: 180321 - protein, 143 aa, Glycine max
  Coding DNA Sequence Number=SeqID_88636
MAAQLIHDHVVMECLEGVWETLKGNERCRFRGTVRLTASSLVHLEQPARTLQQPVEWILPMPTPYRLVEPVQLIEVSSSEEDLEEDPEELPPEPAMDAPDLPEDGEDPLPDVDSPEDIMSASEADSTEESGPGGTANSDDSSS

SEQ ID NO: 180322 - protein, 85 aa, Glycine max
  Coding DNA Sequence Number=SeqID_88637
SSSSSSKSLRSELRAFLIYAVELASGPAPDHPEFTGCGPAAEDVAVPEPSPQPEPKPSTPVFDLPLSQDPSSTPALDLNEHAQDH

SEQ ID NO: 180323 - protein, 123 aa, Glycine max
  Coding DNA Sequence Number=SeqID_88638
MYIVVVKQGQDHLGLPSGVETKHERQKPIKVLKDERGRGWGHDRPIVALLCAKQAENVAARQPPLGPSFFAFLIPFCAFVHHQQAYNAFLNNGTCHIVPVLLLLTPKRAPTKCSVKCLNGISA

SEQ ID NO: 180324 - protein, 53 aa, Glycine max
  Coding DNA Sequence Number=SeqID_88639
LSLAHQWAKRASIAKCSFSALSVIEESGRASISRLHAKREISALSATIFFSQA

SEQ ID NO: 180325 - protein, 95 aa, Glycine max
  Coding DNA Sequence Number=SeqID_88640
  Subcellular localization annotation: CTP_CleavageSite=36; ConfidenceScore=5.04e-01
VDSRGSPLRVITHGKCYGNITESPRVGFSSRKQFSSANLREYEVPRRQNPFLFTPPPIYSKIGEELATQLAQASKVASSRSNRLLEEESGRPKWA

SEQ ID NO: 180326 - protein, 80 aa, Glycine max
  Coding DNA Sequence Number=SeqID_88641
MGPNFNWEIDVSPYIPMATIESPHYLGARPHVRRVKRQLIQCSFGYDVEGRAAVDEHFGHYVVQAFDGHVQGFVVSPAFD

SEQ ID NO: 180327 - protein, 81 aa, Glycine max
  Coding DNA Sequence Number=SeqID_88642
MEQPPPRERTLREMVAPDFTYESLCIQYPDEDVPYVLKTGLIHLLPKFHGLAVMEAPNFSYTWWSGPLRNDLYSLRVHGNP

SEQ ID NO: 180328 - protein, 56 aa, Glycine max
  Coding DNA Sequence Number=SeqID_88643
MKVHYYQASRRPSMTTDSPPLLMLPWTQSPMESPTVATYPSVGGQHGAHGSPPTFI

SEQ ID NO: 180329 - protein, 106 aa, Glycine max
  Coding DNA Sequence Number=SeqID_88644
MMITKDDDKGDDKKLKDQSKNNSSESKINQEEFKTQEESLETRIKIQGYILCGTSRGYIYLGLTENKRGYISCGLVIVEGTSTRFKENKGGYIPCGSLLVKGFLQG

SEQ ID NO: 180330 - protein, 50 aa, Glycine max
  Coding DNA Sequence Number=SeqID_88645
MAMTNLEIKRAITLMQSYSPRALDRRLQEDWARDAREGPRVLMSLRGSIM

SEQ ID NO: 180331 - protein, 110 aa, Glycine max
  Coding DNA Sequence Number=SeqID_88646
MEAMKEQMAAMMEAMMSVKKIMEANAVAIAATSVVAKVNLMSPSDINQMNHPTSDMVDKDLGSTGDPHDVQIQNEHAFPPYGLPPNYTPPNVAYTPSENVNNSTPILVES

SEQ ID NO: 180332 - protein, 64 aa, Glycine max
  Coding DNA Sequence Number=SeqID_88647
MDRLFTMILGFTSKLQLRCPFEYQTAVILQAKKSEYTIPSSYPTNNFWMKFTTGSHSPIQCWSN

SEQ ID NO: 180333 - protein, 237 aa, Glycine max
  Coding DNA Sequence Number=SeqID_88648
  Homolog annotation: Hit_ID=UPI0000ECBAF8; Match level="QueryCoverage =17%, HitCoverage=48%, E-value=3e-16, Identity=100%"; Hit description= UPI0000ECBAF8 related cluster
ATLPEGRKPDRYPVSGRVGTGERTRELPGGNACLWKNASNAAFLRFLAFCWPFAHMFFPALSPDSVDNRITAFEKRKSAQYANRLSPRVGRFINAAGTTADNNFTQETAMTMITNSSSVPHAHALLPQALAAFALVHLGVDVQRGEQRVERAGRGVQHEGVVEALVVAVAALPLDVLVFFVDLRGMQAWHWPSFYNVVTGKTLALPNLIALQHIPLSPAGVIAKRPAPIALPNSCAA

SEQ ID NO: 180334 - protein, 36 aa, Glycine max
  Coding DNA Sequence Number=SeqID_88649
MKNIPDSGVIFTFEEGRQKRGPCSYVPSIEEEIIPM

SEQ ID NO: 180335 - protein, 102 aa, Glycine max
  Coding DNA Sequence Number=SeqID_88650
  Gene Ontology: Mol. function=DNA binding; Cellular component =intracellular; Biological process=regulation of transcription, DNA -dependent
  Homolog annotation: Hit_ID=A5FCU6; Match level="QueryCoverage=100%, HitCoverage=83%, E-value=4e-40, Identity=79%"; Hit description =Transcriptional regulator, HxlR family
  Pfam annotation: Domain name=DUF24; Domain location=29-102; Score =77.6; E_value=4.2e-20; Accession=PF01638.8; Description =Transcriptional regulator
  Pfam annotation: Domain name=HTH_5; Domain location=37-79; Score=6.7; E_value=0.082; Accession=PF01022.11; Description=Bacterial regulatory protein, arsR family
  Pfam module annotation: Pfam domain module=DUF24::HTH_5; Domain location=29-102::37-79
MTAIKESSTIQENKKNILDQCPVMYVMEKIGGFWKPIILFQLSTGEKRYSELKRAIPEVTEKMLIQHLKQLEADGLIIRTAKPVVPPHVTYELSEAGNKLAP

SEQ ID NO: 180336 - protein, 295 aa, Glycine max
  Coding DNA Sequence Number=SeqID_88651
  Subcellular localization annotation: CTP_CleavageSite=76; ConfidenceScore=5.33e-01
GGPLGTRPRLQRTTRPHLQRTACPYFQRTAHPHLQRTTRPHLQRAARPRLQRTRHPRRQRTRCPRLQRTIRPRLLRAMHFRLQWAPHPHLKRIYGPPTLMLNQDLRSRATNYASTTRGRDYRVATVHTGGRFHPCHCKETSADHAHQHEHSYIDDVATLQHSAQQPQCRSPPAKVSVGLCHPDIGVAPTRHPVEPNRALGFPARVTGLYQSYRVLVPPSKGLGVASFDYRPLSVLRSACRPSKVIRPPTNRAFIKKYCTPRQAQGETPQQPGDGRQRATDTPPPPLEFISAHLQK

SEQ ID NO: 180337 - protein, 186 aa, Glycine max
  Coding DNA Sequence Number=SeqID_88652
KGGANWDQLLASKEGASVNWFPRWKEGRTGVLISCGGFPNVPLMGTRGASATIPVRKAWGVVQKKDKELRGSNNGPIGGYHKWLKAHVQGLDWLPSLRTAKRKEVETPEEDEKVQALRTELKQAQIVKERFKSVALRIRKENAELRDVNVATTKALEQETKRARREKHSRNKFRGALWGSNNELKL

SEQ ID NO: 180338 - protein, 44 aa, Glycine max
  Coding DNA Sequence Number=SeqID_88653
MGVFAQFVSVATYPSVGGRRVTRGMRVPRKEYARSRHQRLFEEN

SEQ ID NO: 180339 - protein, 99 aa, Glycine max
  Coding DNA Sequence Number=SeqID_88654
MTHRGLKKKHDRMTPIEHFPIAVSDEDMTKSKGKDPLEGLGGSMTRARARKVKEALQQVLSILFEYKPKFQGEKSKGPIGNLGISLLGDQMVADLLAVG

SEQ ID NO: 180340 - protein, 125 aa, Glycine max
  Coding DNA Sequence Number=SeqID_88655
MTIIFLCVPPDSIVSGWDKGVQMTIICLRMSSGMPPEHDKRCRMTIICVCVPPDSIVSGWRKGVRITIICLRMSSGSPPLDDKRCRMTIIFLCVPPLDDNTCVMTIIWLCVPPDSIVSGWRKVHG

SEQ ID NO: 180341 - protein, 106 aa, Glycine max
  Coding DNA Sequence Number=SeqID_88656
SFGVPVTPSKVIRPPITRAFIKKYCTPRHVQGDAPQAADAPPPPHQADPTGSLGMERCRYTSVSTSSASVSRARISFLLRALLQINLGLRSHGPEIGPRPRQGRRL

SEQ ID NO: 180342 - protein, 118 aa, Glycine max
  Coding DNA Sequence Number=SeqID_88657
MLDKQVVVSPAKPTDGPDAQVKWDATMFGVFNEHFSLYIKHEDLSKIAHGGQCLNISVIQLWILHLTETRLDDTPQPKSKAAAGWIVVKCNRQKGSTECGYYVMHLMSTIILRSFRNN

SEQ ID NO: 180343 - protein, 89 aa, Glycine max
  Coding DNA Sequence Number=SeqID_88658
MASGQGKYRRWPWLYLWMIKTSARGRGYHMEETHTWGGDVLGYKCEGEGRHKRIQAVSPLFFWKREKRDTKRIQAVSPWRILFGKGRRE

SEQ ID NO: 180344 - protein, 77 aa, Glycine max
  Coding DNA Sequence Number=SeqID_88659
MYNSIITYIGLHCSAHWQMLIILPKKNVVIWFCSLHNRLDNYLKGIINSALKGLDDTQQSKSKPAAARWIVLVNEYN

SEQ ID NO: 180345 - protein, 95 aa, Glycine max
  Coding DNA Sequence Number=SeqID_88660
MDLMMKSVHFQRKGESGRASASKLRAKHEISALSAAGAFSQAQRYTPFETWHRIFRGTCVQHSIVPILGKEPLKQQRGTTSALKPRFCHLREIIE

SEQ ID NO: 180346 - protein, 111 aa, Glycine max
  Coding DNA Sequence Number=SeqID_88661
MSISPCRSISWSVLSRHWDRAPYKEPLGPGEVQQGPRVPGSNHQAPINRAFIEKYHAPRKRAIDAPPPPPESTSAHLQRLERCLQPVAGQQATKSKANGSKMPHKNIYVLR

SEQ ID NO: 180347 - protein, 125 aa, Glycine max
  Coding DNA Sequence Number=SeqID_88662
  Subcellular localization annotation: CTP_CleavageSite=58; ConfidenceScore=5.66e-01
MAPPLTSFPLSSATSPYGGKSPLKDPIEAQRSSLHRSPTSKLLSGQGVCVFVMRVSVCGQSINARRCHQLSEDPKASATDNVNGKWVMVTYDATSCNHGASHESLARNGIQATTTTYSTITFCYH

SEQ ID NO: 180348 - protein, 95 aa, Glycine max
  Coding DNA Sequence Number=SeqID_88663
MDLLQDKNTHHPVVVFSSLRIKNLLNFNVLVLFSKHGKELEQEYSRNGGMNNVIEEETRKRPRLNWGEGLAKLEKKKTEGDGVSVAIVSTPTSAA

SEQ ID NO: 180349 - protein, 182 aa, Glycine max
  Coding DNA Sequence Number=SeqID_88664
MGKFMQNNVNICSITIKLYPKFIKIRVGHRRLLETTRAFEGVTSLPKKPPVALMNPHTSAIVSSTTASPLCDVVWDKVISAQGHHIPPYVVGVGASLCAIYAYTVFAEWNADSCPKPVQWNAHEGKVCCCGSHCTSQGKHVLGMMFYLIIASPNNECLKLFIFYQPLDAFLRWSRFTQRSHS

SEQ ID NO: 180350 - protein, 193 aa, Glycine max
  Coding DNA Sequence Number=SeqID_88665
  Gene Ontology: Mol. function=methyltransferase activity; Cellular component=nucleus; Biological process=regulation of transcription
  Homolog annotation: Hit_ID=A5B4W3; Match level="QueryCoverage=69%, HitCoverage=42%, E-value=1e-29, Identity=36%"; Hit description =Putative uncharacterized protein
  Pfam annotation: Domain name=PPR; Domain location=15-49; Score=24.9; E_value=0.0003; Accession=PF01535.11; Description=PPR repeat
  Pfam annotation: Domain name=PPR; Domain location=87-121; Score=5.4; E_value=1.8; Accession=PF01535.11; Description=PPR repeat
  Pfam module annotation: Pfam domain module=PPR::PPR; Domain location =15-49::87-121
MARLLFDNIENKDVVSWSSMIRSYDKSGLLHEALDLLRDTHVMRVKPSEIRMISITHVLAELADLKLGKAMLSYVMKNGKCGKLGVPLCTSLIDMYVKCENLAYARRVFDGLSKASIICWTAMIATYMHCNNLNEDGHSNNHKSNAKNHNSTNMPSDLTSARDHGLDNKKQEVVVAVGNGSDDFYDGLGCCHV

SEQ ID NO: 180351 - protein, 496 aa, Glycine max
  Coding DNA Sequence Number=SeqID_88666
  Gene Ontology: Mol. function=DNA binding; Cellular component=nucleus
  Homolog annotation: Hit_ID=A7PI75; Match level="QueryCoverage=72%, HitCoverage=27%, E-value=2e-20, Identity=37%"; Hit description =Chromosome chr13 scaffold_17, whole genome shotgun sequence
  Pfam annotation: Domain name=Myb_DNA-binding; Domain location=126 -171; Score=30.7; E_value=5.5e-06; Accession=PF00249.22; Description =Myb-like DNA-binding domain
  Pfam annotation: Domain name=Myb_DNA-binding; Domain location=25-70; Score=24.4; E_value=0.00043; Accession=PF00249.22; Description=Myb -like DNA-binding domain
  Pfam module annotation: Pfam domain module=Myb_DNA-binding::Myb_DNA -binding; Domain location=126-171::25-70
MFSMFNSSNELVEDPLAVETEGPMINHWTLEERKIFFEKFSAFEKDFQKITSFLDHKTTVDCVEFYNKDHKTNCLEKDKKKKKKKMGCKSQNLKTSKTTVKGLGYKAACQQPVTPNITRQDIDDGDCEWTNMEKAAFLQAVSSFDEDFRMIARHVGAKSKDQCKKFFIKGQKSHRLDLMRHILENIGSLLNEINLGMSTDTNDAHIVEADSVTDNDKLGTKTIDDQPSFVVNSSRDKSKPMEARNLSTNFKELVIGNDKSGTKTNDEQSSFDMNSSHDKSKSVEAKNRSADLNESKEINREFDHQDKTIISNKYNDESKLVDTDGCGVVLYNYDKSSSVKDKKATTMSNIMEVRKDNVGDAVTELVSSASKIIEPYPSHFVVEDRLSVMLMSFPTWLDDKDGKHGGDIDDDVVELKNQSHDSNTKANTCLSSVLVSFSTLTFGVENQLKLFLKKSNYLGPSMEDPIPTANSMLQNTIGVLGMLFNKRNQLHKMACL

SEQ ID NO: 180352 - protein, 64 aa, Glycine max
  Coding DNA Sequence Number=SeqID_88667
MRSFNGDFPPWRCSGRQRRRGERRRHPLGNKPWKNELHHQVASLISFLEKTSLRSFFEKTSLRS

SEQ ID NO: 180353 - protein, 94 aa, Glycine max
  Coding DNA Sequence Number=SeqID_88668
MQCKECEIDNSYLHFTQFDNCGRARRGSRVRFPKEERCAESPPTFICGKRRKNRRKPVKMKILSSGVVFTFEEGRQKRGSYSYVPSIEEEIRPT

SEQ ID NO: 180354 - protein, 138 aa, Glycine max
  Coding DNA Sequence Number=SeqID_88669
GGGPDDMQRPIMVIRTLLLSVRLNEDSKSSGGQRQIMVIPHTFSPSRGDRVWWNAETNYGHFAPCVNQEERIRQYEDDVPGQRSYPNFVRGPSVVGMRPSFDHFEGVQIATRPTWAFQEVLQKAVASGGSNLARLGEL

SEQ ID NO: 180355 - protein, 102 aa, Glycine max
  Coding DNA Sequence Number=SeqID_88670
MEKSEKKNHNEKKLKKAYITWDENDLESSEDSENEEINLYLMAKSYESDEEGINLKNNKSFIKTFPLPHKNVILILSLVSTVEEEDMAYQLATSRKIIVTLK

SEQ ID NO: 180356 - protein, 99 aa, Glycine max
  Coding DNA Sequence Number=SeqID_88671
MGSSQAPSLKKRFYQVKVKSLGTTSLKELGQLMGQLQRQAFRKEVRHPCPLESHRSCTEKSGANWDRLLASKERASVNWFPRWKEGRTEVLVSCGGFPN

SEQ ID NO: 180357 - protein, 98 aa, Glycine max
  Coding DNA Sequence Number=SeqID_88672
  Subcellular localization annotation: CTP_CleavageSite=50; ConfidenceScore=5.05e-01
MEKPRGIPLSTDFQVYSSVTALNKWINLTSLSLILSVATYPTAGGRCETRGMRVPRKEYVRSRHQRLFEENVGKTGKDAIYELLSERLGSCIYARGRY

SEQ ID NO: 180358 - protein, 49 aa, Glycine max
  Coding DNA Sequence Number=SeqID_88673
MRNALGSGSFAHTPDIFSKIPTKQLEEAAKSGNTNTVIDPPSPIRRHVK

SEQ ID NO: 180359 - protein, 242 aa, Glycine max
  Coding DNA Sequence Number=SeqID_88674
  Homolog annotation: Hit_ID=UPI00016621D1; Match level="QueryCoverage =63%, HitCoverage=42%, E-value=4e-09, Identity=30%"; Hit description =UPI00016621D1 related cluster
GMIPLETIKRDMTTLGIITKSLLVPPSSYPWPPMVESIDEEDPRPTSSNGACINMSLPSEDNTSSPSEDYMSSSLEGYMPLPSEYYTGLHALAFRGLHVLAFEEDYMSTPSEGYMSFRGLHVLALRGLHPLAFRGLHALAFRGLLVLTFRGLPVLTFRGLHAFSFRGLHVLAFKGLHVLAFKGLHVFAFKRLHALAFKGGLDALAFRGLNTLAFRGLHVLAFTGLHVLTFRGLHICAFRGLK

SEQ ID NO: 180360 - protein, 136 aa, Glycine max
  Coding DNA Sequence Number=SeqID_88675
MGETQEIPYHNLADFKPCLGYATEGKAVGGIPLQNTLEGPQYHPQAHLLHSTTSKNPYAMAELGKLDHLEEMLRAIEGGEDYTFANLEELFLVPNIITPPKFKVPDFDKYKEATCPKNHLKIIVRRWGHTQKMRNC

SEQ ID NO: 180361 - protein, 155 aa, Glycine max
  Coding DNA Sequence Number=SeqID_88676
  Homolog annotation: Hit_ID=UPI00006A2939; Match level="QueryCoverage =94%, HitCoverage=74%, E-value=4e-09, Identity=30%"; Hit description =UPI00006A2939 related cluster
MNIVQLSILASPLEDYTPSPWVLVTLTFRGLHVLTFRGLHALAIRGLHVLTFVGLHALTFRGLHVLTNRGLHALTFRGLHVFALRGLHVLTIRGLHALTSRGLHVLALRGLHALAVVLVTLTFKGLHVLTIRGLHALTSRGLHVLALRGLHALAL

SEQ ID NO: 180362 - protein, 28 aa, Glycine max
  Coding DNA Sequence Number=SeqID_88677
MTAGDPPQQKTSQGNEKKKEDENITQGS

SEQ ID NO: 180363 - protein, 121 aa, Glycine max
  Coding DNA Sequence Number=SeqID_88678
MTSRLMGCSQVGQLLADLVVPYKEYRRNPQEERAIRVVFETKGSHILKSAMNKIRNGQDKGKWITANVRAALDEHWGSRNFLNKSSTAKTNQFVDRGASSYCGGSISTAAHFEKLIISLYM

SEQ ID NO: 180364 - protein, 91 aa, Glycine max
  Coding DNA Sequence Number=SeqID_88679
LQGREHVAHVRQDLLARMGQFELRRIAVDQQHAQGRLQRAQGVAGGRGRHADLGAGTGDAVGAGQGQQQFQLAQGGDVGPEGRNHIESKFN

SEQ ID NO: 180365 - protein, 120 aa, Glycine max
  Coding DNA Sequence Number=SeqID_88680
  Pfam annotation: Domain name=Transposase_23; Domain location=47-117; Score=3.7; E_value=0.00047; Accession=PF03017.5; Description =TNP1ENSPM transposase
  Subcellular localization annotation: CTP_CleavageSite=30; ConfidenceScore=5.14e-01
MASFSQMQSQMQSQGLALPPEPLVGPSNPRVSTKGSCVDPSINDPEMGDSDRCGLYIEVDPARLVALGRVYEGSTVVHNTPLLPGQVKVSVEEVTDVDSPVPVPTDEVSLVGQALHTFLA

SEQ ID NO: 180366 - protein, 150 aa, Glycine max
  Coding DNA Sequence Number=SeqID_88681
QGVPFEHTLVDDWKHVYSSHDAHKMVCNDHADMTDRLLAGQIDQANLVRYRMHKVLRANAPLPYPHLVTLFLQHFNVHLEDEPFIKVKRSFAIGVGAVTSFEYRKDMDGQWVRKQDLPPPIPDERTPSPPPQRDTSSSLLNDVLTELRDL

SEQ ID NO: 180367 - protein, 306 aa, Glycine max
  Coding DNA Sequence Number=SeqID_88682
  Gene Ontology: Mol. function=helicase activity; Biological process =viral genome replication
  Homolog annotation: Hit_ID=Q9LX60; Match level="QueryCoverage=99%, HitCoverage=18%, E-value=9e-93, Identity=51%"; Hit description =Putative uncharacterized protein F4M19_60
MEQLYFDGMTICAHVGFPDLFLTLTCNLAWPEIQRQVAKSNLIAHDCPNVVSRVFKMKLNQLMHDLKSGHVFGPILALAKRGLPHAHILIFLHPSNKYPNPEDIDNIISVEIPSKDRDPELYQIVSNHMMHGPCGLANKRAPCMANGKCFRFFPKKFQPATIVDQDGFPVYRRRDTRRIVQKQGVHLDNRFVVPYSPHLLLKYRTHLNVEWCNQSTSIKYLFKYINKGSDRITTAIVNDQNQDGTQNQVHDEIKHYLDCRYVSAPEACWKIFAFPMHGRAPAVERLYFHLENQQPVYWKDSQEIGT

SEQ ID NO: 180368 - protein, 114 aa, Glycine max
  Coding DNA Sequence Number=SeqID_88683
MTLLLSNILPSDRNTDLPLRKYQLVWIAPTKTPSGLKKSNRALGDPARKTPSGPEEGQQGLGVASSKYGSLSVIGSVCRPQQGHQAPPTNRAFIKKYCVSRQAHGETPHQHWDG

SEQ ID NO: 180369 - protein, 100 aa, Glycine max
  Coding DNA Sequence Number=SeqID_88684
  Subcellular localization annotation: CTP_CleavageSite=52; ConfidenceScore=5.52e-01
MDIKLMLAPKSMKAFLTDSFPMVQGIVTLPGSLNFLGSVATYPSAGGRRVTRGMRVPRKEYARSRHQRLFEENVGKTGKDAIYELLSERLGSCIYARGRY

SEQ ID NO: 180370 - protein, 68 aa, Glycine max
  Coding DNA Sequence Number=SeqID_88685
  Homolog annotation: Hit_ID=A5BEV8; Match level="QueryCoverage=94%, HitCoverage=8%, E-value=1e-08, Identity=42%"; Hit description =Putative uncharacterized protein
MVTMDKWMNITDIRYVIASRYDVIVISLSRQQSMTFFPLRSQPPPDSSVHRVICIDHVYGNYFVQVLL

SEQ ID NO: 180371 - protein, 89 aa, Glycine max
  Coding DNA Sequence Number=SeqID_88686
  Subcellular localization annotation: CTP_CleavageSite=46; ConfidenceScore=5.35e-01
MASIIVAIFSFKASVSAFICSCTSYTSPITLALAQIFNMVHDIFVKVKLEVTGTSTVLNVFGSRRSSDVTRSIFCPNFARWLLPYFNLT

SEQ ID NO: 180372 - protein, 258 aa, Glycine max
  Coding DNA Sequence Number=SeqID_88687
  Gene Ontology: Mol. function=motor activity; Cellular component=cell projection
  Homolog annotation: Hit_ID=UPI00016621D1; Match level="QueryCoverage =83%, HitCoverage=41%, E-value=1e-15, Identity=32%"; Hit description =UPI00016621D1 related cluster
  Subcellular localization annotation: CTP_CleavageSite=50; ConfidenceScore=5.43e-01
TTRPRLQRTTHPHIQRTTHPRLQRAARPSFQRATRPHLQRVARLTFRGLHALAFRGLHALAFRRLHVLAFRGLHVPTFRGQHALAFRGLHVLVFRGLHVLTLRGLHALSFRELQVHTYKGLHALAFIGLHVLAGRGLHVLAFRGMHTLAFIGLHVLPFREQHVLAFRGLHVPTFRGQHALAFRGLHVPVLRGLHVLTLRGLHALSFRGLHVLTFRGLHVLAFKGLHVLTYKGLHAHVFRGQHALAFRGLHVLTFRGLH

SEQ ID NO: 180373 - protein, 172 aa, Glycine max
  Coding DNA Sequence Number=SeqID_88688
MAKTRGKSVNRTERVGPTAFACRRVREADVADDHEEHDEHQQMEQQDESQPTDDFVVDGGSEDTSVLTSYADHVARSLSLGLTPLSLNLCCLKPRALPQTPLSLKPRCPSNLEVSLKPRCPSNPSLPQTLRSPSNLAVPRQRPFRALELAPVVTCLPSRGSVSTVRLRSSYR

SEQ ID NO: 180374 - protein, 163 aa, Glycine max
  Coding DNA Sequence Number=SeqID_88689
METCPAVEELLQRLMDWGQLEVSEGDREESQICMQSEERKVPPTPKALVICFTRNVTSSRSKYPPTAPKPTPFSYQSNKAVPWKYTPPAFGERAATEVDSLSAKVTNITGLSGVTRSGRVFAPPYSVELPSKGKAPMIQEPADVATPSKEVDPPVVKHLPSCF

SEQ ID NO: 180375 - protein, 188 aa, Glycine max
  Coding DNA Sequence Number=SeqID_88690
MMQSYPPRVLDRRLQEDWAKDAGGGPRVLMSLRVCRAPYKLKAPYPIKQQLKRKPTLKSYGSHSYPKKDQGQGILGVAPSKPKDVKRDEEEILEKQKEKRIIRPCLQRPRGRKKRKRISPRRLLRRKIILQQKVISKEHSFLNNPSTFSYQGKPPLAQPYLLSLRYYKVPNPYDRWYDECVEWCDPLL

SEQ ID NO: 180376 - protein, 151 aa, Glycine max
  Coding DNA Sequence Number=SeqID_88691
  Gene Ontology: Mol. function=nucleic acid binding; Cellular component= nucleus; Biological process=thiamin biosynthetic process
  Homolog annotation: Hit_ID=A2Q4F5; Match level="QueryCoverage=86%, HitCoverage=20%, E-value=1e-53, Identity=80%"; Hit description =Tetratricopeptide-like helical
  Pfam annotation: Domain name=PPR; Domain location=108-142; Score=4.2; E_value=2.5; Accession=PF01535.11; Description=PPR repeat
  Pfam annotation: Domain name=PPR; Domain location=42-76; Score=11.9; E_value=0.3; Accession=PF01535.11; Description=PPR repeat
  Pfam module annotation: Pfam domain module=PPR::PPR; Domain location =108-142::42-76
MEMTKSLEHKNLSSDLDERICHAGLLEEGWKVFESIKVLDVDHYACMIDMLGRVGKLEEAVKLIQSMSMEPHTGIYGPLLNATNIHKRVELGELAAAKLFKVEPHNFGNYMLLSNIYALAGRRKDVGKVRDKMRKQGVKKTIAMSWVKHNS

SEQ ID NO: 180377 - protein, 54 aa, Glycine max
  Coding DNA Sequence Number=SeqID_88692
MVNGDAVEDKGEEKKELCHQECALDKKLGDDASMEEKKERGGSTKLKEEKGEKS

SEQ ID NO: 180378 - protein, 198 aa, Glycine max
  Coding DNA Sequence Number=SeqID_88693
MVSRFVMHNGKSTCPLEDFCMVPDKSKINWEELLASMTGSTIRWFPRWEEVPNGYVNYNPMLGIRQLGYPIRGPPSNGAIQPFIVQGMNEEHLGLHQQIRKVWDSPNRRVFVAAQQLSLVLLRTLESNQFPLLNDRNKACIYVIKDLTITHKLISSSQNGFRFELSSLQILTQQNLSELFGTWTFLSLELPKQAKASS

SEQ ID NO: 180379 - protein, 69 aa, Glycine max
  Coding DNA Sequence Number=SeqID_88694
MGPKSTLRLIRTIGHSPASLAQSSWSLLGRIASIPLPLIFKKQRTPLIKKIQGLQALHGATSPMNVPFL

SEQ ID NO: 180380 - protein, 107 aa, Glycine max
  Coding DNA Sequence Number=SeqID_88695
MSYRMSRHHASEHADYMCPYEQIKQTQEINSTHIGPTLDVRVPSRWLTKDSSPKNSQTNSSIPDLVQNSCSLHDYIAVYDSGLQLLDAGGDLSSSEKSAVKELKDNF

SEQ ID NO: 180381 - protein, 115 aa, Glycine max
  Coding DNA Sequence Number=SeqID_88696
  Homolog annotation: Hit_ID=A5BP71; Match level="QueryCoverage=65%, HitCoverage=19%, E-value=5e-10, Identity=43%"; Hit description =Putative uncharacterized protein
  Pfam annotation: Domain name=zf-CCHC; Domain location=88-105; Score =18.5; E_value=0.0024; Accession=PF00098.14; Description=Zinc knuckle
MVIIVNAEACGYVSMNYYQYIDVVYTNEHILKAYSAQWWPLGNEAAIPPSDDEWTLIPDPATICAKGRPKSTRIRNEMDWVEPSEHRSKCSRCGAEGHNRRRCPMQSERGSCSTR

SEQ ID NO: 180382 - protein, 211 aa, Glycine max
  Coding DNA Sequence Number=SeqID_88697
MSSPSEDWTSSPSKGYTLSSSEDYTTSPSEDYTSSPSEDFTGLHVLTLRGPHVLAIRGPHVLAIRGLHALAFRGLHVLAFRGMDVLIFRGLHALTFSGPHVLPFRGLDVLTLRGLHALIFRGLHLLPYRGLHVLAFRGMDVLIFRGLHRTTRPHLQKPTRPRLQRTTRPPLQRTTRPRLHRNGRPDLKRATRPQLQRTIRPPFQKATRHRL

SEQ ID NO: 180383 - protein, 59 aa, Glycine max
  Coding DNA Sequence Number=SeqID_88698
MAAVIRHYLPLNPYTKRNTLIRAESSKSSSKIRWRKSLNPPFHSFSEGVFALPLKNPRE

SEQ ID NO: 180384 - protein, 55 aa, Glycine max
  Coding DNA Sequence Number=SeqID_88699
MIRVFKSISDSSSDSEVMSAHVFFGSLVDDPSVFGFWVDDPAWVGDPDDDAQNNC

SEQ ID NO: 180385 - protein, 113 aa, Glycine max
  Coding DNA Sequence Number=SeqID_88700
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPEQSTAGEGTDCKLDQHQSAV

SEQ ID NO: 180386 - protein, 106 aa, Glycine max
  Coding DNA Sequence Number=SeqID_88701
  Homolog annotation: Hit_ID=A5BKB8; Match level="QueryCoverage=99%, HitCoverage=43%, E-value=2e-41, Identity=63%"; Hit description =Putative uncharacterized protein
MTLGNGYLGSCIDEERSEMRYLSGEASSVADRAQVPWKGAPERVRAPSCPDPVAPRGAVGESGCLGMQPQSGGKFRPRLNTGERPIANKYREGKMKRTLKRESKSA

SEQ ID NO: 180387 - protein, 208 aa, Glycine max
  Coding DNA Sequence Number=SeqID_88702
MELAWDGAKFGLPNASNGDKCLNIFVLKLWMMFMNDWSTSIGFSPVYGFLEPQSIRCIKDTREECQKYIETWVKESHREIYLGPYFNQAHWQLLVLCPRENIIVWLCSIRRKPDVHIKFAVNKKYAVISKARTMHLHLHLNGLRLSHVQQGGYECGYYVMHWMWCIVSAGLKNELHNYFSDGTALDTDTMTTIHKKWAAYVLEVGKWM

SEQ ID NO: 180388 - protein, 62 aa, Glycine max
  Coding DNA Sequence Number=SeqID_88703
MVFFLSYTKAKAKNAQVRNALGNGSFAHTPDIFSKIPTLKTKFLKDPTVNEGWVVFLPRQLM

SEQ ID NO: 180389 - protein, 260 aa, Glycine max
  Coding DNA Sequence Number=SeqID_88704
  Gene Ontology: Mol. function=protein binding; Cellular component=cell surface; Biological process=protein amino acid phosphorylation
  Homolog annotation: Hit_ID=Q63FD2; Match level="QueryCoverage=69%, HitCoverage=40%, E-value=2e-12, Identity=34%"; Hit description =Collagen-binding surface protein
RKRKSAQYANRLSPRVGRFINAAGTTGFPTGKRAAETHVNEPSKETVKRESEAEKPSEETHISEPVKETEKLESETEKPSVETHISEAAKETVKLESKAEKPSEETHINEPDKKTVIVESEAKKPSEETHINEPVKETVIVEAEKPSEETHINEPAKEIMIVESEAENPSKETLVNEPAKETVKLESDAEKPSEENNQSRGSSRVDLQACKLGTGRRPHRSPFPTVAQPEWRMAPDAVFSPYASVRYFTPHMVHSQYNLL

SEQ ID NO: 180390 - protein, 103 aa, Glycine max
  Coding DNA Sequence Number=SeqID_88705
LGRIDGDPVLRETRIWATWEYVSSVGGWNFLLLFVDHRVVPGDMSRGSGDLGDVRRAPGSQQIKGTKTTKQGGLWLKNEGRRLRWSLVIDYQEGVIDYQAKNK

SEQ ID NO: 180391 - protein, 92 aa, Glycine max
  Coding DNA Sequence Number=SeqID_88706
MDISEDTDIPVILGRPFMLTTSCIVDMGKRKLELGFEDQKIDFDLFVEDKPSPEHNVCLQVMEGGQEVLKLAKVELSQLQFDLNSAKLQPDR

SEQ ID NO: 180392 - protein, 113 aa, Glycine max
  Coding DNA Sequence Number=SeqID_88707
MTQELVARGDTLRLSAPRHSVTPKAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 180393 - protein, 183 aa, Glycine max
  Coding DNA Sequence Number=SeqID_88708
  Gene Ontology: Mol. function=2-oxoglutarate decarboxylase activity; Cellular component=chloroplast; Biological process=menaquinone biosynthetic process
  Homolog annotation: Hit_ID=A7PNB6; Match level="QueryCoverage=58%, HitCoverage=18%, E-value=7e-37, Identity=70%"; Hit description =Chromosome chr1 scaffold_22, whole genome shotgun sequence
MPGFRFNRLAWLVQSEFYNTSHKIPLVLNHRQYTAHLPCTEIQHFIKRTKTAHLNSIHVTLGLYAFILFCNDSLDHANELSNSLKESANINTVWASLIVEECTRLGLMYLCIAPGSRPSPVAVAVASHKLITCISCFDERSLAFQAVGYGRGSHIPAVAITSSGTAVSNLLPAVCFINIACFT

SEQ ID NO: 180394 - protein, 54 aa, Glycine max
  Coding DNA Sequence Number=SeqID_88709
MPFRGLKSGRKRTAFYGKRDELAKRSLKNSLSEFILLLNYLWLSEAKLLSPDGF

SEQ ID NO: 180395 - protein, 123 aa, Glycine max
  Coding DNA Sequence Number=SeqID_88710
MVLAEGETLPAYSRYYGLLTDYREIEAALCISGRGFILNSEGHPGKILRKILTTLAQVWSVLSYFNLAPTSQPYDLTVDRVRLIFGLVSRLDINIRALISGQMTSIAQSNTSRLGFPALITTL

SEQ ID NO: 180396 - protein, 270 aa, Glycine max
  Coding DNA Sequence Number=SeqID_88711
MAKFDPEVVLEFYANAWPTEEGVRDMCSWVRGQWIPFDADALIQFLGDLLVLEEGQECEFSQRRNKADGFDKEAIAQLLCTPGQDFARTATGRRVRIMRTSMTTLTKMWMTLQLSNVLPSDHNSDLPLSKCQLVYAILTRMSIHVAQLIADAIYLFAGMPPTRHPLDPDKSNRALGFPALITRLCQSFRIPVTPSKDTDAPPPPHQVDPAGSLGMERYLQHLVCQQAANHRGQSSLGLRSRGPKIGPRPRQGRRLQDPRAMQRRPAWMRR

SEQ ID NO: 180397 - protein, 309 aa, Glycine max
  Coding DNA Sequence Number=SeqID_88712
  Gene Ontology: Mol. function=transporter activity; Cellular component= integral to membrane; Biological process=transport
  Homolog annotation: Hit_ID=A8GIA7; Match level="QueryCoverage=49%, HitCoverage=34%, E-value=2e-69, Identity=87%"; Hit description =Metabolite/H+ symporter, major facilitator superfamily
  Subcellular localization annotation: CTP_CleavageSite=79; ConfidenceScore=5.19e-01
QKYLVNTAGMDAKLASGIMTAALFVFMLLQPAAGAFSDKIGRRSSMLIFSALATLLTVPILFALKGVSNPFMAFGLIVLALFVVSFYTSISGLLKAEMFPPEVRALGVGLSYAVANALFGGSAEYVALSLKSFGVENAFFWYVSGMCLLALLDTANQPIDADTPQTANQFAHLDRVLLNALQLLIMADHGGVSADALQFCLPLLAHFLLGIVDQNGVFQIQPPGARVEIIAGNQLPLFVNPHAFQMIAVIAILPQTHDQLPGVDIALQAAQKTAQVDLVQVGQRADDFERLVFRNIEVVGGLVADDDLH

SEQ ID NO: 180398 - protein, 119 aa, Glycine max
  Coding DNA Sequence Number=SeqID_88713
MVNEECKEVSVSSKRLTKKERHFEIKTNIKEISPLRQPPHFLLCKKTLVSIATPIRLEFIPQVKELLDEGLVRKSLNTCALLVPKIGLPMDPKRIKVIPEWPTPPSVEERFMSFKNLWI

SEQ ID NO: 180399 - protein, 205 aa, Glycine max
  Coding DNA Sequence Number=SeqID_88714
GTSTRLFKENKGGYIPCGSLLVNEFYKVEKKSQGPQRGSKNLGELASGDYLTFSALIWRGWELGDHCMMYPYVVITPNYHPHDYVRPSRPGGLMAEDVHLVPIDRIDAVPVTVDHTLTCYILWEFTLRAELRYYVDSHLFFEVEEPRHDLEFLLTPIEYDGRGNVRQYNVEQVHPMEEIEVYQIFLNELELTSKEESDNSSEDMS

SEQ ID NO: 180400 - protein, 31 aa, Glycine max
  Coding DNA Sequence Number=SeqID_88715
MKANMDLAMVWLLVSPKNDIVIRLTLVYEVV

SEQ ID NO: 180401 - protein, 124 aa, Glycine max
  Coding DNA Sequence Number=SeqID_88716
MAPPKEIVIIIYHNCHITDDPVHGLGQTRYISAQLLDNDDLKGAMEIILQNPQLNSTEFYVVTNLIPQPQPSSPQSSCPELQLPPPQQLPYNNIDLNNPVSSYNNLETQDPFDNYTSYTTIIRK

SEQ ID NO: 180402 - protein, 41 aa, Glycine max
  Coding DNA Sequence Number=SeqID_88717
MWDRHRLKGALKPGVFTPKAYTPKSPLGPLPPDSGLSQHGE

SEQ ID NO: 180403 - protein, 47 aa, Glycine max
  Coding DNA Sequence Number=SeqID_88718
  Subcellular localization annotation: CTP_CleavageSite=32; ConfidenceScore=5.10e-01
MAGMLVTTWVPPSFLFSPFSPGSSFIKVGWIKFSSSQTHFDPFASEN

SEQ ID NO: 180404 - protein, 301 aa, Glycine max
  Coding DNA Sequence Number=SeqID_88719
  Gene Ontology: Mol. function=catalytic activity; Cellular component =mitochondrial alpha-ketoglutarate dehydrogenase complex; Biological process=metabolic process
  Homolog annotation: Hit_ID=A7P0B7; Match level="QueryCoverage=67%, HitCoverage=70%, E-value=1e-98, Identity=73%"; Hit description =Chromosome chr6 scaffold_3, whole genome shotgun sequence
  Pfam annotation: Domain name=Transket_pyr; Domain location=66-206; Score=108.0; E_value=3e-29; Accession=PF02779.15; Description =Transketolase, pyrimidine binding dom
  Pfam annotation: Domain name=Transketolase_C; Domain location=208 -301; Score=43.5; E_value=7.4e-10; Accession=PF02780.11; Description =Transketolase, C-terminal domain
  Pfam module annotation: Pfam domain module=Transket_pyr::Transketolase _C; Domain location=66-206::208-301
TIQSKLRKFRVLGTHNNYPQDSEVEEKSLIIKLKFKSVLGGYYFSKGFSTSTSVQKGGGGSEEGLKSLNLCSAINQALHIALDSDPRSYVFGEDVSFGGVFRCTTGLADQFGKKRVFNTPLCEQGIVGFGIGLAAMIVNEAAKFRYRSGNQFNCGGLTVRAPYGAVGHGGHYHSQSPEAFFCHVPGIKWLYRLAVEEVPEDDYMLPLSEAEVIRQGSDVTLVGWGAQLAIMEQACLDAEKEGISCELIDLKTLIPWDKETVESSVNKTGRLLVLVLKFQLLLLSVASQGYAQPLIAISTTL

SEQ ID NO: 180405 - protein, 55 aa, Glycine max
  Coding DNA Sequence Number=SeqID_88720
MQTYAIISNASSSTNQTMSCFDRYGFKTANMEGSITLSQAQHSMKNNIFHTHLRM

SEQ ID NO: 180406 - protein, 74 aa, Glycine max
  Coding DNA Sequence Number=SeqID_88721
MYGVEGVTRIANSSSDRRLIDMGGCFDGVGKREGDGLKFEARGSNGSKGTGNRAKASARINVSPLSESPKPNRR

SEQ ID NO: 180407 - protein, 174 aa, Glycine max
  Coding DNA Sequence Number=SeqID_88722
  Homolog annotation: Hit_ID=Q6WAY4; Match level="QueryCoverage=65%, HitCoverage=23%, E-value=2e-10, Identity=32%"; Hit description =Putative uncharacterized protein
MGSSQAPWLKKRFYEVKIKSLGVASLKELGQLMGQLQQQAFRKAYGKIWDLTMAKVFTEAIASLAQYYDQPLRCFTFGDFQLTPTVEEFEEILGCPLGGRKPISKIVKISTQEVDRGKQVENGVVGVPRKCLEAKARTLASQDEWAPFMDILTLLIFGGGPLSKCGRVGGPGND

SEQ ID NO: 180408 - protein, 388 aa, Glycine max
  Coding DNA Sequence Number=SeqID_88723
  Gene Ontology: Mol. function=nucleoside-triphosphatase activity; Cellular component=flagellum; Biological process=transport
  Homolog annotation: Hit_ID=A6T743; Match level="QueryCoverage=99%, HitCoverage=92%, E-value=1e-162, Identity=56%"; Hit description =Putative ATP-binding component of a transport system
  Pfam annotation: Domain name=ABC_tran; Domain location=127-295; Score= 161.0; E_value=3.2e-45; Accession=PF00005.18; Description=ABC transporter
  Pfam annotation: Domain name=SMC_N; Domain location=114-300; Score= -104.1; E_value=0.00054; Accession=PF02463.10; Description =RecFRecNSMC N terminal domain
  Pfam module annotation: Pfam domain module=ABC_tran::SMC_N; Domain location=127-295::114-300
MATRIVDLDRGKLVSWPGDYDQFLLGKEEALRVEELQNAEFDRKLAQEEVWIRQGIKARRTRNEGRVRALKALRRERSERRDVMGKANMQVGEAARSGKIVFELENVDYGVDGKTLVKDFSTQVQRGDKIALIGPNGCGKTTLLRLMLGQLKADAGRVHCGTKLEIAYFDQHRAELDPDKTVMDNLAEGKQEVMVNGKPRHVLGYLQDFLFHPKRAMTPVRALSGGERNRLLLARLFLKPSNLLILDEPTNDLDVETLELLEELVDGYQGTVLLVSHDRQFVDNTVTECWIFEGNGEIGTFVGGYHDAQQQRAAYKQTKAAPVKSTAAKPAEKADAPKRSAGKLSYNLTRELEQLPQKLEQLETRIGELQAQMSHPDFFSQPHDKTQP

SEQ ID NO: 180409 - protein, 281 aa, Glycine max
  Coding DNA Sequence Number=SeqID_88724
MEGSIDVALVKEFYANLYVLGDKPPKQVRVKGHLSKFDADSLNTFLETPVVLDPGETLLTYSRFCRLRPDPQEMVARLCIPGRGFVLNAEGLPWKLLRKGLTTLAQTWSVLSYFNLASTSHTSDLNLDRVRLVYGLEMKMDMNVGALISGQITLMAQSNSSRLEFPALITTLCMARGVISDSLTFESLNPTINLAYIKKNCWNLDDPTISFPGTRTRGSEGPSSAAPQTSIAPAPIPSAQVPATSNPSAQSTDLMMVMLQSIHQGQYLVMQSLHSLAQHQL

SEQ ID NO: 180410 - protein, 316 aa, Glycine max
  Coding DNA Sequence Number=SeqID_88725
  Gene Ontology: Mol. function=N-acetyltransferase activity; Biological process=metabolic process
  Homolog annotation: Hit_ID=A8GCY6; Match level="QueryCoverage=55%, HitCoverage=94%, E-value=3e-67, Identity=72%"; Hit description =Putative uncharacterized protein
  Pfam annotation: Domain name=Acetyltransf_1; Domain location=55-161; Score=15.2; E_value=0.051; Accession=PF00583.15; Description =Acetyltransferase (GNAT) family
MNIRRARPTDYPAILQLQGENVPEALDERQKRQGFIVSRMNEAQLAAINRGIGILVAEQENQLAGFVCLMPADVQPRPPVVDAMLATLATQSFAGRALNELRVFLYGPVCLAAAWRGKGVLKRLYAAVKAHTSHDYDVGALFIDDDNPHSLAAHVQGLGMTALAPFHCGQKGYQLVHKGVHHHRQRHVYHRDVAPGRIAQIPLHAGIVLVAMPRAGHGAADNAAAAGQGHHAGRHAGQPKVGREIHDIDSEQGGCFASEQRIGRSLPQFPFSAGTDAPINAGPLGAPAGCAATADSAHARRRLPATARRAGANEPA

SEQ ID NO: 180411 - protein, 95 aa, Glycine max
  Coding DNA Sequence Number=SeqID_88726
  Subcellular localization annotation: CTP_CleavageSite=63; ConfidenceScore=5.41e-01
MYPLLFSITTTQVDVPSTCTTKDVPSNVLRQSSQAGKGRHKRIQAVSPLFFWKREKRDTKRIQVNKVWKPENSESFWQRKKKKKFKKMFKEIQRL

SEQ ID NO: 180412 - protein, 292 aa, Glycine max
  Coding DNA Sequence Number=SeqID_88727
  Gene Ontology: Mol. function=transporter activity; Cellular component= membrane; Biological process=transport
  Homolog annotation: Hit_ID=Q8D073; Match level="QueryCoverage=62%, HitCoverage=53%, E-value=1e-69, Identity=74%"; Hit description=Inner membrane permease of galactoside ABC transporter
  Pfam annotation: Domain name=ABC_tran; Domain location=1-109; Score =9.1; E_value=1.3e-07; Accession=PF00005.18; Description=ABC transporter
  Pfam annotation: Domain name=BPD_transp_2; Domain location=119-292; Score=-49.8; E_value=0.015; Accession=PF02653.7; Description =Branched-chain amino acid transport system  permease component
  Pfam module annotation: Pfam domain module=ABC_tran::BPD_transp_2; Domain location=1-109::119-292
MGLLDNKRMKSDTQWVIDAMRVKTPGHHTQIGSLSGGNQQKVIIGRWLLTQPEILMLDEPTRGIDVGAKFEIYQLISELAKKEKGIIIISSEMPELLGITDRILVMSNGQDPTFLSLMNLSNILTQSSVRIIIALGVAGLIVTQGTDLSAGRQVGLAAVVAATLLQSMDNANKVFPHLETVPIPLVILTVCIIGGVIGLVNGVIIAYLKVTPFITTLGTMIIVYGINSLYYDFVGASPIAGFDAGFSKFAQGFLRFGDFKLSFITFYAIIAIVFVWILWNKTRFGKNIFAIG

SEQ ID NO: 180413 - protein, 67 aa, Glycine max
  Coding DNA Sequence Number=SeqID_88728
MARSVFALCPYLGTYRSPVESPTVAACPFAGEQGEVLGCAFQRRKEAWSRHQCLFVKNVGKTEGNRS

SEQ ID NO: 180414 - protein, 141 aa, Glycine max
  Coding DNA Sequence Number=SeqID_88729
DAEQRLNTADDPSAAALQSGTVAAAAGARRTGTGGIAPRAGADRYAAGSAVNAGPTGGRGGAQRIPFCTYVPQQHRRSAAPVCDAPPYGSRAATAAIQRAVAHRDCPALRFPLLQPFQQPLPSAARHGTLGMASALTGQLE

SEQ ID NO: 180415 - protein, 101 aa, Glycine max
  Coding DNA Sequence Number=SeqID_88730
MERSMIDAASGGALGDMTPAEARNLIEKMASNSQQFSARNDAIVIKGVHEVATNSSSSTETRKLEAGLESKICTCRKSLWFMLLCRPPYRPLPFYAATWSN

SEQ ID NO: 180416 - protein, 135 aa, Glycine max
  Coding DNA Sequence Number=SeqID_88731
MGEVEEVQEQMEADMEAMKEQMTTMMEAMMSMKKIMEANAVAVAATSAVAKVNPTSPFGINLMNHPTSDMVGKDLGSTGGPHDVQIQNEHAFPPYGLPLNYTPPNVAYTPNENVNNSTPIPIESQQPQTDHAHVF

SEQ ID NO: 180417 - protein, 126 aa, Glycine max
  Coding DNA Sequence Number=SeqID_88732
  Gene Ontology: Mol. function=NADH dehydrogenase (ubiquinone) activity; Cellular component=mitochondrial respiratory chain; Biological process=electron transport
  Homolog annotation: Hit_ID=P08834; Match level="QueryCoverage=82%, HitCoverage=35%, E-value=4e-37, Identity=77%"; Hit description=NADH -ubiquinone oxidoreductase chain 1
  Pfam annotation: Domain name=NADHdh; Domain location=1-104; Score= -200.6; E_value=0.041; Accession=PF00146.12; Description=NADH dehydrogenase
MAQKQIWSGIPLFPVLVMFFISRLAETNRAPFDLPEAEAESVAGYNVEYARDAILNSPLLAEANVPGSRGLILTETRGACWGRALFILHSKLMNVGSGVSALLSKRELGKANSTHWTSTGLSQVEP

SEQ ID NO: 180418 - protein, 51 aa, Glycine max
  Coding DNA Sequence Number=SeqID_88733
MGQGITKAVVFRSLLASMWCIVTADLKDDWHKWFSDGSPLDVEAITTVRQI

SEQ ID NO: 180419 - protein, 305 aa, Glycine max
  Coding DNA Sequence Number=SeqID_88734
  Homolog annotation: Hit_ID=Q6WAY6; Match level="QueryCoverage=53%, HitCoverage=40%, E-value=8e-17, Identity=29%"; Hit description =Putative uncharacterized protein
MGPLQMQAFRMAYGKILDLTIAKIFAEAVVFLTQYYDQPLRCFTDSARELDHVKQTRNGVVGLPWKYLEGKARDMANHEEWVPFVDVLALLIFGVVLFPNMDGLVDLATIDAFLAYHHSKESPVEGKEGVLFSCGDYPNIPLIGTRGCINYNGALAIRQIGYPMRGAPKEESLSPFLVRYFGAQSFKIIQRVHKAWENPLRKDKELRGIRNGIIGGYHEWLKIINEENFEAPEEDEEVRALKTELGKVRLAKEKFKLVATDIQKECAGLREENAATARALEQETKRAHKEEHGRDKFRGALWGSN

SEQ ID NO: 180420 - protein, 185 aa, Glycine max
  Coding DNA Sequence Number=SeqID_88735
  Homolog annotation: Hit_ID=A5B6Y9; Match level="QueryCoverage=22%, HitCoverage=8%, E-value=9e-14, Identity=83%"; Hit description =Photosystem I P700 chlorophyll A apoprotein
VDSDPQPRNFGRRDHVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVAIK

SEQ ID NO: 180421 - protein, 77 aa, Glycine max
  Coding DNA Sequence Number=SeqID_88736
MQVLEAPIKATTEKKMELERLITRLSESGIDDEEAAEEEEEAAEEDKEAAEEEEEAAEEEEDAAEETESDDDSEATP

SEQ ID NO: 180422 - protein, 77 aa, Glycine max
  Coding DNA Sequence Number=SeqID_88737
MESGDMRRYRMVTRTFRQPGAKEPVDAERLTSSSALFGHPGTASRVAGGDTLWFLLSSSGDIQARRHTRFFSAGRGR

SEQ ID NO: 180423 - protein, 188 aa, Glycine max
  Coding DNA Sequence Number=SeqID_88738
QGAPFEGTIVDDWKFDYSNHDARRMVCNDQDEMTGRLLAGSLAFDCRIMHYIIIDWAHLVRYRMHKALWANAPLPYPQLVTLFLRHFQIPLDDEPFVQVKRSFAIGAGAVTSFGYRKDRNGQWLKKDALPPQDERTPSPPPQRDDSFTLLTEVLSKLRGLCTYVGERFDSLDGCFEGMDTRITQLEED

SEQ ID NO: 180424 - protein, 238 aa, Glycine max
  Coding DNA Sequence Number=SeqID_88739
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=5e-34, Identity=32%"; Hit description= UPI00006A17C9 related cluster
  Subcellular localization annotation: CTP_CleavageSite=57; ConfidenceScore=5.70e-01
MNARTCSPLKVSACSPTKARTCSPLKVRACSHLMARTCSPLKVRACSHLMARTCSPLKARAWSPLKTRTCSPLKVRACSPMTARTCSPLKVRACSPLKERACSPQKVWACSPLMARTCSPLKENTCSPLKERTCSPLKVRACSPLMARTCSPLKARACSPLKARTCSPLKVMACSPLMARTCSPLKVRSCSPLKERTCSPQKARTSGSLKVRTYNPLKARAYSPLKVWTCSLLKGEDV

SEQ ID NO: 180425 - protein, 106 aa, Glycine max
  Coding DNA Sequence Number=SeqID_88740
  Subcellular localization annotation: CTP_CleavageSite=56; ConfidenceScore=5.17e-01
MSVMPRRCRTWPIPIPSCPIRVSSSMIPPFIHFVSLGSPFHPGTFHGPPSGAFGVGSSLFWVNEGVPPEGGEDPNMLVILYPGWKSCGYEYIGAIYDGSWVNTGGV

SEQ ID NO: 180426 - protein, 243 aa, Glycine max
  Coding DNA Sequence Number=SeqID_88741
  Homolog annotation: Hit_ID=A7UQU7; Match level="QueryCoverage=58%, HitCoverage=23%, E-value=2e-20, Identity=39%"; Hit description=IMP dehydrogenase/GMP reductase, putative
MGCSSPHVSAGGFAWGAAALVHMYDHLNDASQAFTRQLGGYITLLQCWIYEHFPTVHTFVVHDAYDEGSPRACRWLTGKAHMMGIKGAPYRRRLDALSVTVVCWMPYGEHWGVRAFDLISSYTGQLRWGQIVVYVRSERVLRQFGYLQTVPPPPVCDSLTGDDIDDRWLHFSDHLVPSGELCVVPGQVAPDYMEWFFQISHPFVTQTEETAARRHPPPPHHEEFVEPPIPEVSVATNLPTHSV

SEQ ID NO: 180427 - protein, 75 aa, Glycine max
  Coding DNA Sequence Number=SeqID_88742
MAGQAPTVFIPKEICPYKPTKRNQVEVVIDKPKAEWTQDEKTKLLLNSRAKFFLKCALSISKFDKIEECGTTQEI

SEQ ID NO: 180428 - protein, 233 aa, Glycine max
  Coding DNA Sequence Number=SeqID_88743
  Gene Ontology: Mol. function=phosphoprotein phosphatase activity; Biological process=intracellular signaling cascade
  Homolog annotation: Hit_ID=A7PHV0; Match level="QueryCoverage=50%, HitCoverage=48%, E-value=2e-22, Identity=36%"; Hit description =Chromosome chr13 scaffold_17, whole genome shotgun sequence
  Pfam annotation: Domain name=DUF1723; Domain location=81-129; Score =47.6; E_value=4.4e-11; Accession=PF08330.1; Description=Protein of unknown function (DUF1723)
MASSSSCSSNIKIKSGPIDGGVLWMQAKHVSKHVWNGKEDWKLLIRRAVPTYQGEEEIPEEIIPLLRQCDFYWIMKMGYLKISVSLITTLIERWRPETHTFHMRCRECTITLQDVCIISTYAWGPAVLVFLYREMSSATDYKIKSIGGMCILIQMWAWERCTTLAPKRTPPFLWEPYTATAMSALPPICLVGSVAWCAVVPLICFHAVEWHQPDIVLQQFGMQQPILECPSQP

SEQ ID NO: 180429 - protein, 74 aa, Glycine max
  Coding DNA Sequence Number=SeqID_88744
MATPNAPLAPQWNVPKAIPDMGDLLGVDLRQEFSVEAEQVEARRHRGRRNPDHQARRWDRPCGTSSRHHGHHNE

SEQ ID NO: 180430 - protein, 137 aa, Glycine max
  Coding DNA Sequence Number=SeqID_88745
MGHIGRNMGPINLAAEQETFFSIWLCHVGKGAVIWRHRRIVLHREREEEGEAQANKEGERGREKRGRGEGKRNSHVERGRGKRGRGEGKRNGHMERGRRKRGSGEGKRNGQQERGRGKQEKKGRGEANDLDTDWGKR

SEQ ID NO: 180431 - protein, 626 aa, Glycine max
  Coding DNA Sequence Number=SeqID_88746
  Homolog annotation: Hit_ID=Q6WAY6; Match level="QueryCoverage=42%, HitCoverage=50%, E-value=4e-23, Identity=28%"; Hit description =Putative uncharacterized protein
MATPMSTARYLNKDETDQSIDIKKYRDGRLFDVSIKNAENTRIGGQKGHSKAFSDPWLAQASLRGTWPPKWLRGEVTSSPGQARLLQVEAVAHLGELQTNQKKKKEGKNEAEALPNCDRNQLSHRSSFGVLRPSSEPRTSQLAKARAADGSSSTSSLPQSIGKIWDLAMIEVPVEAIASLAQYYDQSCRCFTFGDFQLVPTIEEFEGILGCPLGGRKSYLFSGFYPSMERVAKVVKISTQELDRLKQNRNGVVGIPRQHLEERAEALANQGQWTSFIDILVLLVFRIILFPNMDRLVDIAAIDTFLAYHHSKESPVVAFLPDAYDTFNLRCEKSSAGIVIACVSKREGQIGRNSWQEGGAEVLCLCGEFPNVPLMGTRGCINYNPILAIRQLGYLMRGHNRKRSSCFLLHGVAMKAMQKYFREFARTQGITWLSKLKISSGEEVEVLEESEEVQALKAELERTRVVKEKLMTTVTRVRKECDELRDVNMTTTEANNKLKLRRAERNESRVESMVLKDKLKACQRSKRSLTKQLSRTKENMLTIIDQYKEKVNLAASHGQRLEDEHVKAMKWMDRFALTLNGSQELSRLLARAKAMSDVYPIPDEVHGLCDYCHHMIELMSHIIRNR

SEQ ID NO: 180432 - protein, 272 aa, Glycine max
  Coding DNA Sequence Number=SeqID_88747
  Homolog annotation: Hit_ID=Q2HW90; Match level="QueryCoverage=54%, HitCoverage=36%, E-value=1e-16, Identity=33%"; Hit description =Putative uncharacterized protein
MHHVPFEATPQFDINHVISYHTYLGFERPDNPLRLWQQFFGHDSNGRVSRSTFYQATYVKFYGDVGDFTDDVLPRCLRGRNIGGRDVSTEAIASLAQYYDQPLRCFTFGDFQLSPMVEEFEEILGCPQGGRKPYLFSRKCLEAKARILAGRGEWAPFIDILALLIFGGVLFPNVDGLVDLAAIDAFLAYHDRKESLVVAILADLYDTFDRRCEKSSTRIVCCTLALYVWLVSHLFRQEVRHACPLESHRSYTEKKGANWDRLLEGKEGASVN

SEQ ID NO: 180433 - protein, 118 aa, Glycine max
  Coding DNA Sequence Number=SeqID_88748
MACPIISLTSDLVTKSGVVEWTMMVAGSLEVASFEVFDSLGAGCHDPPHCYDITILNHDYPELGMGRRSIDHGPSLYSRPSLSTGKAGNDIAHTNCGHVTVYLNLSLSLDLARHLTIA

SEQ ID NO: 180434 - protein, 1022 aa, Glycine max
  Coding DNA Sequence Number=SeqID_88749
  Gene Ontology: Mol. function=transferase activity, transferring glycosyl groups; Cellular component=integral to membrane; Biological process=cell wall organization and biogenesis
  Homolog annotation: Hit_ID=A8R7F0; Match level="QueryCoverage=93%, HitCoverage=98%, E-value=0.0, Identity=59%"; Hit description =Cellulose synthase catalytic subunit
  Pfam annotation: Domain name=Cellulose_synt; Domain location=191-963; Score=1537.8; E_value=0; Accession=PF03552.5; Description=Cellulose synthase
  Pfam annotation: Domain name=PHD; Domain location=36-85; Score=9.2; E_ value=0.0011; Accession=PF00628.20; Description=PHD-finger
  Pfam module annotation: Pfam domain module=Cellulose_synt::PHD; Domain location=191-963::36-85
MEACTGLFAGTPNSNELVVIQGHDEPKPVKNLDGQLCEICGDSVGLTVDGDLFVACEECGFPVCRPCYEYERREGTQVCPQCHTRYKRIKGSPRVLGDEDEDDVDDIEHEFKHEEMLQGNMTHGDSEGNSKSKPVGLAKVNGELPVSSHSVGEPGAKLDDKEKVDEWMLHQGNLWPETDASVDPEKAMKEPLSRKVPIPSGRLSPYRMMVVARLLLLLLFFQYRIFHPVPDAIGLWFISVTCEIWLALSWMIDQLPKWFPIDRETYLDRLSIRFEPENKPNMLSPIDIIVTTVDPIKEPPLVTANTVLSILALDYPADKISCYVSDDGASMLTFEALQETAEFSRKWVPFCKTFSVEPRAPEKYFSEKIDFLKDKLQSTYVKERRTMKREYEEFKVRINALVAKSMRVPPEGWTMKDETPWPGNNSKDHPSMIQVLLPHNVGNELPCLVYTSREKRPAFQHHNKAGAINAMLRVSAVLSNAPFVLNLDCNHYVNNSKVVREAMCFFMDIQLGNGIAFVQFPLRFDSLDRNDRYANKNTVLFDINLRCLDGIQGPAYIGSACIFRRKALTGFDSPKTSKRPSMVQVHSKQDENGEEASITGEDKELLKSEMNDENKFGKSILFMNSALAEEGGVDPSSSQEALLKEAIHVMSSRYEDRTLWGYEVGLSYGSIAADTLTSLKMHCGGWRSVYCMPKRDPFRGTAPINLTDRLNQVLRWAVGSLQILFSSHCPLLYGGRLKGLQRIAYINSTVYPFSSIPLLIYCIIPAICLLTDKFITPSVGTFASLIFIALFISIFASAILELRWSGVSLEEWWRSQQFWVIGSVSANLFALLQGIMRALPLGRVNTNFSIVSKAPDDVEFRELYAIRWTALLIPPTTIIIINLIGIVAGFTDAINSGEHSWGALLGKLFFSLWVVIHLYPFLKGLMGRQNRTPTLIVIWSVLLASIFSLVWSSVPPNTKFKIIIGSKHKQHTGSELSQDLVRVTLFYENAPTMWDRHRLKGALKSGDPQGLHSEESVRASLS

SEQ ID NO: 180435 - protein, 148 aa, Glycine max
  Coding DNA Sequence Number=SeqID_88750
  Pfam annotation: Domain name=zf-CCHC; Domain location=88-105; Score =22.1; E_value=0.00069; Accession=PF00098.14; Description=Zinc knuckle
MFEDEALNIKILNFLTRTWEPKITTIKESKNLATMMMGALFDSSSSEEDAENFNLMVRKFGKFLKKSKDIKFSKSSKKVDNNNNNFSYTCFECGKQGHIKFECPIYLRKHGGKKKGKKERKQKKAYIAWEESASITSNSSSDEEIANV

SEQ ID NO: 180436 - protein, 97 aa, Glycine max
  Coding DNA Sequence Number=SeqID_88751
MKVEKSWHIDSGCSKHMAGDASKIIHISPNDSEYVIYGDNKQRFQVLMTPKRICLIIILIIKKGENVKNAGFDDAEKNSLDKDCHHQKGGDCECMNT

SEQ ID NO: 180437 - protein, 32 aa, Glycine max
  Coding DNA Sequence Number=SeqID_88752
PWDSCKAILLCYSLFRAFVLGFYVFCFDAIVH

SEQ ID NO: 180438 - protein, 82 aa, Glycine max
  Coding DNA Sequence Number=SeqID_88753
MTKARQKGVRKLNEMKIKVRETSGDHQGEKRQKLATQLDQASSVASSRRHRLLEELPGKAQVDLVAICTPPYLLNTALAFFC

SEQ ID NO: 180439 - protein, 91 aa, Glycine max
  Coding DNA Sequence Number=SeqID_88754
MEKDIYKVEKIPLFFKRFWTGSMVFKPLLVKVKLKLKNKVMQAPLELVGLGSSSSMDSFAFWKMNGSGMEKEEREETPLQGEDESRRSSPP

SEQ ID NO: 180440 - protein, 128 aa, Glycine max
  Coding DNA Sequence Number=SeqID_88755
YCTQRQAQGDAPQAAGALPPPHQAGPAGSVDTERYLRHLVRQQAANHRAHVQTHDCLYQMSLSMQSQGFVSFSCPTPDQFRAEVAWPGDWPEAQAGEAPPEVPGDGEEAHEDEEMTDLFDFLGGSGAT

SEQ ID NO: 180441 - protein, 160 aa, Glycine max
  Coding DNA Sequence Number=SeqID_88756
MWAFHKGLQIDWAHLVRYRMHKALRLNAPLPYPHLITLFLQHFNIPFDFEPYVPIKRSFLIGASVIASFGYIKEHDGSWVKKGARNVGEEGHEGEDSSHLSKILERFDGLQTFVDERFDTLDLQVDMRFNEIESRMTKVEEDLSYIRSSFDLPPLPPPSS

SEQ ID NO: 180442 - protein, 181 aa, Glycine max
  Coding DNA Sequence Number=SeqID_88757
MTSKIILMMPKNQELSKFQRIRSQKASGIKFQRFKIQRTIKFQRIKIQESREDSIKIRYILCGTSRRYIYLGCCTENKRRYISYGSVQVEGTSLVDLWLVKDFTRLKEISRTVGCWGTRCRHGLWPNQRETHSIHLIFQMETWLCAIDHQRRNGKASENDKNEKMRTLEDTDAILPRKGIR

SEQ ID NO: 180443 - protein, 51 aa, Glycine max
  Coding DNA Sequence Number=SeqID_88758
ITDAEKKNHSEKKLKKAYITWDENDLESSDDSENEEINLCLMAKSYESDEE

SEQ ID NO: 180444 - protein, 164 aa, Glycine max
  Coding DNA Sequence Number=SeqID_88759
GPRISRTDHRTLPVVRSPRGTYQGDSAAITRAFIEKYCTQRQAQGDAPQAAGVPPPPLQAGPTGSFDTERYLRHLVRQQAANHRAHVQTHDCLYQMSLSMQSQGFASFSCPTPDQFRVEVAWPEDWPEAQAGEAPPKAPDDGEEAHEDEEMADLLDFLGGSGAT

SEQ ID NO: 180445 - protein, 21 aa, Glycine max
  Coding DNA Sequence Number=SeqID_88760
MDPSLPNKGSPPIEGIPLKAK

SEQ ID NO: 180446 - protein, 138 aa, Glycine max
  Coding DNA Sequence Number=SeqID_88761
MYGFLEPQSIQRSGQSQFESESYIKSWMQSSKHDVYLGAYLNGHWQMVVILPKENLVVWFGSLHNRLDNYLKGIINRQKGSTKCGYYVMHWMSTIISGTFRNNWETAYFNDVRPLEAGRFKAFRIQWAQYHLKVRNQT

SEQ ID NO: 180447 - protein, 71 aa, Glycine max
  Coding DNA Sequence Number=SeqID_88762
MWWKSKRGVFAQSISFRDFFERPTWAFQKLPPEGCCFCRKHPGSPGRAGRQASPYFAINRGGSEEEKGSAP

SEQ ID NO: 180448 - protein, 202 aa, Glycine max
  Coding DNA Sequence Number=SeqID_88763
KAAISLFHQFPDESLSEALERPQTKKLLDASTGGKIKLKTLEEATELIENMSVNDHAILRDRTHQPTKKSLLELSSHDTLLAQNKLQVVPSMVRFMKQANVFPSKKTLKKFILWGINNDKGILKEDFQAFSRVPIINKDSGGHTLETLNQFMQVTMSNHKITELALKNLEVQVEQLAKQIVDKSSNSFVANTEQNPKEECKD

SEQ ID NO: 180449 - protein, 115 aa, Glycine max
  Coding DNA Sequence Number=SeqID_88764
MEICHGGQETLGTSGLKWDWKIVKASGNRLPACVIDYTEEQATGNRLPGSLGDPRRQYEVLISGHDSIHGDFIGVSRGTREYASAHFGVDITHAYTIPSSGASPSDRGDVIRGRP

SEQ ID NO: 180450 - protein, 237 aa, Glycine max
  Coding DNA Sequence Number=SeqID_88765
  Gene Ontology: Mol. function=RNA-directed RNA polymerase activity; Cellular component=mitochondrion; Biological process=mitochondrial electron transport, NADH to ubiquinone
  Homolog annotation: Hit_ID=P92567; Match level="QueryCoverage=78%, HitCoverage=96%, E-value=7e-49, Identity=54%"; Hit description =Uncharacterized mitochondrial protein AtMg01410
VLRRIPMDDQTAPLIRLVPSKTCLSYDLKSATDWWPLVFLFERLALLFDRSFASSVVNTTLGTNVFEVPFVKRALSQVSFVTGQPLGYYGYWPLFAFTHHVLVWWAAEQVRPGILFDRYAILGDDVLITDPLVAEQYRLGLQRLGVKISTHKSLISSTGAVELDGVQSVWRESFLLNAMILSVLSSPALVSGLDFSAMIFPVVHIGAIAVSFLFVVMMFHIQIAEIHEEVLRYLPVS

SEQ ID NO: 180451 - protein, 122 aa, Glycine max
  Coding DNA Sequence Number=SeqID_88766
MDVEFTEICLPRSLLEWVMHIGKWSLCPKDNAAIWFCSLHNRPDNCLKGIINSALKGFNDSQGSKSKVITRWILVKCNKQKVSIEYRYYVVHWMSTIVLGGFEDNWKMYFADPRALELETMK

SEQ ID NO: 180452 - protein, 17 aa, Glycine max
  Coding DNA Sequence Number=SeqID_88767
MQHFKVIDDGRKSINMQ

SEQ ID NO: 180453 - protein, 140 aa, Glycine max
  Coding DNA Sequence Number=SeqID_88768
DLIWEDIQAEFDILEASDSRTKRKLLQTVGERWRQFKSNLTRKWALAADQDGVEDTVCDKYGISKEKWAQLCQTRRDPSWEDVHFKAQTIQKQNTAPHVLSRGGYDYLEQKLLAEKTKKKLHSQEALMVSSTLHPRSDAT

SEQ ID NO: 180454 - protein, 143 aa, Glycine max
  Coding DNA Sequence Number=SeqID_88769
  Gene Ontology: Mol. function=sequence-specific DNA binding; Cellular component=microtubule associated complex; Biological process =microtubule-based movement
  Homolog annotation: Hit_ID=A7QG24; Match level="QueryCoverage=37%, HitCoverage=10%, E-value=1e-14, Identity=61%"; Hit description =Chromosome undetermined scaffold_91, whole genome shotgun sequence
MRKEKIPHQAPFAIQAAQLLGRAIGAGLFAITPAGERGMCCKAIKLGNARVFPVTTFRYSVDYCYKEDEDNELIYSREVKPLVSAAFDGHNSTVIAHGARGSGKTHAIQGTELEFVIMVIAVSCVKLLSAHNSTQHTSRKHKV

SEQ ID NO: 180455 - protein, 153 aa, Glycine max
  Coding DNA Sequence Number=SeqID_88770
MAPPCHSCRGKGHASQLGQAGNLGAFVWQHLWRSGSPMAWVCSGSHQPIACTHLLPPFLCHKLQLGLCPSSPIVAPPLSGMFPRHVMPSDASNKNLPCPRCHTLISSGDHPLLGCDPRLTTSRYLAPILRQFVKFCDMPEVKRRHCSTIREVP

SEQ ID NO: 180456 - protein, 276 aa, Glycine max
  Coding DNA Sequence Number=SeqID_88771
  Homolog annotation: Hit_ID=UPI00006A2939; Match level="QueryCoverage =71%, HitCoverage=100%, E-value=2e-15, Identity=29%"; Hit description= UPI00006A2939 related cluster
MKGLHVLTFRGIHVLAIRGLHAYTFRGLHVLAIRGLHALTFRGLHFLAIRGLHALTFKGLHFLPIKGLQALTFRGLHVLAIRRLHALTFRRQHFLAIRGLHALTFRGLHVLAIRGLHDLTIRGLHVLAIRGSHALTFRGLHVLTIRELHVFTIRWLHVHATRGLHTLNFRGLEILAFREPHVIAIRGLHALTFRGQHRTISPHHQRAACPHHQRAARPHLQRTTRPHLQRAARLHHQRATRPVHQRAARPHLQRAACLHHQRATHPHLKRTTRPSH

SEQ ID NO: 180457 - protein, 88 aa, Glycine max
  Coding DNA Sequence Number=SeqID_88772
  Subcellular localization annotation: CTP_CleavageSite=77; ConfidenceScore=5.00e-01
MQPKVLILDPSIIITAYSENQNPNNTSLVKKRLIFEFQNVAVGLSAYPPLSAASTLLAQRRIRLSSRLALSPISLTRAKRSVAISEPI

SEQ ID NO: 180458 - protein, 187 aa, Glycine max
  Coding DNA Sequence Number=SeqID_88773
  Homolog annotation: Hit_ID=Q6WAY6; Match level="QueryCoverage=84%, HitCoverage=28%, E-value=3e-16, Identity=31%"; Hit description =Putative uncharacterized protein
MDQVRRQAFRKAYGKILDLAMIEVFVEAITSLAQYYDRSLRCFMFGDFQLVPTIEEFEAILGCLLGGRKPYLFSRLYPSMAIVAKVVKILAQELDRVKQNRNGVVGIPRKNLEEKAKDLADQREWTSFVDVLALLVFRIVIFPNVDGLVDLAMVDAFLAYHYNKESLVIVVLAYAYDTFDLRCEGIL

SEQ ID NO: 180459 - protein, 130 aa, Glycine max
  Coding DNA Sequence Number=SeqID_88774
KVKRALCAKPECYSVEAELSAPCCAKLQLFSMTSKNRKAPSTTTQARFDRSRFTSLEAWERYADIVVPRKLLPERNVVIYYTKFDEFKEELKRRHWDKKLTDFSDNSIDIAIVKEFYANLYDPEDKSPKQ

SEQ ID NO: 180460 - protein, 318 aa, Glycine max
  Coding DNA Sequence Number=SeqID_88775
MALRKLPTKRSRKDTTGEGSSATPHADVDLDRHRFRSVEHQQRFETIRGWHRAPLVSPMAKFDPEIVMEFYANAWPTEEGVRDMRKASNASIAGGGVRPQALMRRLLANCCACRGRTLPGPQQGESKILPSDHNSDLTLLKCQLVYTILTHVSVHVAQLISDAIYQFAGIVRTRHPVDPEKSNRALRFHALIIGLCQFYGVSVTPSKLIRPPINRAFIEKYCMPRQAQGQAPQQPEDGQQQAAADAPPPSPKSTSTHLRSTPYISRARIPALTHDLLLSSSKSQWHGLEIGPIFRQGQGLQGPPKMETDLRKTMTWPM

SEQ ID NO: 180461 - protein, 211 aa, Glycine max
  Coding DNA Sequence Number=SeqID_88776
MLQNLTDCVTMLPFDFRHVTETHGLCNTIAKVIGCWHEGNTYQEGWEKNYDSYVTRVLYRENAQKDGSKTTLPDLHKFILFHLMENLPFGLPHTIYSNILRNLKGLGVLDDIYYAALINKILGDQGVYHVFNKMNEDSKHILIAKGSVVAKQQKFSKANLKAMKVSFIPSTILRHIQTRATKANPKIGDKEWAVSFIGNKKDPASSTSSDH

SEQ ID NO: 180462 - protein, 94 aa, Glycine max
  Coding DNA Sequence Number=SeqID_88777
MTKARQKGVRKVNEMKTKVRETSGDHQREKRENLATQKEVPSGMLRNFTDRATMLSFDFWHVMELHVLCNNGCQVPQSGQAKDACHQTMVPKRN

SEQ ID NO: 180463 - protein, 48 aa, Glycine max
  Coding DNA Sequence Number=SeqID_88778
MELATRSWWEETRSSYTKSTMEETRSRFCAYLTYLPCARLIGHYRTLN

SEQ ID NO: 180464 - protein, 112 aa, Glycine max
  Coding DNA Sequence Number=SeqID_88779
MEIYESDRLGKSVSCHHKKGGDCRTKLHDESRLIQRSFDDNKGDAKKLKYQEQLHDNKDDDLKNQRMSSRCSRLNQEHFKVQEEIRFQDSRIKIQGSSFQESRSRFKTQEKN

SEQ ID NO: 180465 - protein, 20 aa, Glycine max
  Coding DNA Sequence Number=SeqID_88780
MVIFHHGDAAEDKGEEVRGA

SEQ ID NO: 180466 - protein, 153 aa, Glycine max
  Coding DNA Sequence Number=SeqID_88781
MQLLCIPGQDFTCAAAKRQQHSAQQPQYRSPPAEVSVGLCRFDIGIVPTRHPVDSEEPNGTLGFPALVTGLDQSYRMPVPPARSCHCDIGIAPARHPVDSEKSNRVLGFPALITGLCQFYGVPVAPARSLGPLLIKLSSRGTAPPGRRRRNTT

SEQ ID NO: 180467 - protein, 83 aa, Glycine max
  Coding DNA Sequence Number=SeqID_88782
MSDGFCGTHLQIMVRTRGLGCALGQVTGRGLGRGDRDDSDDAPQRRRPTASARRQQVTVTADHVDEPVIPAPDVQMTRWRHQL

SEQ ID NO: 180468 - protein, 191 aa, Glycine max
  Coding DNA Sequence Number=SeqID_88783
  Homolog annotation: Hit_ID=UPI00016621D1; Match level="QueryCoverage =94%, HitCoverage=43%, E-value=7e-12, Identity=29%"; Hit description =UPI00016621D1 related cluster
STLEDPLTIRGLHAVTFRGLHALAFRGLHVLTFRGLHTPPSEDYTSSASEDYTSSPSEDYTGLHVLTFRGLHVHTFRGMHALGFRGLNVLDFRGLHTLALRGLHVLPYRGLDILVIRGLHVLTFSGLHVPTFKGLHVLHFRGLHVLPFRGLHILVFRGLHVLAFSGLHILTLRGLHVLAIRGLHVLTLRGL

SEQ ID NO: 180469 - protein, 165 aa, Glycine max
  Coding DNA Sequence Number=SeqID_88784
MVIHTPFAIQRQASQMACRDHHGHLHPICYPKTIKYDGMRRPSWSSTPFLLSRDNQVRWHVEENYGHPHPFFYLETTKSDGTRRQIMVILTPFTIWRQASPMAYGDHHGHPHPVCYLETIKSDGTWRQIMVICTHFAIQRQASLMAHGDKSWSSAHLLLSIDKQV

SEQ ID NO: 180470 - protein, 42 aa, Glycine max
  Coding DNA Sequence Number=SeqID_88785
MSQLVDIGYMMLALGSGSIIHSMEALVGYSPAKSQIWFLWAV

SEQ ID NO: 180471 - protein, 152 aa, Glycine max
  Coding DNA Sequence Number=SeqID_88786
MVRTRGLGHALGHDTDRGRQRVPVIAADDEPVVLAAEATGASIEADVYADKPMARGDIHDTGADTPADTGTQAAEDEPEGFSGGPRDPSVLTEYADHVADSVWMGEERPELKLSSRGRKVHSLGRLVPAFEGLVVGTGLSPLIACSVDIGDQ

SEQ ID NO: 180472 - protein, 60 aa, Glycine max
  Coding DNA Sequence Number=SeqID_88787
  Subcellular localization annotation: CTP_CleavageSite=27; ConfidenceScore=5.13e-01
MVFGASRLRNTSVNFENLGKIKSKYFRNASVSDSVEILHRSSSFFTVLHPFFVRSSFFNG

SEQ ID NO: 180473 - protein, 69 aa, Glycine max
  Coding DNA Sequence Number=SeqID_88788
MQNSKRDVYLGVYLNGAYWKIVIILPKENLVVWFCSLHNRSNNYLKGIINSALKGLDNTPQPKSKAGAR

SEQ ID NO: 180474 - protein, 81 aa, Glycine max
  Coding DNA Sequence Number=SeqID_88789
MTKLSDRVIRHKIILWHFIEHLQGQIDQPKLHILRAIVKRVQNMWRKWESITTQVDIPSTSTTKDVLSNVLRQRILRRLVP

SEQ ID NO: 180475 - protein, 90 aa, Glycine max
  Coding DNA Sequence Number=SeqID_88790
  Subcellular localization annotation: CTP_CleavageSite=72; ConfidenceScore=5.38e-01
MADRASATTRLHISAAPPFPISKGPFSCLYFSILLNPSVVPPLSLFLLGYASHFISLFELKVLLRLRVVSILSSEVALMNCSAFRLFLAL

SEQ ID NO: 180476 - protein, 251 aa, Glycine max
  Coding DNA Sequence Number=SeqID_88791
  Gene Ontology: Mol. function=phosphoprotein phosphatase activity
  Homolog annotation: Hit_ID=A7UQU7; Match level="QueryCoverage=52%, HitCoverage=23%, E-value=1e-19, Identity=41%"; Hit description=IMP dehydrogenase/GMP reductase, putative
  Pfam annotation: Domain name=DUF1723; Domain location=163-212; Score =64.3; E_value=4.1e-16; Accession=PF08330.1; Description=Protein of unknown function (DUF1723)
MSRTRGLGRAIGRVVGRDRAADEDTGDVPERRRPTASARRLRVHQMTTEGRDMAEDVADMTDDVPEQPEAPEMRADAQGADSGEGSDGDDAAEGFPGGPRDPSVLTSFAEHVAHAVWSGQERPDLKLVSHGRKVTLIGRPVPEIEGLVAATGLSSLIDCSVITGDPGLISAFVERWHSETSTFHLPVGELTITLDDVSSILHLPITGALHSFHALSTEKARFLLTELLEVSAEEARAETALTRGAYVRLGW

SEQ ID NO: 180477 - protein, 69 aa, Glycine max
  Coding DNA Sequence Number=SeqID_88792
MGEAEEAIKEQKATMMKAMMSMKKMMEANAVIVVAISAVAKGEPDAPIWPQANESSNLKYGRQRFGKYG

SEQ ID NO: 180478 - protein, 103 aa, Glycine max
  Coding DNA Sequence Number=SeqID_88793
  Homolog annotation: Hit_ID=A6FJQ2; Match level="QueryCoverage=36%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTCKTTASAKLACLQ

SEQ ID NO: 180479 - protein, 23 aa, Glycine max
  Coding DNA Sequence Number=SeqID_88794
MENFFFAVRRGKTPASTKLAGPQ

SEQ ID NO: 180480 - protein, 259 aa, Glycine max
  Coding DNA Sequence Number=SeqID_88795
MDMNLGSFISSQITLMAQHDSLRLDFLALITALCKTQGVHSDSLTHERLSPAINLAYIKKNYWNLDDLSVTFRGPHKAKGKRSEAPSSFEAPSTLAPKTPTPSSSITPLPLTHIPVIPPAPTQIPLPAPLSIGPLDFIFTPMMLHSMLQSIHRGQSIIMQSLQSLGLSSIMSMEEFDARVAWPGDQPSSSGGGGASAALEPMIEEPLIPVAAAAAKEETTPEETQPSTPVTEPEQPIQDSSIALALDLNEDQPQEEQDV

SEQ ID NO: 180481 - protein, 126 aa, Glycine max
  Coding DNA Sequence Number=SeqID_88796
  Gene Ontology: Mol. function=nucleoside-triphosphatase activity; Cellular component=chloroplast
  Homolog annotation: Hit_ID=Q2PMM5; Match level="QueryCoverage=49%, HitCoverage=2%, E-value=8e-31, Identity=100%"; Hit description =Protein ycf2
MYFIRPLGYGWVFYQRYTLGEGAGRTISKQITHSFDREDHQDFVIRCRIFQFSGLLEYATLGRFLFYCIERPNELGFPYWARSFRDKRIIYDEEDELQENDSEFLQGGTMQYQTRDRSSKEQGFFE

SEQ ID NO: 180482 - protein, 53 aa, Glycine max
  Coding DNA Sequence Number=SeqID_88797
  Subcellular localization annotation: CTP_CleavageSite=13; ConfidenceScore=5.09e-01
MSRYAHSSLLMNMASKKRKAPSTPTQARFDRSRFTSLEAWERYTDIVVLESYY

SEQ ID NO: 180483 - protein, 115 aa, Glycine max
  Coding DNA Sequence Number=SeqID_88798
  Homolog annotation: Hit_ID=A5BP71; Match level="QueryCoverage=65%, HitCoverage=19%, E-value=5e-12, Identity=48%"; Hit description =Putative uncharacterized protein
  Pfam annotation: Domain name=zf-CCHC; Domain location=88-105; Score =18.9; E_value=0.0021; Accession=PF00098.14; Description=Zinc knuckle
MVIIVNAEACGYVSMNYYQYIDVVYTNEHILKAYSAQWWPLGNEAAIPPSNDAWTLIPDPTTIRAKGRPKSTRIRNEMDWVEPSEHRQKCSRCGAEGHNRRRCPMQSEHGSCSNH

SEQ ID NO: 180484 - protein, 89 aa, Glycine max
  Coding DNA Sequence Number=SeqID_88799
MVYKNSHSIRYSLSLEEILLSSSSGERMRILFIGQGCRFRVKLPYYFHEARVTMMIWKQRAKLVMHTARWVLKHPVYGIVILRLGIYAS

SEQ ID NO: 180485 - protein, 375 aa, Glycine max
  Coding DNA Sequence Number=SeqID_88800
  Gene Ontology: Mol. function=carbon-sulfur lyase activity; Cellular component=vacuole
  Homolog annotation: Hit_ID=A7QX63; Match level="QueryCoverage=95%, HitCoverage=93%, E-value=1e-115, Identity=50%"; Hit description =Chromosome undetermined scaffold_213, whole genome shotgun sequence
  Pfam annotation: Domain name=Alliinase_C; Domain location=91-364; Score=429.4; E_value=5.2e-126; Accession=PF04864.4; Description =Allinase, C-terminal domain
  Pfam annotation: Domain name=EGF_alliinase; Domain location=32-89; Score=117.0; E_value=5.4e-32; Accession=PF04863.4; Description =Alliinase EGF-like domain
  Pfam module annotation: Pfam domain module=Alliinase_C::EGF _alliinase; Domain location=91-364::32-89
MATSLQKSRSATKKLLEDFTKKRRLESPKEQPTWSTRAAEEAEAVAAIPCSGHGRAYLDGLILKDMNKSRCECNSCYAGSDCSQFLSDCPANADGGDPYFMEPFWMQHAASSAILVSGWHRMSYSYSDGSVISQLLVEYIKKVHGIVGNAITEGKYIVFGSGSTQLLNAAVYALSPDPSMSPAKVVATAPYYPFVTSPNNPDGKLNKGILKGSDVKTIYDRAYYWPHFTAIPSPADDDLMLFSISKLTGHAGSRFGAMGVSRDVQLRVLKLLDVATEGDGKEIFQFTYSTMRDRWIRVRDPSPAYAWLKCERQQDMNCYETLKAAGIIGRKGSNFSADERYVRLSLIKSQDDFEILTNKLRSLVAKEWESNPASI

SEQ ID NO: 180486 - protein, 185 aa, Glycine max
  Coding DNA Sequence Number=SeqID_88801
MDVMPFLGEFHANEIFPRGNNASFIALIPKRQSAFIEGRHFFQSVVTANEAIDEARRSVLLVTGLWDYIYSLSTTVSAFSVASDITAEGFTVLSFLDEVSMIYKNVGLSLTQPQKLVQKVRTDLLPLIWLYSRQVIMSLRCLVSLLLVEGHPLLEPPETGHCLLVPRALLARKTPCLSTLIEILV

SEQ ID NO: 180487 - protein, 146 aa, Glycine max
  Coding DNA Sequence Number=SeqID_88802
  Gene Ontology: Mol. function=protein dimerization activity
  Homolog annotation: Hit_ID=A5ASU7; Match level="QueryCoverage=59%, HitCoverage=17%, E-value=2e-15, Identity=48%"; Hit description =Putative uncharacterized protein
IPLEHKRLHDLVFVKYNQQLKQRYNARDEIDPISLNDIDVCNEWLVEEMDQDDDNDAGNDLVFEDDDALNWTTVYQASGVGECRMKQKAVQENDEDLDFEENIDLESEEEEIMVNFEASNGEEGEGDAPLPYDNNEDDYVGIGEDD

SEQ ID NO: 180488 - protein, 174 aa, Glycine max
  Coding DNA Sequence Number=SeqID_88803
MVEWRSCQGRLEAAPVWLSGWAKQSFPQLPFSSCVWMLISTATLLSESGVLWGGEKHECRECIRIFQEIRKLYLLGNCHGFGNSLEHNTVGCRCILCLYKMFTPPTKTCTDRLSGRHAAACSTASVTDLLLDADRSYCPPKLCGRYQLSAAMAFLSWFLSSASSLFNFWLFPSL

SEQ ID NO: 180489 - protein, 54 aa, Glycine max
  Coding DNA Sequence Number=SeqID_88804
MSHVRVITNGERQKRKAKGSEILFLSSFKEIKVHRKEVPMEKDTSLPDGERHTS

SEQ ID NO: 180490 - protein, 2029 aa, Glycine max
  Coding DNA Sequence Number=SeqID_88805
  Gene Ontology: Mol. function=transmembrane receptor activity; Cellular component=intrinsic to membrane; Biological process=innate immune response
  Homolog annotation: Hit_ID=A7Q6Z7; Match level="QueryCoverage=98%, HitCoverage=98%, E-value=0.0, Identity=35%"; Hit description =Chromosome chr5 scaffold_58, whole genome shotgun sequence
  Pfam annotation: Domain name=LRR_1; Domain location=1395-1420; Score =9.2; E_value=6.1; Accession=PF00560.24; Description=Leucine Rich Repeat
  Pfam annotation: Domain name=LRR_1; Domain location=1473-1495; Score =0.3; E_value=2.7e+02; Accession=PF00560.24; Description=Leucine Rich Repeat
  Pfam annotation: Domain name=LRR_1; Domain location=1497-1518; Score =0.8; E_value=2.1e+02; Accession=PF00560.24; Description=Leucine Rich Repeat
  Pfam annotation: Domain name=LRR_1; Domain location=1520-1542; Score =10.0; E_value=4.2; Accession=PF00560.24; Description=Leucine Rich Repeat
  Pfam annotation: Domain name=LRR_1; Domain location=1544-1565; Score =8.4; E_value=8.5; Accession=PF00560.24; Description=Leucine Rich Repeat
  Pfam annotation: Domain name=LRR_1; Domain location=1567-1589; Score =7.5; E_value=12; Accession=PF00560.24; Description=Leucine Rich Repeat
  Pfam annotation: Domain name=LRR_1; Domain location=527-552; Score =2.3; E_value=1.2e+02; Accession=PF00560.24; Description=Leucine Rich Repeat
  Pfam annotation: Domain name=LRR_1; Domain location=610-631; Score =11.3; E_value=2.4; Accession=PF00560.24; Description=Leucine Rich Repeat
  Pfam annotation: Domain name=LRR_1; Domain location=633-658; Score =6.9; E_value=16; Accession=PF00560.24; Description=Leucine Rich Repeat
  Pfam annotation: Domain name=LRR_1; Domain location=683-703; Score =1.0; E_value=2e+02; Accession=PF00560.24; Description=Leucine Rich Repeat
  Pfam annotation: Domain name=LRR_1; Domain location=704-727; Score =5.1; E_value=34; Accession=PF00560.24; Description=Leucine Rich Repeat
  Pfam annotation: Domain name=LRR_1; Domain location=733-758; Score =6.7; E_value=17; Accession=PF00560.24; Description=Leucine Rich Repeat
  Pfam annotation: Domain name=NACHT; Domain location=1049-1203; Score=- 19.6; E_value=0.002; Accession=PF05729.3; Description=NACHT domain
  Pfam annotation: Domain name=NB-ARC; Domain location=1013-1305; Score= 134.6; E_value=2.7e-37; Accession=PF00931.13; Description=NB-ARC domain
  Pfam annotation: Domain name=NB-ARC; Domain location=144-438; Score =101.4; E_value=2.8e-27; Accession=PF00931.13; Description=NB-ARC domain
  Pfam annotation: Domain name=TIR; Domain location=14-147; Score =182.1; E_value=1.4e-51; Accession=PF01582.11; Description=TIR domain
  Pfam annotation: Domain name=TIR; Domain location=853-987; Score =154.1; E_value=3.7e-43; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::NACHT::NB- ARC::NB-ARC::TIR::TIR; Domain location=1395-1420::1473-1495::1497 -1518::1520-1542::...
  Pfam module annotation: Domain location=1544-1565::1567-1589::527 -552::610-631::633-658::683-703::704-727::733-758::1049-1203::1013 -1305::144-438::14-147::853-987
MSSSSISYGWKYDVFLSFRGSDTRHGFTGHLYKALLDRGIYTFIDNEELQRGEEITPSLVKAIEDSRIAILVFSKNYASSTFCLDELVHILACVKEKGTMVLPVFYEVDPSDVRHQRGSYEEALNKHKEKFNDDEEKLQKWRIALRQAANLSGIYEARTLQPFAVSGVRHASVSVSDTDTTPVGIHGIGGVGKTTIAREVYNLIADQFEWLCFLDNVRENSIKHGLVHLQKTLLSKTIGESSIKLGSVHEGIPIIKHRFLLKKVLLVVDDVDDLDQLQAIVGGTDWFGSASRVIITTRDKHLLTCHGVTSTYEVDGLNKEEALKLLSGTAFKIDKVDPCYMRILNRVVTYASGLPLALMVIGSNLFGKSIEEWESSIDQYERIPNKKIQDVLKVSFDSLEEDEQQIFLDIACCFKGYALTYVKEILSTHHNFCPEYAIGVLIDKSLIKVDADRVILHDLIEDMGKEIVRQESPREPGKRSRLWFPDDIVEVLEENKGISRIQMITLDYLKYEAAVEWDGVAFKEMNNLKTLIIRSGCLHEGPIHLPNSLRVLEWKVYPSPSLPIDFNPKKLVILKFPYSCLMSLDVLKSKKLSYCHSLESFPEVLGKMENVTSLDIYGTVIKELPFSIQNLTRLRRLELVRCENLEQIRGVPPNLETFSVKDCSSLKDLDLTLLPSWTKERHLLKELRLHGNKNLQNIKGIQLSIEVLSVEYCTSLKDLDLTLLPSWTKERHLLKELHLHGNKNLQKIKGIPLSIEVLSVEYCTSLKDVDVTLPPACTQECCILSTLFFDACGMNLHEIHGIPSIIRTCSARGCQYSTSVPTGMLLNKFLNHMAERAEPSSSSFADKWNFYDVFLSFRGKDTRQNFTGHLYNSLFKNGILTFIDDKGLRRGEEITPALLNAIKNSRIAIIVFSEDYASSTYCLDELVTILESFKEEEGRSIYPIFYYVDPSQVRHQTGTYSDALAKHEERFQYDIDKVQQWRQALYQAANLSGWHFHGSQPEYKFILKIVKEISEKIDCVPLHVADKPIGLEYAVLAVKSLFGLESDVSMIGIYGIGGIGKTTIARAVYNMSFSKFEGICFLPDIREKAINKHGLVELQEMLLSETLKEKDIKVGHVNKGIQIIKQRLQQKKVLLILDDVDKLEQLKVLAGQYDWFGSGSIIIITTRDKHLLATHEVVKLYEVKPLNDEKSLELFDWHAFKNNKTDPSYVTISNRAVSYACGLPLALEVIGSDLFGKSLNECNSALDKYERIPHEKIHEIFKVSYDGLEENEKGIFLDIACFLNTFKVSYVTQMLHAHGFHPEDGLRVLVDKSLVKIDASGFVRMHDLIRDTGIEIVRQESTVEPGRRSRLWFKEDIVHVLEENTGTDKIEFIKLEGYNNIQVQWNGKAFQKMKNLRILIIENTTFSTGPEHLPNSLRFLDWSCYPSPSLPSDFNPKRVEILKMPESCLKIFQPHKACCKVLTHLPSLREVPLVTFLCLDYCSNLVKIDCSIGFLDKLLTLSAKGCSKLKILAHCIMLTSLEILDLGDCLCLEGFPEVLVKMEKIREICLDNTAIGTLPFSIGNLVGLELLSLEQCKRLIQLPGSIFTLPKVEVIFGFRHWRYLFFEENQDGKELSLEVFPKAILVCHLDPRHYHHLDLYYLYMSPNNVIQVCSPNLYMLCDFDLLFQKLALGVEKDWFRRCRKWSMNFSFRKKFPKIAHEWNEAEILFELKCPAPSSVEAMWAHNISMEIIDWTLIGVYNQGNIKDDIKFKMPMSTFLLPNREPPSLPDQPEVYRKIVKEVSEKIDCIPLHVADNAIGLEYSVQEVKSLLGLESDEVNMIRIYGISGIGKTTIACVVYNLIFSHFEGVWFLPDIREKTINKHGLVQLQEMLPSEILKEKYIKDNHCHHKRDKHLLATHGVINLYEHAFKNNKVDPCYVNISNREALDVHGLPLALEAIGSHGIFLDISNIFKTKEVGYVTRMLHAHDFHAEDGLRVLVDRSLIKIDASGGLFFHGCRQKNWRHRCSAIADGEKYAELEGAATGTGETC

SEQ ID NO: 180491 - protein, 872 aa, Glycine max
  Coding DNA Sequence Number=SeqID_88806
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=93%, HitCoverage=66%, E-value=1e-168, Identity=49%"; Hit description =Functional candidate resistance protein KR1
  Pfam annotation: Domain name=LRR_1; Domain location=265-290; Score =3.1; E_value=81; Accession=PF00560.24; Description=Leucine Rich Repeat
  Pfam annotation: Domain name=LRR_1; Domain location=333-354; Score =4.5; E_value=45; Accession=PF00560.24; Description=Leucine Rich Repeat
  Pfam annotation: Domain name=LRR_1; Domain location=356-378; Score =8.0; E_value=10; Accession=PF00560.24; Description=Leucine Rich Repeat
  Pfam annotation: Domain name=LRR_1; Domain location=380-401; Score =9.6; E_value=5.2; Accession=PF00560.24; Description=Leucine Rich Repeat
  Pfam annotation: Domain name=LRR_1; Domain location=403-425; Score =12.0; E_value=1.8; Accession=PF00560.24; Description=Leucine Rich Repeat
  Pfam annotation: Domain name=LRR_1; Domain location=427-448; Score =12.9; E_value=1.2; Accession=PF00560.24; Description=Leucine Rich Repeat
  Pfam annotation: Domain name=LRR_1; Domain location=450-471; Score =6.4; E_value=20; Accession=PF00560.24; Description=Leucine Rich Repeat
  Pfam annotation: Domain name=LRR_1; Domain location=504-527; Score =6.5; E_value=19; Accession=PF00560.24; Description=Leucine Rich Repeat
  Pfam annotation: Domain name=LRR_1; Domain location=529-550; Score =12.6; E_value=1.4; Accession=PF00560.24; Description=Leucine Rich Repeat
  Pfam annotation: Domain name=LRR_1; Domain location=552-577; Score =4.0; E_value=55; Accession=PF00560.24; Description=Leucine Rich Repeat
  Pfam annotation: Domain name=LRR_1; Domain location=602-627; Score =4.9; E_value=37; Accession=PF00560.24; Description=Leucine Rich Repeat
  Pfam annotation: Domain name=NB-ARC; Domain location=1-177; Score= -101.0; E_value=0.00079; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NB-ARC; Domain location=265-290::333-354::356-378::380-401::403-425::427-448::450 -471::504-527::...
  Pfam module annotation: Domain location=529-550::552-577::602-627::1 -177
MKILLFLDDVDDLDQLRAIAGGTDWFGSGSRIIITTRDRHLLTCHGVKNKYEVHGLNKEEALKLLTWSAFKIDKVDPCYVNILNRVVTYTSGLPLALEVIGSNLSGKRKEVWESALDQYERIPDKKIQDILKVSFDSLQEDEHKIFLDIACCFKGYDFTYVKEVLSIHHGFCPKYAIGVLIDKSLLCRRSSYLTMHDLIEDMGKEIVRQESPGEPGKRSRLWLHEDIVQVLEENEGTSRIQMIILDCLKYEVVQWDGMASKEMNNLKTLIVKGGCFSNGPKHLPNSLRVLDWWGYPSRSFPSDFQPKKLVRLQLPYSHLMCLNLLSSNKMFVNMSVLNFNDSPYITEIPNLCCVPNLQKLSCRYCDNLIKIHKSVGFLDKLEVLDADKCSKLSRFPPLLKLTSLKELGLSCCPSLEIFPKILGKMENVTSLYISYTPIKELPFSIQNLTRLQRLELVACGIVQLPSSIYAMQELRHLIVKACKGLLLPKEDKGEVQTNSLVFKNTIVLDLSKCNISDKSLQRGLHLFANMRELYLSYNDFTILPASIKECHVLTKIYLKGCENLQEIRGVPPNLEGFSVIECSLLKDLDLTLLPTENKKRFFLRMLYVTGCKNLKKIEGIPQRIEVLRVTFCSSLKIVEFTLHPAGTQGFHLRREIVLDNCENLQEIKGIPFGIQYFSARDCHSLSSECRSMLLSQELHETRECGVFYLAGTRIPEWFHHCINGSSISFWFRNNFPSISLGVVAGPKSYLNVHSRFRININNNITFNLGIRNHLVQVRHHRVELASIPIVFWGNKWNRVECTVYPLQEFIKQIGIHVLEQGNNMEDIQFTNPLSSSGEMNKKRKKRGTRRPAPPQVLEGPLSRLIFKVNSVL

SEQ ID NO: 180492 - protein, 36 aa, Glycine max
  Coding DNA Sequence Number=SeqID_88807
MATTSDVKNEGKGKGDSSYSLACVAISTVQIREYAS

SEQ ID NO: 180493 - protein, 1149 aa, Glycine max
  Coding DNA Sequence Number=SeqID_88808
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=99%, HitCoverage=95%, E-value=0.0, Identity=53%"; Hit description =Functional candidate resistance protein KR1
  Pfam annotation: Domain name=LRR_1; Domain location=559-584; Score =6.8; E_value=17; Accession=PF00560.24; Description=Leucine Rich Repeat
  Pfam annotation: Domain name=LRR_1; Domain location=602-622; Score =0.2; E_value=2.8e+02; Accession=PF00560.24; Description=Leucine Rich Repeat
  Pfam annotation: Domain name=LRR_1; Domain location=627-646; Score =7.3; E_value=13; Accession=PF00560.24; Description=Leucine Rich Repeat
  Pfam annotation: Domain name=LRR_1; Domain location=650-672; Score =9.0; E_value=6.6; Accession=PF00560.24; Description=Leucine Rich Repeat
  Pfam annotation: Domain name=LRR_1; Domain location=674-695; Score =7.3; E_value=13; Accession=PF00560.24; Description=Leucine Rich Repeat
  Pfam annotation: Domain name=LRR_1; Domain location=696-718; Score =12.6; E_value=1.4; Accession=PF00560.24; Description=Leucine Rich Repeat
  Pfam annotation: Domain name=LRR_1; Domain location=720-741; Score =11.8; E_value=2; Accession=PF00560.24; Description=Leucine Rich Repeat
  Pfam annotation: Domain name=LRR_1; Domain location=743-764; Score =0.4; E_value=2.5e+02; Accession=PF00560.24; Description=Leucine Rich Repeat
  Pfam annotation: Domain name=LRR_1; Domain location=798-821; Score =6.3; E_value=20; Accession=PF00560.24; Description=Leucine Rich Repeat
  Pfam annotation: Domain name=LRR_1; Domain location=823-844; Score =10.2; E_value=3.9; Accession=PF00560.24; Description=Leucine Rich Repeat
  Pfam annotation: Domain name=LRR_1; Domain location=846-868; Score =3.6; E_value=66; Accession=PF00560.24; Description=Leucine Rich Repeat
  Pfam annotation: Domain name=LRR_1; Domain location=896-921; Score =4.3; E_value=49; Accession=PF00560.24; Description=Leucine Rich Repeat
  Pfam annotation: Domain name=NACHT; Domain location=213-364; Score= -7.3; E_value=0.00022; Accession=PF05729.3; Description=NACHT domain
  Pfam annotation: Domain name=NB-ARC; Domain location=175-470; Score =144.1; E_value=4e-40; Accession=PF00931.13; Description=NB-ARC domain
  Pfam annotation: Domain name=TIR; Domain location=14-147; Score =179.9; E_value=6.6e-51; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::NACHT::NB- ARC::TIR; Domain location=559-584::602-622::627-646::650-672::674 -695::696-718::...
  Pfam module annotation: Domain location=720-741::743-764::798 -821::823-844::846-868::896-921::213-364::175-470::14-147
MSSSSFSYGWKYDVFLSFRGSDTRHGFTGHLYKALCDRGIHTFIDDEELQRGEEITPLLVKAIEGSRIAIPVFSKNYASSTFCLDELVHILACVKEKGTLVLPVFYEVDPSDVRHQRGSYKDALNSHKERFNDDQEKLQKWRNSLSQAANLAGYHFKHGIENEYEYDFIGNIVKEVSQKINRTVLHVADYTVGLEFRMKEVNSLLNFKSGGVHMVGIHGVGGVGKTTLARAIYNLIADQFEVLCFLDNVRENSIKNGLVHLQETLLSKTIGEKGIKLGSINEAIPIIKHRLHRKKVLLVLDDVDKPDQLHAIAGGMDWFGSGSRVIITTRNRHLLTCHGVESIYEVHGLNHKEALELLSWSAFKTGKVDPCYVNILNRAVTYASGLPLALKVIGSNLIGKRIEEWESALDQYQRIPNKDIQDILKVSFDSLEEYEQNIFLDIACCFKGYRLSEVKEILFSHHGFCPQYGIGVLIDKSLIKIDCFGNVTLHDLIEDMGKEIVRRESPEEPENRSRLWCPEDIVQVLEENKGTSRIQMIALDYLNYEEVEWDGMAFKEMNNLKTLIIRGGCFTTGPKHLPNSLRVLEWRRYPSPSLPFDFNPKKLVSLQLPDSCLTSLNWLNSKNRFLNMRVLNFNQCHYITEIPDVCGAPNLQELSFEYCENLIKIHVSVGFLDKLKILDADGCSKLTSFPPMKLTSLEELKLSFCANLECFPEILGKMENVTSLDIKDTPIKELPSSIQHLSRLQRIKLKNGGVIQLPSTFFAMKELRYLLVNQCEGLLLPVENEGKEQMSSMVVENTIGYLDLSHCHISDKFLQSGLPLFSNVKELYLNGNDFTILPACIQEFQFLTELYLEACENLHEIGWIPPNLEIFAVIDCTSLKELDLTLLPTWNKECCLLRKLLLCGCRNLEKLKGIPLNIEELIVESCNSLKDLDLTLPPSCTRQCRILSKLILDSCMDFEEIKGIPSDIGVFSARECSSLTSECRSMLLNEELHEADGFKEFILPGTRIPEWFECTNESSICFWFRDKFPAISVCVVSEPMDSDVTFSFIINGVEHLPKGAISLDLCVDHLWIIDHIEELFNDCVLSENEWNHVVCTTSWVPQPIKQIGIHVIKQGSNLEDIQFTNPLLSKEDPDFRIQHDDSRKRKRQE

SEQ ID NO: 180494 - protein, 236 aa, Glycine max
  Coding DNA Sequence Number=SeqID_88809
  Gene Ontology: Mol. function=binding; Biological process=protein amino acid phosphorylation
  Homolog annotation: Hit_ID=Q9FIF7; Match level="QueryCoverage=43%, HitCoverage=19%, E-value=2e-13, Identity=42%"; Hit description =Genomic DNA, chromosome 5, P1 clone:MNC17
  Pfam annotation: Domain name=PPR; Domain location=6-40; Score=25.4; E_ value=0.00022; Accession=PF01535.11; Description=PPR repeat
  Pfam annotation: Domain name=PPR; Domain location=63-97; Score=26.0; E_value=0.00014; Accession=PF01535.11; Description=PPR repeat
  Pfam module annotation: Pfam domain module=PPR::PPR; Domain location =6-40::63-97
MVPNTMTYSSLVDGLCKSGRKSYALDLIDEIHRRRQPADGGRLKNAQEFFQHLLVKGYCIDVWTYTVMISGLCKEGMLDEALAMKMRMIRPCSKNNPRIVRSVPTITANLPNPHSYSHDSNLRKAIISLLHKNRKNPKHVQSIHCHAVKTRTSQDPFVAFELLRVYCKVNYIGHAIKLFRCIQNPNVYLYTSLIDGFVSFGSYPPLRLEELNYLTQFEGYLPTEVALHDIDDEQKE

SEQ ID NO: 180495 - protein, 988 aa, Glycine max
  Coding DNA Sequence Number=SeqID_88810
  Gene Ontology: Mol. function=binding; Cellular component=nucleus; Biological process=activation of protein kinase C
  Homolog annotation: Hit_ID=A7PLK6; Match level="QueryCoverage=56%, HitCoverage=95%, E-value=1e-126, Identity=41%"; Hit description =Chromosome chr7 scaffold_20, whole genome shotgun sequence
  Pfam annotation: Domain name=PPR; Domain location=579-613; Score =25.6; E_value=0.00018; Accession=PF01535.11; Description=PPR repeat
  Pfam annotation: Domain name=PPR; Domain location=683-717; Score =46.1; E_value=1.2e-10; Accession=PF01535.11; Description=PPR repeat
  Pfam annotation: Domain name=PPR; Domain location=718-752; Score=2.9; E_value=3.6; Accession=PF01535.11; Description=PPR repeat
  Pfam annotation: Domain name=PPR; Domain location=754-788; Score=6.5; E_value=1.3; Accession=PF01535.11; Description=PPR repeat
  Pfam annotation: Domain name=PPR; Domain location=820-854; Score=0.7; E_value=6.4; Accession=PF01535.11; Description=PPR repeat
  Pfam module annotation: Pfam domain module=PPR::PPR::PPR::PPR::PPR; Domain location=579-613::683-717::718-752::754-788::820-854
MAAFSWDQLFEVFSCLPAKAIHRFKCTSKTLAKLLEETCFASKQAQNSMKKDDTCFFLQQETPHYNEKVEVELHPLPGNQLSSGVSHDVLRFLSNSTRVLASTKGLILCNHATSHTPIELFICNPSTKTWLPIPTPKEVQKRYDAADPTMLLLESSYDGCDDDYMVFHLELESTTDWSSNYACKIFKPKEGSWKTMETSFFVGGRNMKFNMPVCCNRAIHFISDCGPYLTKRSCFFNPYVMSYNLESGTSTMLRVPKDARRGSHDSSCDMRIFIWGKAYTAQCSICLVRLRKSVFTVWILTDYEPSRWLRILKVRTKGMGLREENPKITGFAVMNGDLLVFATETRVYSYGLTEENYMRVEEICQHRFQSNVCFTSYLDTLRFCGRGAEMCDLNPDEQRAFGWEYLTKEAQAAGKNGNRAHEMIISTVPITTANLPNPRSNSHDSNLRKAIISLLHKNRKNPKHVQSIHGHAIKTRTSQDPFVAFELLRVYCKVNYIDHAIKLFRCTQNPNVYLYTSLIDGFVSFGSYTDAKWFGSTFWLITMQSQRSIGLKLVELYGKCGVLEDARKMFDGMPERNVVACTVMIGSCIDCGMVEEAIEVFNEMGTRNTVCWTMVIDGLVRNGEFNRGFWELWLGRWIHAYMRKCGVEVNRFVAGALINMYSRCGDIDEAQSLFDGVRVKDVSTYNSMIGGLALHGKSIEAVELFSEMLKERVRPNGITFVGVLNACSHGGLVDLGGEIFESMEMIHGIEPEVEHYGCMVDILGRVGRLEEAFDFIGRMGVEADDKMLCPLLSACKIHKNIGIGEKVAKLLSEHYRIDSGSFIMLSNFYASLERWSYAAEVREKMEKGGIIKEPGCSSIEVNNAIHEFLSGDLRYPERKRTYKRLEELNYLTKFEGYLPATKVALHDIDDEQKELALAVHSERLAICYGLVSTEAYTTLRVGKNVRICDDCHAMNKLIAKITRRKVVVRDRNRFHHFKNGECSCKDYW

SEQ ID NO: 180496 - protein, 89 aa, Glycine max
  Coding DNA Sequence Number=SeqID_88811
MGIGAGEVPKENTPTHGFREPIQFNIFIDDLRPHSKQLLDASVDGKIKLRTSEEAMELIENMATNDHAMKLIENRDKVTLFFLCIHLYA

SEQ ID NO: 180497 - protein, 501 aa, Glycine max
  Coding DNA Sequence Number=SeqID_88812
  Gene Ontology: Mol. function=sucrose transmembrane transporter activity; Cellular component=integral to plasma membrane; Biological process=sucrose transport
  Homolog annotation: Hit_ID=A3DSX5; Match level="QueryCoverage=92%, HitCoverage=97%, E-value=0.0, Identity=74%"; Hit description =Putative sucrose transport protein SUT3
  Pfam annotation: Domain name=MFS_1; Domain location=17-438; Score =23.1; E_value=0.001; Accession=PF07690.7; Description=Major Facilitator Superfamily
  Pfam annotation: Domain name=PUCC; Domain location=42-479; Score= -227.3; E_value=0.053; Accession=PF03209.6; Description=PUCC protein
  Pfam annotation: Domain name=Sugar_tr; Domain location=14-451; Score=- 42.9; E_value=2.6e-07; Accession=PF00083.15; Description=Sugar (and other) transporter
  Pfam module annotation: Pfam domain module=MFS_1::PUCC::Sugar_tr; Domain location=17-438::42-479::14-451
MEEPQPGPNPLRKMILVSSMAAGIQFGWALQLSLLTPYVQTLGVPHAWASFIWLCGPISGLLVQPIVGYSSDRCQSRFGRRRPFILAGSLAVAIAVFLIGYAADIGHAAGDNLTQKTRPRAVAIFVIGFWILDVANNMLQGPCRAFLGDLAAGDEKKTKAANAFFSFFMAVGNILGYAAGSYDGLHRLFPFTETEACNVFCANLKSCFFFAIVLLVVLTTLVLITVKETPYTPKAEKETKDAEKTHFSCFCGELCLAFKGLKRPMWMLMLVTAVNWIAWFPYFLFDTDWMGREVYGGDVGQKAYDSGVHAGSLGLMLNAMVLAVMSLAIEPLGRVVGGIKWLWGIVNILLAICLGMTVLITKIAEHERLLNPALVGNPSLGIKVGSMVFFSVLGIPLAITFSVPFALASIYSSTSGAGQGLSLGVLNIAIVVPQMIVSTISGPWDALFGGGNLPAFVLGAVAAVVSAILAVLLLPTPKKADEGFTCFTFNLALIWEKELSL

SEQ ID NO: 180498 - protein, 168 aa, Glycine max
  Coding DNA Sequence Number=SeqID_88813
  Homolog annotation: Hit_ID=A7QCI3; Match level="QueryCoverage=27%, HitCoverage=28%, E-value=5e-15, Identity=78%"; Hit description =Chromosome chr12 scaffold_78, whole genome shotgun sequence
MAPFNLGFSKVDLTQLADIGEIDAKIGKVDSWNMGEWLWELQWRRSWFQWEQSVVQQMLDTIGEFQPKQNKLDDWAWNLNVEKKYVVRELVYEILITEETMKDEEFFKQMKKLPIPSKELKSAMEEHMDLMADLVQKLSSDLRAGFRPAYDNFIGFFHAIDWKVALPF

SEQ ID NO: 180499 - protein, 299 aa, Glycine max
  Coding DNA Sequence Number=SeqID_88814
  Homolog annotation: Hit_ID=A5AEK3; Match level="QueryCoverage=50%, HitCoverage=94%, E-value=3e-16, Identity=36%"; Hit description =Putative uncharacterized protein
MDTEEFSFPRISDTCAHNIDSPPLWNLSPAASPNPYYQGNKRGENECFGAKLVAAEVHRKSFSCVENSRKRFGLEEDEDRMDMLWEDFNEELYSTTTTVSATSSSRELRYAPALTVAKTNNSSLFPTKNNKPSMVVIVRVMRKLFSINNSQGHSIVIFSHGVAAEDKGEEEKFHHQESVLDKKLREKASMEEENEREQGKLPRIVNAGPLDVDSVGVVIGEVKAKEVDLGGVDFRFGERNITTVGKANSTFAARYDVGEAKVNGVVSRNDASNKEKKFSSLSMEKKKKLLIIKKGKIGQ

SEQ ID NO: 180500 - protein, 258 aa, Glycine max
  Coding DNA Sequence Number=SeqID_88815
MGEGCCTQPYPCICKEAVSGFEPMTNKSPRHNFTAAPGLALNGVPEDLDFSQYTPSRPTLLGLGVWITMEALDLVCMGCVLAGIELGAEGDSEEDVLMVVDSKRVVSAAVRVAVAPSRRRPPSSAADRLHSGHHFNRRLQGFVRLEERNPTQLIAWPEAPPRAASVLTKHRRLTTTRRLPLAGIARVCCRPSSRTLRSPYQPLVFGFGTSLRDLCFHFPKLPPSQQQSSTGKITYPGLLQWNCDFLGKGIMTILKKML

SEQ ID NO: 180501 - protein, 333 aa, Glycine max
  Coding DNA Sequence Number=SeqID_88816
  Gene Ontology: Mol. function=sequence-specific DNA binding; Cellular component=nucleus; Biological process=regulation of transcription, DNA-dependent
  Homolog annotation: Hit_ID=A7PI38; Match level="QueryCoverage=87%, HitCoverage=97%, E-value=6e-93, Identity=62%"; Hit description =Chromosome chr13 scaffold_17, whole genome shotgun sequence
  Pfam annotation: Domain name=GATA; Domain location=239-274; Score =62.4; E_value=1.6e-15; Accession=PF00320.18; Description=GATA zinc finger
MIGNFIDDIDCGNFFDHIDDLLEFPDDAAAADTSAAAPVPPPANFWSAESDSLPATDTVFSDNSVTDLSAELSVPYEDIMQLEWLSNFVEDSFSGGSMTMKKEEPQCTTTKEDIAPAQFQTASPVSVLESSSFCSGEKAGTEINISVPCGRARSKRPRPATFNPNPVMQLISPASSTGENTQHNAANTSKASSDSENFAESVIKAPKQASGEHKKKKKIKVTFPSGQERNAPSQAIRKCLHCEITKTPQWRAGPMGPKTLCNACGVRYKSGRLFPEYRPAASPTFCAAMHSNSHKKVLEMRNKTGTKSGFATVSAASPELIPNTNSSLTLEYM

SEQ ID NO: 180502 - protein, 33 aa, Glycine max
  Coding DNA Sequence Number=SeqID_88817
MVRIEREERFERSMMRDATEMRMERKSQLRGGI

SEQ ID NO: 180503 - protein, 182 aa, Glycine max
  Coding DNA Sequence Number=SeqID_88818
  Gene Ontology: Mol. function=superoxide dismutase activity; Cellular component=cytoplasm; Biological process=superoxide metabolic process
  Homolog annotation: Hit_ID=Q9AR76; Match level="QueryCoverage=98%, HitCoverage=99%, E-value=9e-69, Identity=71%"; Hit description =Superoxide dismutase [Cu-Zn]
  Pfam annotation: Domain name=Sod_Cu; Domain location=8-180; Score =261.3; E_value=2e-75; Accession=PF00080.11; Description=Copperzinc superoxide dismutase (SODC)
MEAAKGTVKGVAIIIGDNNIRGSLQFLQHPNGTTHVTGRVTGLSQGFHGFHIHAFGDTTNGCNSTVLTSSTPGPHFNPFKKDHGAPSDDKRHAGDLGNIAAGPDGVAEISIRDRQIPLTGVHSIIGRAVVVHADPDDLGRVLKNHKEAPLYICILGGHELSKTTGNAGARVACGIIGLQSSV

SEQ ID NO: 180504 - protein, 552 aa, Glycine max
  Coding DNA Sequence Number=SeqID_88819
  Gene Ontology: Mol. function=SNAP receptor activity; Cellular component=membrane; Biological process=intracellular protein transport
  Homolog annotation: Hit_ID=A7Q015; Match level="QueryCoverage=44%, HitCoverage=80%, E-value=9e-88, Identity=71%"; Hit description =Chromosome chr8 scaffold_41, whole genome shotgun sequence
  Pfam annotation: Domain name=SKI; Domain location=100-252; Score =52.4; E_value=1.6e-12; Accession=PF01202.13; Description=Shikimate kinase
  Pfam annotation: Domain name=SNARE; Domain location=473-530; Score =45.9; E_value=1.4e-10; Accession=PF05739.10; Description=SNARE domain
  Pfam annotation: Domain name=Syntaxin; Domain location=297-404; Score= 96.0; E_value=1.2e-25; Accession=PF00804.16; Description=Syntaxin
  Pfam module annotation: Pfam domain module=SKI::SNARE::Syntaxin; Domain location=100-252::473-530::297-404
  Subcellular localization annotation: CTP_CleavageSite=81; ConfidenceScore=5.60e-01
MEKVSPCHTNTPLPLPNRPSNFLQFKHQTFFFKFPNPNPNPNPNPNPNLVRLRRLNCSVSDGTVPSSVGATDSSSLAVKKKAAEVSSELKGTSIFLVGLKSSFKTSLGKLLADALRYYYFDSDNLVEEAVGGALAAKSFRESDEKGFYECETEVLKQLSSMGRLVVCAGNGAVTSSTNLALLRHGISLWIDVPLDFVARDVIEDQSQFAPSELSISGSYPEDELGALYDRYRVGYATADAIISVQKVASRLGCDNLDEITREDMALEESFEIPRGQGHGGGGDIELGEYARNSGDLGLDSFFKKVQELDKQYAKLDKLLKKLQDAHEESKAVTKAPSMKAIKQRMEKDVDEVKKTAHYLKTKIEELDKENLANRQKPGCGKGSGVDRSRTATTISLKKKLKDKMAEFQTLREAIHQEYREVVERRVFTVTGTRADEETIDRLIETGDSEQIFQKAIQEQGRGQIMDTLAEIQERHEAVRDVERKLLDLQQIFLDIAVLVDAQGDMLDNIETQVGWVVKKEGKAEKVAGFKCSGSRAARQQCPPEGKETTKEL

SEQ ID NO: 180505 - protein, 117 aa, Glycine max
  Coding DNA Sequence Number=SeqID_88820
MWSGIARQSLKKVVDGGGQGVDGSGEVVLAEEGGLAAVESSHGGSVRRVVWVMVGSHGSFVCLVAELRGSTPPKEEEEEKKKKVKGRNFAISFIHIPSKCHYTDIYIAMKGTRPDKH

SEQ ID NO: 180506 - protein, 377 aa, Glycine max
  Coding DNA Sequence Number=SeqID_88821
  Gene Ontology: Mol. function=glutamate dehydrogenase [NAD(P)+] activity; Cellular component=mitochondrial matrix; Biological process=amino acid metabolic process
  Homolog annotation: Hit_ID=Q5F2M9; Match level="QueryCoverage=100%, HitCoverage=91%, E-value=0.0, Identity=92%"; Hit description =Glutamate dehydrogenase 1
  Pfam annotation: Domain name=ELFV_dehydrog; Domain location=142-374; Score=399.9; E_value=3.9e-117; Accession=PF00208.12; Description =GlutamateLeucinePhenylalanineValin
  Pfam annotation: Domain name=ELFV_dehydrog_N; Domain location=2-127; Score=215.7; E_value=1.1e-61; Accession=PF02812.9; Description =GluLeuPheVal dehydrogenase, dimeri
  Pfam module annotation: Pfam domain module=ELFV_dehydrog::ELFV _dehydrog_N; Domain location=142-374::2-127
MQVECTIPKDDGSLATFVGFRIQHDNARGPMKGGIRYHPEVEPDEVNALAQLMTWKTAVANIPYGGAKGGIGCDPADLTVSELERLTRVFTQKIHDLIGVQTDVPAPDMGTGPQTMAWILDEYSKFHGHSPAVVTGKPVELGGSLGRDAATGRGVLFATEALLKEHGMSVSGQRFIIQGFGNVGSWAAQLISEKGGKVVAVSDITGAIKNTNGLDIPSLLKHSREHRGVKGFHGGDAIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFKDVKEMCKTHNCDLRMGAFTLAVNRVARATVLRGWEA

SEQ ID NO: 180507 - protein, 169 aa, Glycine max
  Coding DNA Sequence Number=SeqID_88822
  Homolog annotation: Hit_ID=A7PBF4; Match level="QueryCoverage=78%, HitCoverage=34%, E-value=5e-36, Identity=55%"; Hit description =Chromosome chr16 scaffold_10, whole genome shotgun sequence
MDAGPLSFSPIIETRSRYPFQQQFQKKSSKGNCEHHQLDRFIPPNRSAMDFDYAHYLCLLRGTKLAELFNMNRLRILAFKNKPSKPVDLLHPQISTLIRQNKPAKPRRVIPQTLDAPELVDDYYLNLWGSNNCSCIALGSIMYFWDAKNHSTSELVTIDDEDDPVTFVS

SEQ ID NO: 180508 - protein, 297 aa, Glycine max
  Coding DNA Sequence Number=SeqID_88823
  Gene Ontology: Mol. function=sequence-specific DNA binding; Cellular component=nucleus; Biological process=regulation of transcription, DNA-dependent
  Homolog annotation: Hit_ID=A2Q5Q2; Match level="QueryCoverage=79%, HitCoverage=81%, E-value=8e-64, Identity=57%"; Hit description=Zinc finger, GATA-type
  Pfam annotation: Domain name=GATA; Domain location=222-257; Score =62.4; E_value=1.6e-15; Accession=PF00320.18; Description=GATA zinc finger
  Subcellular localization annotation: CTP_CleavageSite=47; ConfidenceScore=5.04e-01
MFAEIYQFLQVSVSKSFPPLMTFSVIRTRVYMLPCVWIVPTKFGTKKCEQEVDFGMEWLSVFVEDCFSSRPSCLLPPSGGGVQTTSTSTKPSSGTIMPRPQQSHHCPLQNFAVPGKARSKRKRLSAPRTTKHTLSTWSQHFSSQNDGVSSDPPLLKQAYWLADSELIVPKKKDVEQEEGVVVVVKKEKLGDYYDDDEGDEVNNNNTNNNNNDNVQHPIPRRCTHCLAQRTPQWRAGPLGPKTLCNACGVRYKSGRLLPEYRPAKSPTFVSYLHSNSHKKVMEMRMGVGVAVLSTDKK

SEQ ID NO: 180509 - protein, 438 aa, Glycine max
  Coding DNA Sequence Number=SeqID_88824
  Homolog annotation: Hit_ID=A7P5Q2; Match level="QueryCoverage=93%, HitCoverage=93%, E-value=2e-59, Identity=36%"; Hit description =Chromosome chr4 scaffold_6, whole genome shotgun sequence
  Pfam annotation: Domain name=DUF247; Domain location=32-427; Score =350.6; E_value=2.7e-102; Accession=PF03140.6; Description=Plant protein of unknown function
MEGQSRDTMNEQQCLETKLTNMLQNVKPPEMYGFDMQCIYRVPPDIRETNPKAYTPRIVSIGHFHKACYAGNEDSIFESMEELKVNYLKAFLNRTQVPVGTFVVTLHALEDKIRSCYAVRIKYNSDDFLKMILIDACFIIELFLRLYRYNYWRGKDPVLLKDWMRMQIRSDLILLENQLPFFVLEQLYNLAGMNQEFPSFLQISFNCLKHERYGTTSCPTESPKHFTDLMRTSIISSSKFVLREEEECKGIKHVYSASQLREAGLKFKVSLNENECLLDLTYSSEGVLTMPILNITENSEMFFRNILAFEECHLSDDTNIITQYLVILDFVINTEKDVNVLVDNKIIVNWMGDANKVATMVNNLDSNLAMPDFNSHYYSLCNSLNEFYENPRNKYKARFRLFINEYFDAPWTIASTVAAVVLLLLTVIQTICSIISLF

SEQ ID NO: 180510 - protein, 361 aa, Glycine max
  Coding DNA Sequence Number=SeqID_88825
  Gene Ontology: Mol. function=hydrolase activity; Cellular component =integral to membrane; Biological process=transport
  Homolog annotation: Hit_ID=Q9FUI1; Match level="QueryCoverage=30%, HitCoverage=28%, E-value=9e-40, Identity=71%"; Hit description =Apyrase 2
MASAIKAAIGDLVLTFLWVFFSSMLGLVTNAITTALDLHHVSYNGFDYPSAVIITSLIFILVTIFTFVGNALGGASFNPTGNASSYAVGLGSDTLFSMALRFPAQVFVDCGHLRPRWPHLSVAVRFLAMTLQEKDIVDKGGECGNNCGRIAKDLKNLDITTEIAWTALGSVGGVLAVMEVMPPKYRHLIGGPSLKVSLHTGAIAEGVLTFVITFVVLLIMIRGPRSEAVKTLLMAISTVVLITAGSAYTGPAMNPAFSAYAQNPQQTAESLISLLDKAESVVPREFRPKTPVGVGVRDLLKQRSTLKSELDAVTVLDGTQEGAFQWVTIPYLLGKLGKDFSETVGVVDLGGGSVQMAYAIS

SEQ ID NO: 180511 - protein, 146 aa, Glycine max
  Coding DNA Sequence Number=SeqID_88826
  Gene Ontology: Mol. function=endodeoxyribonuclease activity, producing 5'-phosphomonoesters
  Homolog annotation: Hit_ID=A7CTG6; Match level="QueryCoverage=64%, HitCoverage=33%, E-value=1e-17, Identity=50%"; Hit description=TatD -related deoxyribonuclease
  Pfam annotation: Domain name=TatD_DNase; Domain location=5-141; Score= -38.9; E_value=2.7e-05; Accession=PF01026.12; Description=TatD related DNase
MLRLLDAHCHLQDPRILSKAPHLIKTAQDTGVAYFAVNGVSEQDWHSVKQLAETYPSVIPCFGLHPWFVKERSPNWFQTLKEYFDSTPSAAVGEIGVDKGSHGKKIDFSEQKMYKMQCDPHRQICIFAVTSRKAECMCPFPFLPHD

SEQ ID NO: 180512 - protein, 616 aa, Glycine max
  Coding DNA Sequence Number=SeqID_88827
  Pfam annotation: Domain name=RRM_1; Domain location=121-191; Score =28.6; E_value=2.2e-05; Accession=PF00076.13; Description=RNA recognition motif. (a.k.a. RRM, RB
RVTDRDRRKERWSETDTAKTSVKQDRKDTSPNRRTPNGSSSRRWRSMDRREKPYGGQRVNIFGRDNDYADEDNWTKVVSKRSMKVMQKSSLAGRQSQNLEIGDSTKHYCLNWRNNADITSFYFTHFPDEANEELLWRHFKKWGDVREVYIAKRLNKDGRRYGFVRFKGVSDAKGLEVRLDNIFINDCKLFVNLPRFERPARNAELQKKSPIGRKYTNEASKPCGVTTGPHRRSYVDVMTKGGCKGDKRTNEALTPTILINPDEEDCIAWELGYNIHSKFLGDDMVLLSGMSDDKVQLLIQSEMESGNSLFYSLEKWTPKCRPNNRVVWLQVWGFPIEVWEMKNLRRAVAAIGDVIEPDDDTEDRRRLDRARLLVRTPLPPLIRTEVIVRVGKLEYRVWIVEESGFEGGSNRKGSSPSDGWSEVITSDDGGDVGDVLDDTDTNFSFSPELCNRKLSSSGTQRAEEGTDGCCYDLRPLGNTQVDVTPKEKSKGIEEGMLGSCFGKLDLGDSFAGTEKEAANTKEVTCYNTLQDDRRQRNHIEGYYSNGGAKVAVDQTFIGEEEGHVTQSLSPSISGQIQQGLGPGCITGPISTQGGCNKEDILPVELLGVQVVQIQKE

SEQ ID NO: 180513 - protein, 176 aa, Glycine max
  Coding DNA Sequence Number=SeqID_88828
MPNLRRYSLEELNRRIFHCLHEASIVDGSSDVVEDLLAELLLACEENSNADLGGFYPVSDFVLKLLPLEALNVSDAELFDVELVEARVHGGFSHAVVYLDALAEVAEGEHALGNATEVIDGVGGDQIDLTNVAGGTVTTVVNRVDGASAKTWDALPREEPEVDEVVVWARSSSVRE

SEQ ID NO: 180514 - protein, 303 aa, Glycine max
  Coding DNA Sequence Number=SeqID_88829
  Gene Ontology: Mol. function=acyltransferase activity; Cellular component=cytoplasm; Biological process=flavonoid biosynthetic process
  Homolog annotation: Hit_ID=A7R288; Match level="QueryCoverage=99%, HitCoverage=66%, E-value=1e-109, Identity=64%"; Hit description =Chromosome undetermined scaffold_409, whole genome shotgun sequence
  Pfam annotation: Domain name=Transferase; Domain location=1-299; Score=109.5; E_value=1e-29; Accession=PF02458.6; Description =Transferase family
MHVTSFKCGGFAIGISTSHTTFDGLSFKTFLDNIASIAAKKPLAVTPCHDRHLLAARSPPRVTFPHPEMLKLSDQLPTCPESNIFEASTEQLDFKVFKLTSNDITKLKEEARNSSISGGLSTKCVTGFNVITAYIWRCKALSCYNDENPNRSSTILYAVDIRSRLNPPLPKSYAGNAVLTAYATAKCKELEEWPFMKLVEMVREGATRMTNEYARSIIDWGEINNGFPNGEVLVSSWWRLGFEEVEYPWGKPKYCCPVVYHKKDIILLFPPVGGGEGVSIIVALPPKEMEKFHGLFNKFLTSH

SEQ ID NO: 180515 - protein, 410 aa, Glycine max
  Coding DNA Sequence Number=SeqID_88830
  Gene Ontology: Cellular component=membrane
  Homolog annotation: Hit_ID=A7PA63; Match level="QueryCoverage=71%, HitCoverage=66%, E-value=1e-128, Identity=77%"; Hit description =Chromosome chr14 scaffold_9, whole genome shotgun sequence
  Pfam annotation: Domain name=DUF803; Domain location=55-354; Score= -96.8; E_value=9.3e-05; Accession=PF05653.5; Description=Protein of unknown function (DUF803)
MVFVVSVLRVQFPGKHSRSGFFKEYCCPDTWCVEEGLSSFLPCHIISFMGEWIVGAFINLFGSIAINFGTNLLKLGHNERERHLLGSDGVNGKMNLKPIIYFQSWRIGIVFFFLGNCLNFISFGYAAQSLLAALGSVQFVSNIAFAYFVLNKMVTVKVLVATAFIVLGNVFLVAFGNHQSPVYTPEQLTEKYTNIAFLLYLLALISIVALHHSIYKRGELLFAVSGHDLRPYWSMLLPFSYAVVSGAVGSCSVLFAKSLSNLLRLAMSNGYQLHSWFTYSMLLLFLSTAGFWMTRLNEGLSLFDAILIVPMFQITWTFFSICTGFIYFQEYQHKQAKRTFQFKFSNFKSETLKNRCQGARYRRELENREPSSQQKTDVKENHPANSANISAEEKRNNEGEEDSMQQWFQL

SEQ ID NO: 180516 - protein, 151 aa, Glycine max
  Coding DNA Sequence Number=SeqID_88831
  Homolog annotation: Hit_ID=Q84LR3; Match level="QueryCoverage=25%, HitCoverage=12%, E-value=1e-07, Identity=69%"; Hit description =Putative uncharacterized protein
  Subcellular localization annotation: CTP_CleavageSite=53; ConfidenceScore=5.10e-01
MATPSRSNSGSARNPVPSWRLSTDGRVGLCVLSAAAGGDRGRRGRHGAGEVARADAGGGAPAAAAANEAAGAVLPGPLLGPDGGDEEDHNDNSDNNNNQNGVVSGGGDDIVQCRYNGCKTKAMALTNYCHTHILSDSKQKLYQGCKAVAKK

SEQ ID NO: 180517 - protein, 79 aa, Glycine max
  Coding DNA Sequence Number=SeqID_88832
  Gene Ontology: Mol. function=oxidoreductase activity; Cellular component=membrane; Biological process=electron transport
  Homolog annotation: Hit_ID=Q6WNR0; Match level="QueryCoverage=54%, HitCoverage=9%, E-value=3e-09, Identity=63%"; Hit description =Isoflavone 2'-hydroxylase
MTFNTIMRMVSGKRYHGEDCDVELARQFREIINELVTLGGANNTLGISWLCLGCLIFMTMLLAETDTSAVTLEWECLIY

SEQ ID NO: 180518 - protein, 112 aa, Glycine max
  Coding DNA Sequence Number=SeqID_88833
MEKARHVADFTISNENLKRDDAAEIAPVVAVGRKRHAGVVIADVLSCKKARPVRPDDVVKHSCTPAKDETTRTIREPNQREKTWPYFLGHAMQGLVEGLFELVEVSDYGGDS

SEQ ID NO: 180519 - protein, 470 aa, Glycine max
  Coding DNA Sequence Number=SeqID_88834
  Homolog annotation: Hit_ID=A5AV20; Match level="QueryCoverage=95%, HitCoverage=89%, E-value=9e-43, Identity=30%"; Hit description =Putative uncharacterized protein
  Pfam annotation: Domain name=DUF247; Domain location=40-470; Score =28.8; E_value=2.8e-11; Accession=PF03140.6; Description=Plant protein of unknown function
QNTNPPINPSFKHYLTMSSNLTIEQRLEQLQKAKERAQPQPPKGAKIQRVAHHLRDRKHFTKHYEPKLMSLGPIHHGAEKLQLGEQCKQRWAATYIESTGKTPQTLHKRVVDDFENQKKLFDDDLLLASTQQEKRNLLGPIRHKCTLLETQAPWKVMSTKFHSKKSPSLIEQTNDINVSEARLHNHGRKDSVDAVRGRVCPAANSGTCKSSRTGENENQGRSTGSGDGGRALVREPASFLFAETVVEKRRERVDENNEKVSSRSIILYDPNKRKQTQNNDNQNQDTNKGNEAQNDPNINMANMGNPTPNENPELKEAGIVLKSSKTRRPRDVSFSYGWIRSELKLPEIVVDDTTAATVLNLIAYEMCPDFENDYGICSYVSFLDSLIDHPDDVKALRSEQILLNSLGSDEEVANLFNTISTDLVPDMVKYADVRNEIEKHYSDKSRTWLALGYHTYFSNPWAIIAFHAAV

SEQ ID NO: 180520 - protein, 497 aa, Glycine max
  Coding DNA Sequence Number=SeqID_88835
  Gene Ontology: Mol. function=potassium ion transmembrane transporter activity; Cellular component=integral to membrane; Biological process=potassium ion transport
  Homolog annotation: Hit_ID=A7PA53; Match level="QueryCoverage=100%, HitCoverage=86%, E-value=0.0, Identity=65%"; Hit description =Chromosome chr14 scaffold_9, whole genome shotgun sequence
  Pfam annotation: Domain name=K_trans; Domain location=1-497; Score =442.5; E_value=5.9e-130; Accession=PF02705.7; Description=K+ potassium transporter
LLPNQQAADEEMSCYKNGLSPEAAESSSLKRFLENHRSLKTALLVVVLLGACMVIGDEPILWPVFVIATLAAIVGSQAVITATFSIIKQCHVLGCFPRVKIVHTSKHMFGQIYIPEINWILMILTLAVTIGFRDTTLIGNAYGLACMTVMFVTTFLMALVIMFVWQKNILIATIFLLFFWVIEGLYLSAALIKVFQGGWVPLVLSFIFMLVMHVWHYGTCTKYNYDLSNKVSLKWLLALGPSLGVARVPGIGLIYTELATGIPAIFSHFVTNLPAFHMVLVFVCVKTVPVPHVLTKERFLIGRVCPRPYRMYRCTVRYGYKDIRRDDRDFDNHIIRCIAEFIQIEAQELQLSISETSSFDGGTTIISVRSFESVSSWTVSENEDVGVDNNIASGRSFSRQPSISTYDKENPHSRRRHVSFLVPDDPALDHEVKQELLDLAQAMEAGVAYIMGHTHVKARKSSSLLKRLVINVGYAFLRTNCRGPATALNIPHISLIE

SEQ ID NO: 180521 - protein, 95 aa, Glycine max
  Coding DNA Sequence Number=SeqID_88836
  Gene Ontology: Mol. function=structural constituent of ribosome; Cellular component=ribonucleoprotein complex; Biological process =translation
  Homolog annotation: Hit_ID=Q9M2F1; Match level="QueryCoverage=48%, HitCoverage=59%, E-value=9e-19, Identity=82%"; Hit description=40S ribosomal protein S27-2
  Pfam annotation: Domain name=Ribosomal_S27e; Domain location=50-93; Score=58.5; E_value=2.3e-14; Accession=PF01667.8; Description =Ribosomal protein S27
MALVQSLWPLHLSSRLRKPSLSLVGEVFHVTDEAGKKLTDETLMLHIQQDVKCQGCFNIHSQTVVVCGNCQTVLCQPTGGRARLTEGCSFRKKGD

SEQ ID NO: 180522 - protein, 1446 aa, Glycine max
  Coding DNA Sequence Number=SeqID_88837
  Gene Ontology: Mol. function=sodium:dicarboxylate symporter activity; Cellular component=membrane; Biological process=dicarboxylic acid transport
  Homolog annotation: Hit_ID=A7PA41; Match level="QueryCoverage=28%, HitCoverage=95%, E-value=1e-149, Identity=61%"; Hit description =Chromosome chr14 scaffold_9, whole genome shotgun sequence
MAADQRRKRVNGANIAGYGSREQHRIKRKNLGLVQNDLNMRPHISVEWDDNHKKVVAKREQIGISWRQMKPFINSVSNDHKILADVFSVPQEIFDLDNLSEVLSFECLGDWTVMGLNPEMTFLHMQGGASLCLGGLHPDMIVDQEQHLKTERREYHSHIHNYHNDMIGFLSKLKKSWQSCKDPEKEIAQKIWRSKHVEKRMPSKVIESRVYDHDGNVTGTSDSCSWDAEEKACSSDNQISSLRKDNKLQRRVLEKGIFKGKSQNLMDSLDNMPNVAEKPKTGDKLPKRSIHSSDSDKYMSCIKISRQQHELVKNMKQSGKSIQSRSLNRVLGNLEKIHVQPYNIFVKEEQKKLQEHWLLLVNKDLPVAYVNWTERQIQRHAVRNSLVAEMKDKSIPLIEGVNTGSELKDQVDVNSGSELKDHDDVNSGSELQDHDEEVNSGSELQDQDEDNISSGDKLKDQNEDNMSSEGELQDQNDDNLSSGSELQDQGEDNVNSGDELQDQVKDGGLSDQSDLKDDDDSISRSPENQSQHNSDVSGDNEFNQMSVDSEKNILLSKSTNNTSSGSGDHEFNQMSVDSEKNLLSKSNNTSSNKDEYSVHMNTQDVSIDEGAPFTSSGDVWQGVEMPHSYYDSAVTHEYAASGLSLANPQVSQEQPTRMIDLEADLRREETGKELLSRQLDNGTFSSYQSQDRSVLLQSLFKGEGLLPYHHDQKEAELDFQTSNNVMMGGGQFSSHFKEPLQTSLTLDQGRRRATEVYMPENMSENIYSDEGRYLIPRQDPLIPRQDPLIPTQDPLIPRQDPLIPRQDPLVPRQDPLAAVNMTDWAANNARIAGPSQSHLNTGDFIGHHWFPADHQVRGGGWNGSDGGGLSNQSLGPGASSDQSLFSILSECDQLHSGSLYDSVRNTDQFLAPRTYGLVDAGTPRVNTVAPPASRPLDYFTGREAPSGLVPDDMAWMSLPRQNSSIHDQMGKPYLRSWNRKHLMPSLRSMNLIPLCVAKKHFVWSFTDPLEQMGNEKKKEVIRIERESVIPVLKPQLIMALANLIKHSADRVEFLKLCKRIEYTIRAWYLLQFEDMMQLYSLFDPVSGAQKLEQQKLPREEIDVLEQNFLTYLFEVMKKSNFKIATQEEIDIALSGQYILNLPITVNESKLDKVLLKNYFEAHPHDNLPDSYDKKTLTHGACRLEKFLSRRAKRRRRKDPKNDDEINLELEDFQDDLNVPSRNPTAHSSDKCMLFYLTKTADLMHTTIQEPTFDRIIVVYRPASSNSKKERGIFVKHFKNIPMADMEIVLPEKKNPGLTPKDWVKFLASAMVGLVAVASSLHVDSADLRVIGAVLSTVLGYLAKTYFTSMYDKQLDSGKGTLLHLCDDVIQQEELDQWCEELIREEFGESCNFDVDDAVKKLEKFGIVTKDIIGRYQCVGLKRANEIIGTTTEELVLKARQGGSTTP

SEQ ID NO: 180523 - protein, 444 aa, Glycine max
  Coding DNA Sequence Number=SeqID_88838
  Gene Ontology: Mol. function=transcription regulator activity; Cellular component=nucleus; Biological process=regulation of transcription, DNA-dependent
  Homolog annotation: Hit_ID=A7PA22; Match level="QueryCoverage=42%, HitCoverage=34%, E-value=4e-76, Identity=77%"; Hit description =Chromosome chr14 scaffold_9, whole genome shotgun sequence
  Pfam annotation: Domain name=HLH; Domain location=256-303; Score =43.1; E_value=1e-09; Accession=PF00010.17; Description=Helix-loop -helix DNA-binding domain
MLPTRALTHTLGVPWTEPENDAVTGDAALLASFKSMLDRDWYMDQPHCDFLQNDAAFLEHPLGSSSSSSSSSLPQQQHFVVPPKPCYFNVNGNGPLECGFELGSQSSFLAPFPVNALELSLDPEFPASKPGGGLIRREEKQRPLDALAPSTLYQKRTERWREAGKAEELAMPPPPPPQLAMEKRRKRGEEGEDEGGLNYESGEDMKLEENGVDANNNDNDNDDDDDDGDGDNGNGNGGGGGGDQKGKKKKRKKMPAKNLMAERRRRKKLNDKLYMLRSVVPNISKMDRASILGDAIDYLRELQVRITDLNHELESGPPGSSLPPAASFHPVTPTLPTLPCRVKEEICPISLPSPKNQSAKVEVTVREGGAVNIHMFCAHRPGLLLSTMRAMDSLGLDVQQAVISCFNGFSLDVFRAEQCREGQDVLPEQIKEVLLDTAGFHGMM

SEQ ID NO: 180524 - protein, 612 aa, Glycine max
  Coding DNA Sequence Number=SeqID_88839
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=91%, HitCoverage=82%, E-value=1e-73, Identity=50%"; Hit description =Functional candidate resistance protein KR1
  Pfam annotation: Domain name=LRR_1; Domain location=388-409; Score =2.3; E_value=1.1e+02; Accession=PF00560.24; Description=Leucine Rich Repeat
  Pfam annotation: Domain name=LRR_1; Domain location=469-490; Score =12.2; E_value=1.7; Accession=PF00560.24; Description=Leucine Rich Repeat
  Pfam annotation: Domain name=LRR_1; Domain location=492-517; Score =7.9; E_value=11; Accession=PF00560.24; Description=Leucine Rich Repeat
  Pfam annotation: Domain name=TIR; Domain location=18-118; Score= -21.6; E_value=0.0068; Accession=PF01582.11; Description=TIR domain
  Pfam module annotation: Pfam domain module=LRR_1::LRR_1::LRR_1::TIR; Domain location=388-409::469-490::492-517::18-118
MAMRPSSSSFSYRFTYDMFLSFRGEDTRCGFSGNLYNALQDRGIHTFVDYKELQRGHEITSALEKGIEILRMCDTTEVVFGEALANHEKKFNANKMGFKHNMEKTEAWKMALHQVANLSGYHFNGIVDLISSKINHAHLHVADYPVRLESQVLNVMSLLDVGSDDVAHMVGIHGLGGVDDVNKREQLQAIVGRPDWLGPGSRVTITTQDKQLLACHGVKRTYEVELLNDEDALRNNLCLGPSIGFRSNRFQLIWRKYGTIGVCFKSMSKEFFLDIACCFKEYELGEVEDILHAHHGQCMKHHIGVLVEKSLIKIGLGGKVTLHNLIEDMGKEIVQKESPKEPGKRSRLWFPEDIVQGTRHIEIMFMDFPLCEEVEVEWDGDAFKRMKNLKTLIIRNGLFSEGPKHLPNTLEYWNGGDILHSSTEEGWLLPKKGAEKVSSTVSSNIQKLALQYCKLSDEFFWIVLPWFVNVKELDIRGNNFTVIPECIKECFFLTSLYLHHCKLLQEIRGIPPNLKYFSAKNCLSLTSSCRSKLLNLELHEAGNTNFHLPGEKIPEWFEYQAGPGVHQFLSGSVEYSPPEDEDEYSLLEDEDEYPLIEDEDEDEDEYSLLEGR

SEQ ID NO: 180525 - protein, 57 aa, Glycine max
  Coding DNA Sequence Number=SeqID_88840
MESVEGMCYVVFVGLGWVGGTNEKGTVQCDGMEGRKKEGKVHLAAKPGFPPSVFFFK

SEQ ID NO: 180526 - protein, 177 aa, Glycine max
  Coding DNA Sequence Number=SeqID_88841
MENNLIENSGRLATLQHNADANNKEVTTLDMPNFIPIFLQLVEEKIVKYETNEAQSHQEEDQEENKVKGKTNLIINDISAIQQEETVTKWSKIAKEMIVEDVVGATRARDPHEEGMHLRVAPRRAESRQHYGEPLRQPLAWDRVRDPEGCDSEHGEPFPRQPWGNQARDDFGQVPPP

SEQ ID NO: 180527 - protein, 338 aa, Glycine max
  Coding DNA Sequence Number=SeqID_88842
  Homolog annotation: Hit_ID=A7P9Y9; Match level="QueryCoverage=97%, HitCoverage=63%, E-value=1e-114, Identity=63%"; Hit description =Chromosome chr14 scaffold_9, whole genome shotgun sequence
MEATYHMVRFQGTVDSVAAQFFLKNMHSQMRTAALNLFGDPQVLGLRPNVFGELMRVLISPSEDVEAAVNWVIGGGENPDISLHMRMLMHRSGRAVQAVLHCLNKAMRSQHLMSSRPKVVVVSDTPAVVKSIMYMSNLSEFVEVLHFDYDKYRGSMFKGLHITDSRRRDWGTAPRWVAFVDFFLASRAKYATISGAHRRVGTTYAQLVAALSAAYNLGISAIHSAYSRDMSGSRFIFLSSFQSNLLTDGLKNQRGWGHVWNRYAGPLSCRKQGNQCAFTPVLPSAWWDGLWQSPIPRDINRLASYGIKLSALGTVDKDSLKNHCKKKKNVVRTITFKL

SEQ ID NO: 180528 - protein, 144 aa, Glycine max
  Coding DNA Sequence Number=SeqID_88843
  Gene Ontology: Mol. function=calmodulin binding; Cellular component =integral to membrane; Biological process=cell death
  Homolog annotation: Hit_ID=Q56BA4; Match level="QueryCoverage=72%, HitCoverage=18%, E-value=1e-45, Identity=81%"; Hit description=MLO1
  Pfam annotation: Domain name=Mlo; Domain location=2-142; Score= -249.9; E_value=3.2e-07; Accession=PF03094.6; Description=Mlo family
MYIADPERFRLAKDTTFGQRHLNTWSQSSISLWIVSFFRQFSGSVKKVDYFALRHGFITAHLAPGSDARFDFQKYIKRSLDEDFKVVVGISPIIWFFAVLFLLANTHGNLISGCQATNDHNKDGTEDSGQRGSTQGCTSGGARR

SEQ ID NO: 180529 - protein, 122 aa, Glycine max
  Coding DNA Sequence Number=SeqID_88844
MSDDKLEMKQLSRKGGRRPMIRLAKASNSSKNGVILKIHPSGSEPSNRGTSSFIRYRVDDGSKKVGLVDEEEGEGWLVLREDIFCMRWSSLADMVIWLAAKVGSYMEVTKTSINGWKLHGSY

SEQ ID NO: 180530 - protein, 236 aa, Glycine max
  Coding DNA Sequence Number=SeqID_88845
  Gene Ontology: Mol. function=zinc ion binding; Cellular component =nucleus; Biological process=regulation of transcription
  Homolog annotation: Hit_ID=Q76KU9; Match level="QueryCoverage=100%, HitCoverage=100%, E-value=3e-62, Identity=54%"; Hit description=DNA binding with one finger 5 protein
  Pfam annotation: Domain name=zf-Dof; Domain location=24-86; Score =132.8; E_value=1e-36; Accession=PF02701.6; Description=Dof domain, zinc finger
MPSSNSGESRRASKPHRSVAAPPVEPENLPCPRCDSANTKFCYYNNYNYSQPRHFCKSCRRYWTHGGTLRDIPVGGGSRKNAKRSRTHHAAAATSSSSSTSSATTSAHEHHNAHTLTALAPVTAATHFGHDGDVKQTNGNACGSYTSLLNNTQGSGFFALGGFGLGLGHGFDDMGFGIGRSGWAFPGMVDNGNIGGAIASSGVNTWQLESGEGGFVGGDCFSWPGLAISTPGNGLK

SEQ ID NO: 180531 - protein, 238 aa, Glycine max
  Coding DNA Sequence Number=SeqID_88846
MPSPFVPLVSVCTVVVMFYYVVIMIKTKGRVLGREVSHDADEVPKQQRPTTFARRQWEAAPIDKNVEHVDRAVDEVHEQPKVPVTNAEGFLGKPYDTSVLMDYVHHMIVIVWNREEHLELKLSSHERKVEKFGRPALEIEGLVAAIGLSPLIAFSLDTDDRRLIFAFAERWKLVFSIFCSSISLASGSYAWGAVTLVHMYENLNDASKSSVRQLTGYITLLQCWIYKHFLSVTSSIVA

SEQ ID NO: 180532 - protein, 114 aa, Glycine max
  Coding DNA Sequence Number=SeqID_88847
MAKGMGVNYEKEEIRMISRIKILEGRDKNNADKFNKEIGTKRTVCWAESPAINTAGGVLSIWSEESFAMQRNQRDQGSGVMREFTAWLKELEVEDVPCVGRDFTRYRPNGVAKN

SEQ ID NO: 180533 - protein, 31 aa, Glycine max
  Coding DNA Sequence Number=SeqID_88848
MGYRWRKFEGLKSESRRRVNNEAGLLLFQLI

SEQ ID NO: 180534 - protein, 357 aa, Glycine max
  Coding DNA Sequence Number=SeqID_88849
MLCIAPLLGLTVRRKVWLCSIVRFGCEKSKLYFCTHVWIVNFGFRWLRWLCDYKVMARVPDKIKLIDGSREALKLSVRITDLWFIGIPEKFEQAEMVVVDSDGDEIHVVCKQDQLKSWKADLKENLTYVMHNFKVMKNDVIGVVDEVVFRYVSSKNTKVLSCTLWENYCLQFLSYLNEVEDERPIIILLTHARIKEAQGSYLPSVSNSFKASKLMINELVLEIQELRERLLDLGMEKIVCVTVAKITTIHGAIRLAVNVTKKTDIETVSFICPCGKDNDQPVLRYRVEVMVNHKGEQTKFLLWDREYAELIGQSADEVNRLKIEDDDVDLNASPQALDRLLGCFLAFKVKVQPRFRN

SEQ ID NO: 180535 - protein, 62 aa, Glycine max
  Coding DNA Sequence Number=SeqID_88850
  Gene Ontology: Mol. function=nucleic acid binding; Cellular component= nucleus; Biological process=mRNA processing
  Homolog annotation: Hit_ID=Q9FT01; Match level="QueryCoverage=88%, HitCoverage=14%, E-value=4e-18, Identity=83%"; Hit description =Putative splicing factor
MVKPSEAEKNLVQSNAFGGAAGVTGPYGAVDRKLYVGNLHFNMTKSQLWESFGMFLGLCYIY

SEQ ID NO: 180536 - protein, 250 aa, Glycine max
  Coding DNA Sequence Number=SeqID_88851
MRDLGSNIPFKVRITQVDMLVREKLVELYESEKQWSKASQMLSATSSKGVDTNAHHAEGFYKHTWLEMKFGWKIILGSIIGFLGSTFRTVEGVGEGGIFVPVLTLVVIFIFLTDQLDPELSLLQAMPTNSARRILTSTMPTRGGSNTTVNLVGIPTAARSMMTKKTKMKNECAAVMTTVLKLFREEEDERRLGRRRTREGGDQKLKRSKNGEEEAEAGMWDWKGERRMNNFFFKLIKPEADFGYTFFAQR

SEQ ID NO: 180537 - protein, 400 aa, Glycine max
  Coding DNA Sequence Number=SeqID_88852
  Gene Ontology: Mol. function=protein serine/threonine kinase activity; Cellular component=cytoplasm; Biological process=protein amino acid phosphorylation
  Homolog annotation: Hit_ID=Q9M728; Match level="QueryCoverage=90%, HitCoverage=94%, E-value=1e-127, Identity=72%"; Hit description =Viroid symptom modulation protein
  Pfam annotation: Domain name=Pkinase; Domain location=79-338; Score =83.8; E_value=5.4e-22; Accession=PF00069.16; Description=Protein kinase domain
  Pfam annotation: Domain name=Pkinase_Tyr; Domain location=79-345; Score=-136.7; E_value=0.00048; Accession=PF07714.8; Description =Protein tyrosine kinase
  Pfam module annotation: Pfam domain module=Pkinase::Pkinase_Tyr; Domain location=79-338::79-345
  Subcellular localization annotation: CTP_CleavageSite=15; ConfidenceScore=5.13e-01
MPSNSNPSTTSSRVVAETTREFSIITKSTNQGQRSGVSSRNDSLESTSGAHIKPHTGGDVRWDAINMVSRGNGLNLSHFKLLQRVGYGDIGSVYLVELKGSKAFFAMKVMDKASLAKILLALEYLHMLGIVYRDLKPENVLVRDEGHIMLSDFDLSLRCSVNPTLVKSSSAHESNNGPSGSILDDEQVIHGCIQPSSFFPRILPSKKNRKLKSDFGLMVGGCLPELMAEPTNVRSMSFVGTHEYLAPEIIRGEGHGSAVDWWTFGIFLYELLHGITPFKGEGNKATLFNVVGQPLRFPKKPHVSNVARDLIKGLLVKEPQKRFAYKRGATEIKQHPFFNGVNWALVRSATPPIIPKPLDFSKYANKSNIPPIDKKIADIVASDKSRHTQPNSSYEDFEYF

SEQ ID NO: 180538 - protein, 66 aa, Glycine max
  Coding DNA Sequence Number=SeqID_88853
MPNIVNLMCFNFNFNEACALSENHALREALSPLSELGESMKHMRAQRVISLLIRLSSTRHPRMRFN

SEQ ID NO: 180539 - protein, 337 aa, Glycine max
  Coding DNA Sequence Number=SeqID_88854
MAPRKLASKRSRKDKATKGTSSAPEYDSHRFRSVEHQQRFEAIKGWSFLQERRVQLRDDEYTYFQEEIVRRRWASLVTPMAKFDPDIVLEFYANAWPTEEGVHDMRSWVRGQWIPFDADAIGQLLGYPLVLEEGQECEYGQRRNRSDGFDEEAITQLLCIPGQDFARTAAGRRVWIMRTNMTTLTQIWMTLLLTNILPSDHNFDLPLPKCQLAQGDAPQAADVPPPHQAGPAGSFDTEQYLRHLVRQQAANHRAHVQTHDCLYQMSLSLQSQGFTSFPCPTPDQFRAEVAWPGDWPEVRAGEAPAEALAEAPDEADEAREDEEMADLFDFLGGSGAT

SEQ ID NO: 180540 - protein, 222 aa, Glycine max
  Coding DNA Sequence Number=SeqID_88855
  Gene Ontology: Mol. function=transferase activity, transferring glycosyl groups; Cellular component=cytoplasm; Biological process =amino acid biosynthetic process
  Homolog annotation: Hit_ID=Q6D412; Match level="QueryCoverage=100%, HitCoverage=74%, E-value=1e-109, Identity=88%"; Hit description=ATP phosphoribosyltransferase
  Pfam annotation: Domain name=HisG; Domain location=8-176; Score =278.3; E_value=1.6e-80; Accession=PF01634.9; Description=ATP phosphoribosyltransferase
  Pfam annotation: Domain name=HisG_C; Domain location=177-222; Score =19.1; E_value=0.00027; Accession=PF08029.2; Description=HisG, C -terminal domain
  Pfam module annotation: Pfam domain module=HisG::HisG_C; Domain location=8-176::177-222
MPIDILRVRDDDIPGLVMDGVVDLGIVGENVLEEELLTRRAQGEDPRYFTLRRLDFGGCRLSLAMPVDAEYTGPQCLNNARIATSYPHLLKKYLDKQGIAFKSCLLNGSVEVAPRAGLADAICDLVSTGATLEANGLREVEVIYRSKAVLIQRDGELPAAKQQLVDTLMTRIQGVIKARESKYIMLHAPSERLEEVIALLPGAERPTVLPLAGEVSRVAMHM

SEQ ID NO: 180541 - protein, 52 aa, Glycine max
  Coding DNA Sequence Number=SeqID_88856
MVIFNHGVAVEDKGEEPSTWEASLRSKEGSFLEKLEEESFPEKLVGLLTLLQ

SEQ ID NO: 180542 - protein, 128 aa, Glycine max
  Coding DNA Sequence Number=SeqID_88857
NVAGASKPYVRPPIHQQQQQRQQPTEAPPQPSLEELVRQMTIQNMQFQQETRASIQKSENVSAITLKSGKQFEVPPPVAAPTPEPVKLHSTLEKEDEIVVQKRKLPDHEGVNKNFHAGGPSSSNSDLQ

SEQ ID NO: 180543 - protein, 42 aa, Glycine max; identical to SEQ ID NO: 147747
  Coding DNA Sequence Number=SeqID_88858

SEQ ID NO: 180544 - protein, 161 aa, Glycine max
  Coding DNA Sequence Number=SeqID_88859
MVIRTFGHLETASPTTCGGNVWLSAPFVNRGQTCPLTRRDERRHLHPLSTRGKQAHGKFDDMRGYRMVIRTFCHPETVSPMTCGATVWLSAPFFIQGQTSSDGKSNGMRGYPMVIHTFCYLETPSPMTCGGGNSDDMRGYRMVICTFRQPGANKPVDAQGL

SEQ ID NO: 180545 - protein, 187 aa, Glycine max
  Coding DNA Sequence Number=SeqID_88860
ELAKCAYCAKRVHLLWMNIHLPDEIPVANPRLSGQSLAKPIIGPCLAKPLMASRKHKSIGARPIAQCDTRWFHSLDAWNRYIDNVLGRRILPERKVEIYHAEFDDFKTELERRNLHKRLTNLADGTIDVALVKEFYTNLYSSEDPSPKQAKVRGHVVKIDVDDLNTFLETPVVLEEGETLPTYSRYC

SEQ ID NO: 180546 - protein, 311 aa, Glycine max
  Coding DNA Sequence Number=SeqID_88861
GQDHLELPSGVETEHEQQKPIKERMQVRMGSRPTDRRPFLHTKQAENVAARQPPLGSSFFAFFDSVLRFCSSPTRMAPRKLASKRSRKDKAAEGTISAPEYDSHRFRSAVHQQCFEAIKGWSFLRERRVQLRDDEYTNFQEEIGRRRWASLVTPMAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHAAQLITDAIYIFA

SEQ ID NO: 180547 - protein, 39 aa, Glycine max
  Coding DNA Sequence Number=SeqID_88862
HYFTIPNGENARNWVANVLLKFHDDPTVNESKIIVFPRQ

SEQ ID NO: 180548 - protein, 191 aa, Glycine max
  Coding DNA Sequence Number=SeqID_88863
  Homolog annotation: Hit_ID=A5C6J6; Match level="QueryCoverage=20%, HitCoverage=6%, E-value=8e-08, Identity=57%"; Hit description =Putative uncharacterized protein
GEKGILNVVKDSMVVMRGIMENGLYSVDGEVVIGSAATATRRVLSKTELWHMRSFYVGIEWKDKSSVNIVSMAKPVEEIQCWTVENIKVPLIMFMLIFGVQPRLPLILEQGCEDPTIFVWVKQQLTAVYLNETTRGVLDSSKGYSEGVKGYKLWCLEAGFKRCLVSRDVVFNEAKMAYKTKPNMVQSNTDQ

SEQ ID NO: 180549 - protein, 429 aa, Glycine max
  Coding DNA Sequence Number=SeqID_88864
  Gene Ontology: Mol. function=ribonuclease activity; Cellular component=cytoplasm; Biological process=mRNA catabolic process
  Homolog annotation: Hit_ID=Q2KUU6; Match level="QueryCoverage=95%, HitCoverage=64%, E-value=0.0, Identity=81%"; Hit description =Putative ribonuclease
  Pfam annotation: Domain name=RNB; Domain location=57-340; Score =215.2; E_value=1.6e-61; Accession=PF00773.10; Description=RNB-like protein
SNEGAGRRCARLGKSPDRLLLELGAWPHALALHKRRFLAVNFPRGLAFPELELPPIDRELPLSDAEIYSVDDVTTTEIDDALSVSTLPDGNLRVGIHVAAPGLTVTRDSEFDKLARARLSTVYMPGDKIPMQPDNVIKAFSLDAGREVPVLSLYVVANPETGEVIESDTRLERVVVRENLRHNMLDAQVTEDSLNDTSTELPYGHWLRPLWKLAQALSAQRENVRGKPENNSRVEYSFYLDGDPDDPDTPVRLVPRQRNAPLDRMVAEYMILANNLWGGLLNQHGVPGIYRSQQAGRVRMSTQALPHEAIGVPQYAWSTSPLRRYVDLVNQWQLIAAVEHGVSARLVAPFKPRDADLFAIIGAFDAQYAAWAEFQSAMERYWCLRWLKQHNITRTVAHVLREDLVRFANCPLVTRIGGDARAGARDGGG

SEQ ID NO: 180550 - protein, 353 aa, Glycine max
  Coding DNA Sequence Number=SeqID_88865
  Homolog annotation: Hit_ID=Q6WAY6; Match level="QueryCoverage=82%, HitCoverage=53%, E-value=2e-34, Identity=31%"; Hit description =Putative uncharacterized protein
QGQELRDHQSKRVRAVDGSAPMASFSQSLRCFTFGDFQLSPMVEEFEEILGCPLGGRKPYLFAGFYPLLARISKIVQISAQELDYRKQVENGVVGIPRKYLEAKARILVDKGEWAPFIDILALLIFGGVLFPNVDGLVDLAAIDAFLAYHNHKESSVVAMLADLYDTFDRRCKACLPARKSPFMHREKRCKLGPTLSKTEGVSINWFPRWKEGKVGVLISCGGFPNVPLTGTRGCISYNLVLAIRQLGYPMRGAPLEEELAPVISRGFNKTNMETLQKVRKAWEVVREKDKELRGGNNGPIGGYRKWLRAHVQGLDWLPSLRNAKREEVEAPEEDEEVQALRTKLEQAQTVKE

SEQ ID NO: 180551 - protein, 60 aa, Glycine max
  Coding DNA Sequence Number=SeqID_88866
MPKDRGTCLDFRDCHHQKGGDCRQMIKLNVLMMPKLHMRLKALFKTKKLNIFKMDDQDSL

SEQ ID NO: 180552 - protein, 219 aa, Glycine max
  Coding DNA Sequence Number=SeqID_88867
IRLRAGTQGSFVPHGRLDVLAVAIGRPEHPGCVRAARAGVTIKQYFGSAPRTDQLEESITEKVMRQVMASFSQLQSQMQSQGLAVPPEPQAEFDIPEASGSRTKRKTVYREMHLVPVTNTHLARKLVGLPASLPDHRKPLSGSTGHPEAEYCPADVLSRGGYDYLEQKLLAEKTKKKMHEAAQSGSVDGVINPPSPVRRHVKWKMARTKKTGEMTTEAA

SEQ ID NO: 180553 - protein, 133 aa, Glycine max
  Coding DNA Sequence Number=SeqID_88868
DVRKKAQAIQKQNTAPHVLSRGGYEYLEQKLMAEKTKKKLEEAAQFGTTDGVIDPPSPIRCHMKWKMASTKKTGQMTSEAAKEILEKIASQGSFVPHGRQDVLTVAIGRAEHPSCVRAAGAGVTIKQYFGSAP

SEQ ID NO: 180554 - protein, 212 aa, Glycine max
  Coding DNA Sequence Number=SeqID_88869
  Homolog annotation: Hit_ID=Q2HW90; Match level="QueryCoverage=87%, HitCoverage=43%, E-value=7e-17, Identity=30%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPQKYLEDKARGLAAIDAFLAYHHSKESPVVAVLADLFDTFDRRCKKSSARIICCLPALCVWFHTCSNKTQDIHVRS

SEQ ID NO: 180555 - protein, 218 aa, Glycine max
  Coding DNA Sequence Number=SeqID_88870
MHLLCILGQDFTRAAAKRRVRIMRTNMTTLTWIWMTLLCQSPPADVSVGLCRHDIGITPTRRPVDPKKSNRALGFPALVTGLCQSYRVLVPPARNRTRTKTPSGPGEVQQGPGDFQLWITGLYSLYRGLPPGKVTSAPQSSFHQEVLRPKAGAGRDTAVAWGWPAAGNRHTATTSKATQLIHKKLVCCLRPMADQQTTKFKAKDKQSTRSVTDKSTSV

SEQ ID NO: 180556 - protein, 425 aa, Glycine max
  Coding DNA Sequence Number=SeqID_88871
  Homolog annotation: Hit_ID=O48915; Match level="QueryCoverage=42%, HitCoverage=81%, E-value=1e-31, Identity=40%"; Hit description=Non -race specific disease resistance protein
  Pfam annotation: Domain name=Hin1; Domain location=27-168; Score =22.9; E_value=1.8e-05; Accession=PF07320.4; Description=Harpin -induced protein 1 (Hin1)
MAPKHDNCCSRCIGFLIAIGLTALFLWLSLRVDEPKCYLDYIYVPALNKTLNSSSNSTHNKNATIVFALKLANENKDKGIQYDDVLLSFRVFESVNTTRPLGNATVERFYQGHKKKATKRGNFTVGGGGGNLTAALDGKVWYRVDYATAVKYKIIFWYTKRHRLWGGANVEIGELGTKVNRKAVRLGGKNPVVIESGASKLSGRYRAPLLLPFAYLLASGKSAKKPDSEEIDGAKKFEEMSNLSWLSSVSQNNILLQRKEQSRKKKQKCVFDFTQESRFQKLIEVCARILGPEATIELFGKVGREPGVKGYNTLVEMCIDKARGTDDEDITIEELGKVFNLFKSTREQGLELQEQTYRLLLLYLIDMRMVEEFKFFCVVIKDENPSSVTRLGYYEMLLWLKDNNEEKIQGICDYIAENDEDTSDI

SEQ ID NO: 180557 - protein, 168 aa, Glycine max
  Coding DNA Sequence Number=SeqID_88872
  Homolog annotation: Hit_ID=A7P0Y7; Match level="QueryCoverage=98%, HitCoverage=49%, E-value=1e-32, Identity=43%"; Hit description =Chromosome chr19 scaffold_4, whole genome shotgun sequence
YYEELKQSGIVATKQIFMALINAYAACGQLEKAKKVILDPLIPPKSLNQIKGFLVSVLASHGQLSGALVIYDKIKQSGHKLEAKEITSLIVSSAVELCNLLMDKFQSDEQVMEFLFDKVFSLIEESSHLHTFLELLSEIKDKLGLLPSQKRHDSLLRVTATDLHDSDF

SEQ ID NO: 180558 - protein, 260 aa, Glycine max
  Coding DNA Sequence Number=SeqID_88873
  Gene Ontology: Mol. function=transcription regulator activity; Cellular component=nucleus; Biological process=regulation of transcription
  Homolog annotation: Hit_ID=A7P102; Match level="QueryCoverage=100%, HitCoverage=100%, E-value=2e-72, Identity=59%"; Hit description =Chromosome chr19 scaffold_4, whole genome shotgun sequence
  Pfam annotation: Domain name=HLH; Domain location=74-125; Score=40.0; E_value=8.7e-09; Accession=PF00010.17; Description=Helix-loop-helix DNA-binding domain
MVSPENSNWLFDYPLIDDDVIPVGDSSFAVSASTFSWPPPPANVSVEIDASLGDSDGLKNPALKKRTKSDSSTASSSKACREKLRRDRLNDKFVELGSILEPGRPPKTDKASILIDAARMVTQLRDEALKLKDSNTSLQEKIKELKFISVAVRKTSCKPFITLSIEFLSPMQAEKNELRDEKQRLKAEKEKLEVQVKSMNAQPAFLPPPPAIPAAFAPQGQAPGNKLVPFISYPGVAMWQFMPPAAVDTSQDHVLRPPVA

SEQ ID NO: 180559 - protein, 111 aa, Glycine max
  Coding DNA Sequence Number=SeqID_88874
MQSTNKEGLKRPKPLVIHFTRDTAPQRPRHPSAVSSVRPIPFPYKNSHAIPWRYAPPGGRKQEATDVGSLSAKVTNITRLSGITRGGRMFTPPGLPTQPANAKGKTKVTEG

SEQ ID NO: 180560 - protein, 132 aa, Glycine max
  Coding DNA Sequence Number=SeqID_88875
IAIEEPVIRDNVSDFSDDEQQHDFDEHGKPTNQSELSSYFEIFSSQLSENQEYSNPYQRTTSVSTNDLYEGLTFESKQATVNAIKQFHFMHSLNFDVVENKSDKYVVMCNQYDNGCYWRREYRSAKYAKGGS

SEQ ID NO: 180561 - protein, 257 aa, Glycine max
  Coding DNA Sequence Number=SeqID_88876
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=43; ConfidenceScore=5.24e-01
LGTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMAFRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 180562 - protein, 87 aa, Glycine max
  Coding DNA Sequence Number=SeqID_88877
VYQVKVKSLDVTSLKELGRLMGPLQRQAFRKVYGKILDLTAAEEKREVVVAQLVQASWVASTRRHRLLLEHPGRSKWAWCYLHTLVY

SEQ ID NO: 180563 - protein, 176 aa, Glycine max
  Coding DNA Sequence Number=SeqID_88878
MKADMEAIKEKMATMMEAMMSVKKIMEANAVAIAATSVVAKVNPTSPSGLKQMNHPTSNMVGKDLGSTGGPHDVQIQNEHAFPSYGLPLNYTPPNMAYTPNKNTHEIPHHNLADFEPWLGYTTEGQAVGGIPLQNPLEGPQYHPQLHLLHSTAVKNPYDYGRNGKVGSSRGKAQGH

SEQ ID NO: 180564 - protein, 211 aa, Glycine max
  Coding DNA Sequence Number=SeqID_88879
  Homolog annotation: Hit_ID=Q6WAY4; Match level="QueryCoverage=88%, HitCoverage=33%, E-value=3e-21, Identity=36%"; Hit description =Putative uncharacterized protein
MGTNQNGKRFYQVKVKSLDVTSLKELGRLMGPLQRQAFRKVYGKILDLTAAKVFTEAVVSLAQYYDQPLRCFTFGDFQMVPTIEEFEEILGCPLGGRKPYLFSGFLPSLSKIAVVVGDSAKELDRMKQTRNGVVGLPQKYLEGKARDMASQEKWGPFADILALLIFGVVLFLNVDGLVDLAAIDAFLAYHHSKESPVVAILADLFNTFDRS

SEQ ID NO: 180565 - protein, 79 aa, Glycine max
  Coding DNA Sequence Number=SeqID_88880
MGDANSKFEILNWAFQTVFQRWIASGGSNPVRLGELGGNLLPLFPIKRQNGVVLRVPDSPGYAFQLKSMKVFIRSSFFN

SEQ ID NO: 180566 - protein, 77 aa, Glycine max
  Coding DNA Sequence Number=SeqID_88881
  Gene Ontology: Mol. function=protein binding
  Homolog annotation: Hit_ID=A7P6V8; Match level="QueryCoverage=77%, HitCoverage=17%, E-value=5e-18, Identity=60%"; Hit description =Chromosome chr9 scaffold_7, whole genome shotgun sequence
MSDWRKGSQWFEINRELALRIVEDNTYYPKLKGSHYFQTMLTINTPHLLANRSLTYVDWSSFMLIHLVQPIIFGATR

SEQ ID NO: 180567 - protein, 48 aa, Glycine max
  Coding DNA Sequence Number=SeqID_88882
MWTTTGEELATQLAQASKVASSRSNSLLEEESGRPKNRSSGGKIRGLG

SEQ ID NO: 180568 - protein, 233 aa, Glycine max
  Coding DNA Sequence Number=SeqID_88883
  Homolog annotation: Hit_ID=Q84VH5; Match level="QueryCoverage=55%, HitCoverage=18%, E-value=9e-67, Identity=96%"; Hit description =Envelope-like protein
MDLIKAAGLLKTVTKLGDCYECLVREFIVNIPSDITNRKSDEYQKVFVRGKCIRFSPAVINKYLGRPTEGVVDIVVSEHQIAKEITAKQVQHWPKKGKLSAGKLSVKYAILHRIGTANWVPTNHTSTVATEERISSIPALQLFEGTHVPDIVSTSGKAAASGAVSKDDLIAELKDTCKVLEATIKANTEKKMELERLIKRLSDNGIDDGEAAEEEEDAAEDTESDDDDSNATP

SEQ ID NO: 180569 - protein, 72 aa, Glycine max
  Coding DNA Sequence Number=SeqID_88884
  Subcellular localization annotation: CTP_CleavageSite=25; ConfidenceScore=5.02e-01
IIGPNLGPWAQKSILRLMRTLRPSSAALAQSSWSLLLMALVTRHQRLFVENIGKTEGIGHEEYSRFGSCIYV

SEQ ID NO: 180570 - protein, 53 aa, Glycine max
  Coding DNA Sequence Number=SeqID_88885
MPMQRHMRECAQYDIFTDIAKGGIIPFDEHIVAVGTTSNNRFSKRKALDEGSL

SEQ ID NO: 180571 - protein, 107 aa, Glycine max
  Coding DNA Sequence Number=SeqID_88886
MTEKKIITIIVHTLPVFYYEKTVGYAPSSFANLVFADKRIEAGLKRGKFDHPTLMSEKAGANEEDENEGETLAMIAIPTRSNFPSAQQCHYSANNSPSHPIIHKDHP

SEQ ID NO: 180572 - protein, 71 aa, Glycine max
  Coding DNA Sequence Number=SeqID_88887
MIEPSMLIKTHLDTKNFVDTTNCLPLKGKQLVVYPLKTLRKALSITHNYTSCIPQQVKTLMLWQKWESWTI

SEQ ID NO: 180573 - protein, 84 aa, Glycine max
  Coding DNA Sequence Number=SeqID_88888
MGTGAERNEMRSGTWRYVAGVRRPWGCQVGAIAQNQAWLIPTQPGHSQSVRTCDVPKQASSWQSTNKRTKSTKQGSLCGGWPAM

SEQ ID NO: 180574 - protein, 45 aa, Glycine max
  Coding DNA Sequence Number=SeqID_88889
MAHQALRGNVTSPKTFEAFNVASPFLETSLRGAAPKIPWAWSFLG

SEQ ID NO: 180575 - protein, 51 aa, Glycine max
  Coding DNA Sequence Number=SeqID_88890
STLEDPLAWPGDWPEAQAGEAPPEAPGDGGEAHEDEEMADLLDFLGGSGDT

SEQ ID NO: 180576 - protein, 159 aa, Glycine max
  Coding DNA Sequence Number=SeqID_88891
MAPRKLASKRSRKDVAAAGTSVVPEFDSHHFRSAEHQQRFEAIKGWSFHRERRVQLRDDEYTDFQEEIARRRWTSLVTPMAKFDLDIVLEFYANAWPTEEGVRDLWSWVRGQWIPFQWGQECEYGQRRNQADGFDEEAIAQLLCIPGQDFARTAAGRRV

SEQ ID NO: 180577 - protein, 74 aa, Glycine max
  Coding DNA Sequence Number=SeqID_88892
MSVKNLVGRLGVHDKTNHIIICQLGSQCFARMLQPYGINIGLKEHSNRVTPKAYTPKSPSGPLPPDSGPTQKTF

SEQ ID NO: 180578 - protein, 108 aa, Glycine max
  Coding DNA Sequence Number=SeqID_88893
  Gene Ontology: Mol. function=protein serine/threonine kinase activity; Cellular component=cytoplasm; Biological process=protein amino acid phosphorylation
  Homolog annotation: Hit_ID=A7Q5W6; Match level="QueryCoverage=85%, HitCoverage=15%, E-value=4e-21, Identity=57%"; Hit description =Chromosome chr14 scaffold_54, whole genome shotgun sequence
MINANCPQESLHSVSNGNLSLYNKFLKRISAKNLTPRAAAIEQGIAMSMWKSIQDSNPEDLERLYSEVHLLKTLKHKNIMKFYTSWVDTTNRHINFVTEMFTSGTLRQ

SEQ ID NO: 180579 - protein, 380 aa, Glycine max
  Coding DNA Sequence Number=SeqID_88894
  Gene Ontology: Mol. function=protein binding; Cellular component =protein complex; Biological process=hyperosmotic response
  Homolog annotation: Hit_ID=O81694; Match level="QueryCoverage=96%, HitCoverage=96%, E-value=1e-149, Identity=70%"; Hit description=19S proteosome subunit 9
  Pfam annotation: Domain name=PCI; Domain location=242-346; Score =103.3; E_value=7.6e-28; Accession=PF01399.18; Description=PCI domain
MTSFLPATTESLDLAVDAKDPSESISILYQVLDYPSSSPDALRMKEQAITNLTEHLREQNRAEDLHSLLTQLRPFFSLIPKAKTAKIVRGIIDSVAKIPGTTDLQITLCKEMVQWTRAEKHTFLRQRVEARLAAFLMESKEYSEALTLLSSLVKELLIYVPPAQQGSIDLQSGILHAEEKDSKTAYSYFFEAFESFNALDDPKAVFSQKYMLLCKIMVSQADDVAGIISSKAGLQYLGPDLDAMKAVADAHSKRSLKLFEIALRDFKAQLEEDPIVHRHLSSMYDTLMEQNLCRLIEPFARVEIAHIAELIELPVDPVERKLSQMILDKLFAGTLDQGAGCLVIFDDSKTDAIYPATLETISNIGKVVDSLFVRSAKIVA

SEQ ID NO: 180580 - protein, 95 aa, Glycine max
  Coding DNA Sequence Number=SeqID_88895
MTTEEAVVRVAKVAGGAVGGNEGGRKGHRAKVSESSLGIVENWFNSEYVVKIGKDEWDVKKIGLVHEEYLLNEEGHNVNPFGPSKPTSPSHKTKP

SEQ ID NO: 180581 - protein, 115 aa, Glycine max
  Coding DNA Sequence Number=SeqID_88896
  Pfam annotation: Domain name=DUF827; Domain location=2-110; Score= -114.7; E_value=0.071; Accession=PF05701.2; Description=Plant protein of unknown function (DUF827)
MGRIGNWFFKKTSDFDSLRHVTQDVGGAKESLQKVTGQEDTPRSMVEDLRMELEKVKRGHSELKEKESKIESIVENVQNDTAKLKIKAAVAKLLLEDAETKVKVAVEEVEPPNAA

SEQ ID NO: 180582 - protein, 258 aa, Glycine max
  Coding DNA Sequence Number=SeqID_88897
MGRVNLGLNVRMVVIMSIRTCRKAWAEQMRKRNDKCERKESFLGKNFKSIQRLTNHNEENVTGLGGVDGDPVLRGTRIRATWECVSSVERWATGDVVAGDMSRGSGDLGDVRLKNGDMMLKWPLGDRALVIDYHLGVIDYTIAMAAQLIHDRVVMESLEGVWETLEGNERFRFRGTIRLTATSLPVQVIEVSSSEEDPEEDLEELPPEPVVDALDLPGDDEDPLPDVDFPEDVLSASEADSIEESGPGGTANSDNSSS

SEQ ID NO: 180583 - protein, 111 aa, Glycine max
  Coding DNA Sequence Number=SeqID_88898
MARVNDTRGVDGKESGGDGFGVVGEGWAWSTRVRGLGGGVMTRWWHMVWGIGSNLVEDGNGSCLKVARGGDDNVDNLLYLGRLTYHMDKPMKIMRYNFNCHANYIWDQMSS

SEQ ID NO: 180584 - protein, 204 aa, Glycine max
  Coding DNA Sequence Number=SeqID_88899
  Gene Ontology: Mol. function=oxidoreductase activity; Cellular component=integral to membrane; Biological process=electron transport
  Homolog annotation: Hit_ID=A7PW83; Match level="QueryCoverage=76%, HitCoverage=32%, E-value=1e-33, Identity=50%"; Hit description =Chromosome chr8 scaffold_34, whole genome shotgun sequence
MVMETYINNLPYLQAIVKETLRLHPPSPFVLRESTGNCTIAGYDIPAKTQVFTIVWVIGLKGFLAMIMRVEKWVKLGSGDTIINFFLGSGRRGCPGASLALKVAHTTLAAMIQCFELKAEEKGGYCGCVDMEEGPSFILSSVEPLICVRKSRLMSFPLYHAKYYFLVSLKLRPSMKPRSKVRLLVDVVNKVRLFWSLRLKSNFF

SEQ ID NO: 180585 - protein, 190 aa, Glycine max
  Coding DNA Sequence Number=SeqID_88900
  Gene Ontology: Mol. function=nucleotide binding; Cellular component =intrinsic to membrane; Biological process=defense response
  Homolog annotation: Hit_ID=Q2YE88; Match level="QueryCoverage=57%, HitCoverage=8%, E-value=2e-44, Identity=82%"; Hit description=NBS -LRR type disease resistance protein Rps1-k-1
NESFPEGGMPPNLRTVSIENCEKLMSGLAWLSMGMLTDLTVWGRCDGIKSFPKEGLLPPSLTFLYLYGFSNLEMLDCTGLLHLTSLQELTIRECPLLENMVGERLPKAHIYACKADLPGQKEEEAMAQSADGKVFKIVPCHHLEHSTSNSLSIRALSHDLTGSDRGGFDQIDKDDSNLPLDTAPIKHVTQ

SEQ ID NO: 180586 - protein, 168 aa, Glycine max
  Coding DNA Sequence Number=SeqID_88901
MTPEELEQLTQQIRDQLEESITEKMQSQFQSQMQSQCLALPSKPEVGPSVARVSTKESCVDPSGNDPDTGDSDKCRLYIEENNPRLVALGRVYEGSITVHNIPLLHDQVKVGVEEDKDIDAPVPVSTDKVIWDVTVFVVFNEDFQLYIKHEDLSEIAHSGQCLSISVI

SEQ ID NO: 180587 - protein, 141 aa, Glycine max
  Coding DNA Sequence Number=SeqID_88902
MYETDDDITFEGPKKAIQIKRGKYIALQICNDEDVETMIQSFEQQQEMSVIELCVEVDVTGAFAINLTNSLLSCENNMSHNESGSATVGTNSEEDFDDDDYLISNSYVEDSLDEDEDIDEMFDTDDEAACLIEPLIVVQSG

SEQ ID NO: 180588 - protein, 69 aa, Glycine max
  Coding DNA Sequence Number=SeqID_88903
MTRTKTLQEEEQERNKDTNKNATRRKQENKIEPVSRAEALIPDDVILTRSGSLDTGYGDLDDATSSKGR

SEQ ID NO: 180589 - protein, 79 aa, Glycine max
  Coding DNA Sequence Number=SeqID_88904
MVEVSIEAIASLAQYYDQPLRCFTFGDFQLSPMVEEFEEIQGCLLGGRKPYLFSRFYPSLARISKIVQISADRGRTRIK

SEQ ID NO: 180590 - protein, 143 aa, Glycine max
  Coding DNA Sequence Number=SeqID_88905
MDNEEGVHEQMKADLSTLKDQMASISEDKATATASSTVREAEPVLQPALNPGRDRNTAVFCRRYSPQAYPYGLPPDFTPRATPEDLSQAPTFEGQLPPYDDYPGQDDKEGDTHLAPLLHLKDPSPHELPQPNIVRHIPASPTP

SEQ ID NO: 180591 - protein, 66 aa, Glycine max
  Coding DNA Sequence Number=SeqID_88906
GRRNSYLGRLAIQLNREPSSHYFFRWQLAAGTGPATRVVHRAAVFPSQAEKTSKESLSMALPGNPS

SEQ ID NO: 180592 - protein, 154 aa, Glycine max
  Coding DNA Sequence Number=SeqID_88907
MSCVGETSSQTIANSRLAFIFPNGSITHNQTGVYFQSPTPTPMRIPNDYSFDTLKRRMHNTLQLTNDQLVDEIYYRQPFIDAELLCIIIRTLDVILNLLQSTITPTHHAIMYYNGKWNIPRQGGFLGYSFTGTNPIRSGIPSGCGMDKLNDLIK

SEQ ID NO: 180593 - protein, 57 aa, Glycine max
  Coding DNA Sequence Number=SeqID_88908
MPRWHDLAGGDEHPVGLTEARNQSWKPQGPVGLLRVHLPPPLVALAQLALLQDQGMA

SEQ ID NO: 180594 - protein, 27 aa, Glycine max
  Coding DNA Sequence Number=SeqID_88909
MVGALCDETMVCPSWVTMPSTSPSIGG

SEQ ID NO: 180595 - protein, 87 aa, Glycine max
  Coding DNA Sequence Number=SeqID_88910
MTTGRINQQAPGQASSETTDFKDNVGALDHPRSLHAPHPRDITTRVPQEAVMMTTNVVHVWDFEILQRPQQRGLDGMGLTSHTNTVW

SEQ ID NO: 180596 - protein, 152 aa, Glycine max
  Coding DNA Sequence Number=SeqID_88911
STEFEHPPHLSDGKIGESKRATTSPDEESERSTAPPTGESGGSATSPAGESWGAAVSLDGKSEMIIRGGDGGTTSSSGEEGGFTTGDCGSAGSGSTYVGVGSGGAASLSYPNFVRGLLLDDMQPLDSRFEILGVLCCTINEVPRRVRNQKEA

SEQ ID NO: 180597 - protein, 68 aa, Glycine max
  Coding DNA Sequence Number=SeqID_88912
MSMNKMYFYLSTISFASSNRIEVSALLGRMPSAAIPLFGTEMVSLKKKESLGRIAQIIGPVLDVAFPP

SEQ ID NO: 180598 - protein, 198 aa, Glycine max
  Coding DNA Sequence Number=SeqID_88913
MDIIEVPTFYHQQWAPEYPEFVNFRYDGTIYQIRLRQHRAKVYFAEGLKEFRKDLSIYESVIIKFLACNSKSMFDLYFVPSLECQTCGRPEVMSRQYIWTLEITQSILGAPGPLRLPNCAMTYVNACGQHMTILRRFGTPLQWNVVVDGGIGRIYVVQPWYQFLADNDLSHGDEVSFYYKTIDKIWEIVICRRKNWEY

SEQ ID NO: 180599 - protein, 156 aa, Glycine max
  Coding DNA Sequence Number=SeqID_88914
MTSEPPKEIADKIDVLTASIGRPEHPGRVHAARASVTIKHYFGPASRGSYTSSSMASKDLEQLAQKIRDQLEESITQKSQMQSQRLALPPEAEVGPSIACAITKEICIDPSGQDPERETWTNVGCMLMIVLPNWLLLEEFMRGRQLTTMFLWAMIK

SEQ ID NO: 180600 - protein, 211 aa, Glycine max
  Coding DNA Sequence Number=SeqID_88915
MAKFDPDIVLEFYANAWPTEEGVRDMRSWGLECEYGQRRNRSDGFDEEAITQLLCIPGQDFARTAAGRRVQIMRTNMTTLTQIWMTLLLSNILPSDHNFDLPLPKCQLVYAILTRMRIHVAQLIADAIYIFAGMAPTRHPLDPDKSNRALGFPALITGLCQSFGVPVAPSKVIRPPITRAFIEKYCTQRQVQGDAPQAADAPPPHQAGPAG

SEQ ID NO: 180601 - protein, 71 aa, Glycine max
  Coding DNA Sequence Number=SeqID_88916
MSLKSTLRLMRTLGPSVEESFVMMNQAILMLPKAQVIDFKTSIKIKHQESNPRFKIQEKKSRSNKSRLHIG

SEQ ID NO: 180602 - protein, 61 aa, Glycine max
  Coding DNA Sequence Number=SeqID_88917
  Homolog annotation: Hit_ID=A5BSR3; Match level="QueryCoverage=98%, HitCoverage=19%, E-value=5e-07, Identity=45%"; Hit description =Putative uncharacterized protein
MARTKKTGQMTSEAAKEIVDNIDSLEDQASQGSFVAHGRQDVLTAAIGRPAHPGCVRAAGA

SEQ ID NO: 180603 - protein, 115 aa, Glycine max
  Coding DNA Sequence Number=SeqID_88918
  Subcellular localization annotation: CTP_CleavageSite=54; ConfidenceScore=5.30e-01
YLSPPARASGPLVSSFHQEVLRLQAGAGRNTTAAWGWPAAGNRRTAITSRVHLSSSTKRTHLVAHDPRNLNKTSTSSEGHPLYPRTAGQTLTYIMTSRSTSLEPKSQLTINLDPG

SEQ ID NO: 180604 - protein, 203 aa, Glycine max
  Coding DNA Sequence Number=SeqID_88919
  Homolog annotation: Hit_ID=A5BRA1; Match level="QueryCoverage=70%, HitCoverage=16%, E-value=4e-09, Identity=31%"; Hit description =Putative uncharacterized protein
MVTPFKTKDINEEITSKDIKSLMEQANYTNKYLQVLGESINREKVSPKHKTHEGSASNVQIEKPLFKPFKVSEKAKQKIIKLRKNKTFTEGIGDNNSELLNKIDSLLKVIPETPHASEESSKMRTRSTSKLINVINDDSNQNSEQTTEEDSVSGKDINPINTKHWKSSSKHYCQRPTALIFYWKKEAKIILKALVQTTSMNGI

SEQ ID NO: 180605 - protein, 42 aa, Glycine max
  Coding DNA Sequence Number=SeqID_88920
MTIKEGLQKVIWFPMQRTEPNNNMLPRTQNYELPMCPACHSH

SEQ ID NO: 180606 - protein, 33 aa, Glycine max
  Coding DNA Sequence Number=SeqID_88921
MAGGSEFHPKIVCWLAKSQLFGTRMGTGVEVWK

SEQ ID NO: 180607 - protein, 369 aa, Glycine max
  Coding DNA Sequence Number=SeqID_88922
  Gene Ontology: Mol. function=nucleoside-triphosphatase activity; Cellular component=integral to membrane; Biological process=transport
  Homolog annotation: Hit_ID=A7QT44; Match level="QueryCoverage=99%, HitCoverage=71%, E-value=4e-85, Identity=41%"; Hit description =Chromosome undetermined scaffold_165, whole genome shotgun sequence
  Pfam annotation: Domain name=ABC2_membrane; Domain location=151-330; Score=-28.1; E_value=0.047; Accession=PF01061.15; Description=ABC-2 type transporter
MGLQDAINTRIGGRGSKGASGVQLPTRRIATLAQNDHIQRTVIASIHQLSSEVFQLLNNLCLLSSGKTVYFGPASAANEVLLQCLCSFSLQINGFPCPVLMNPSDNLMKTMNKFFDQDIEVGLLGIEKYPQKKQSASFSIEWKRGHAGFFNQCLVLTERSFANMYRDLGYYWLQFAIFVALAIALATIFCDLGTSYGSVQDPGSLIAFINGFLTFMTIGGFPSFVEVMKVFQRERQNGHYVDSLMMIVASVVPNFLMGIMTGAGIQGIMLLLDGFFKLPRLRFASNEVGGGYISGEDILRNTWQVDTSYSKWVDLAILIGMIVVYRVLFLVIIKIKEKMKPVVVSLSCMSASSKRTIQVMENPNATPLH

SEQ ID NO: 180608 - protein, 309 aa, Glycine max
  Coding DNA Sequence Number=SeqID_88923
  Gene Ontology: Mol. function=protein serine/threonine phosphatase activity; Cellular component=protein serine/threonine phosphatase complex; Biological process=protein amino acid dephosphorylation
  Homolog annotation: Hit_ID=A7QTV5; Match level="QueryCoverage=85%, HitCoverage=75%, E-value=1e-104, Identity=70%"; Hit description =Chromosome undetermined scaffold_171, whole genome shotgun sequence
  Pfam annotation: Domain name=PP2C; Domain location=114-308; Score =96.4; E_value=8.8e-26; Accession=PF00481.12; Description=Protein phosphatase 2C
MECNKDEAARAKEIVEIAVRAKKMTYALVAIFLMSLVVQAGTFVNRVRINEFGRSLLAVQSFSHWPIREYKTITGMMVDTGSMSSAGPLVDMMPEKDDDGRFASGGWKSEDGRLSCGYSSFRGKRVTMEDFYDIKTLKIGGQSICLFGIFDGHGGSRAAEYLKEHLFDNLLKHPNFLTDAKLAISETYQQTDANFLDSEKDTFRDDGSTASTAILVDSHLYVANVGDSRTIISKAAIALSEDHKPNRSDERKRIENAGGVVMWAGTWRVGGVLAMSRAFGNRMLKQFVVAEPEIQVILDYCVQSEYIVY

SEQ ID NO: 180609 - protein, 82 aa, Glycine max
  Coding DNA Sequence Number=SeqID_88924
  Subcellular localization annotation: CTP_CleavageSite=40; ConfidenceScore=5.64e-01
MSPPPLGPHNHSQTYLKLFNATSSSSSILCGSSFSQILPRAQPRSVVLNGWLVKPEDWLSERVKINTSQTCLINLKLRENDY

SEQ ID NO: 180610 - protein, 73 aa, Glycine max
  Coding DNA Sequence Number=SeqID_88925
MEIFYMLSLLAIAASFFYFEFVMQAPLELVGLGSSSSMDSFASWKINGSGMKKEEREETPLQGEDESRRSSPP

SEQ ID NO: 180611 - protein, 209 aa, Glycine max
  Coding DNA Sequence Number=SeqID_88926
MKDKRDEEEKLEKQKKKKDSKALSSKAKGKGKEENDSSKKIVKKENHFATKGDIKRALLLKQSFYLLLSREKSLSTAIPLELEVIPQVKELLDEGLVRKSLNPCTLLVPKIGIIRHQIPMIGGMMNMLSSATLFSKITHAPNIFMICVHRDSLGRNNQHENKEKGMFYSITFLKFVNSDQGLPMDPKRIKVILEWPTPPSIREIWGFIS

SEQ ID NO: 180612 - protein, 357 aa, Glycine max
  Coding DNA Sequence Number=SeqID_88927
  Gene Ontology: Cellular component=integral to membrane
  Homolog annotation: Hit_ID=A8GJY0; Match level="QueryCoverage=30%, HitCoverage=88%, E-value=2e-45, Identity=84%"; Hit description =Putative uncharacterized protein precursor
  Pfam annotation: Domain name=DUF1090; Domain location=240-354; Score =164.0; E_value=4.1e-46; Accession=PF06476.3; Description=Protein of unknown function (DUF1090)
  Subcellular localization annotation: CTP_CleavageSite=32; ConfidenceScore=5.51e-01
PVARQYANGARLAFAPAGPLPSTRSQPVPPPRAFRPAGRPLPGLRAHPAADHRRPVRPEQRALPVLQLDERPAVGLDPDNAGLRAGQNPADVLPDDVAAGIAGGRVDRLVDRAVAQETRQRPEPGERGVTAKRPRWQYVLMIALALLALATLLVPCMVRTESELRIRASQQGLSLPDGFYVYQRLDERGIRIKSITPEGDGLVIRLDSPEQQLLAREALQTILPPGYHIALSESPVPSHWPAMNALLSRCRLRQSGKRGGCAAKAQDIQQQIDYATQHGNTHRVDGLKKALSEVQTHCTEAGLQAERQKNIAEKQRKVDERRQELKEAQQTGKLDKVAKKQQKLAEAQAELKRAQAE

SEQ ID NO: 180613 - protein, 185 aa, Glycine max
  Coding DNA Sequence Number=SeqID_88928
MTCVANSFMNNCGRSKVDQSLYGLLEPQSIHNAKDRREQCQEYIQTWVKESQRQLYLGAYLHQAHWQLFVLCPRENTVVWFCSLRKKPDINIKATINSAMKTITSSFQGMSNQAAPRWVEPKSCPNWSVRVRILCHALDVVHSDWWMKDDWNKWFSDGSPLDVEAITTLRQKWATFFLSIRKSGC

SEQ ID NO: 180614 - protein, 138 aa, Glycine max
  Coding DNA Sequence Number=SeqID_88929
MDPKRIKVIPKWPTPPTPLIELVRNYILSWEDDHERGVEERIHEFQEPMDLSSFLLSVSGPPPDIRGGPTVQAQPEREAITQLLCIPGQDFTRAAAKKRVRIMRTNMTTITQIWMTLLLSNILPSDRNADFHLRNYQL

SEQ ID NO: 180615 - protein, 43 aa, Glycine max
  Coding DNA Sequence Number=SeqID_88930
RLDIVRDAILPRKGPVTRAMSKRLQEDWARAAEEGPRVLMNLR

SEQ ID NO: 180616 - protein, 161 aa, Glycine max
  Coding DNA Sequence Number=SeqID_88931
  Homolog annotation: Hit_ID=Q2HTA0; Match level="QueryCoverage=76%, HitCoverage=18%, E-value=2e-16, Identity=42%"; Hit description=IMP dehydrogenase/GMP reductase, related
  Pfam annotation: Domain name=DUF1723; Domain location=11-60; Score =58.4; E_value=2.4e-14; Accession=PF08330.1; Description=Protein of unknown function (DUF1723)
LSPLVDCSVVTSNLGLISAFVERWHNETSTLHLPVGELTITLDDVSSLLHLPITGALYSFHALSMEEVRFLLTQLLEVSTEEARAETALTRGAYVRLGWVFGTRDDVLQWARIVAHENGFVAVIMRSDTETGSKGRSSFVLIGCERSGTYKCMLDKWPQLS

SEQ ID NO: 180617 - protein, 344 aa, Glycine max
  Coding DNA Sequence Number=SeqID_88932
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=81%, HitCoverage=97%, E-value=1e-146, Identity=94%"; Hit description=Beta- lactamase TEM precursor
  Pfam annotation: Domain name=Beta-lactamase; Domain location=31-280; Score=185.2; E_value=1.6e-52; Accession=PF00144.15; Description=Beta- lactamase
  Pfam annotation: Domain name=Peptidase_S11; Domain location=29-263; Score=-122.5; E_value=0.033; Accession=PF00768.11; Description=D -alanyl-D-alanine carboxypeptidase
  Pfam module annotation: Pfam domain module=Beta-lactamase::Peptidase _S11; Domain location=31-280::29-263
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGHHFKNSVAPPTYLALLILLPVAAASGDKSCLTGATLPEGRKADRYPVSGRVGTGERTRELPGGNA

SEQ ID NO: 180618 - protein, 120 aa, Glycine max
  Coding DNA Sequence Number=SeqID_88933
  Subcellular localization annotation: CTP_CleavageSite=42; ConfidenceScore=5.43e-01
MPISPCKSISWSVSSQHGIAPTKTPSDPRSPTGPWGFQLWLRASVVYRVPVPPDKGLCPQDTQWTQISPTGSWSCQALITGLCQFYGVPVTSSKGIKPPTNRAFIKKYCIPRQAQGETPQ

SEQ ID NO: 180619 - protein, 103 aa, Glycine max
  Coding DNA Sequence Number=SeqID_88934
  Homolog annotation: Hit_ID=B0HC01; Match level="QueryCoverage=32%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARGRKRGVL

SEQ ID NO: 180620 - protein, 343 aa, Glycine max
  Coding DNA Sequence Number=SeqID_88935
  Gene Ontology: Mol. function=hydrolase activity, acting on carbon -nitrogen (but not peptide) bonds
  Homolog annotation: Hit_ID=A1FZD6; Match level="QueryCoverage=32%, HitCoverage=24%, E-value=1e-57, Identity=95%"; Hit description =Amidohydrolase 3 precursor
PFLEGLVVFPDPAVGGVDRAGPVVVAEVADHGRNRTLQREGRQGRDFRRQVIARGTLATDRSDRQHQVTQLVLALEATALAQEQHRLGHHRRQQVHDDRGIGAAHAEVDHGDAINGGTGHRPVQADDRRAGQLGERMQVAPEVGQQDVLAELVQGHAGIPGQPVVDDFLLALHGRSGTAGDRVFSATRPVPSSYRRQACEEGCKGNCMASTLLRAGVALALLSLSTAPAVGASRFVADPYSSTYQAHPDAPILIQNATVLTGTGQRLDNADVLLRDGRIVAVGRQLQADAGVTRIDAQGKWVTPGLIDVHSHLGVYPSPGVGAHSDGNEMTAPVTANVWAEHS

SEQ ID NO: 180621 - protein, 51 aa, Glycine max
  Coding DNA Sequence Number=SeqID_88936
MASIIDGQFALLWPPCRAFIFSCTSSASPITLALARVRNGFMIPTWLGGIL

SEQ ID NO: 180622 - protein, 44 aa, Glycine max
  Coding DNA Sequence Number=SeqID_88937
MADEHQQRVTLEDYSSSSMSQFFTSIARPKEKPRGGSTHLRVTV

SEQ ID NO: 180623 - protein, 271 aa, Glycine max
  Coding DNA Sequence Number=SeqID_88938
  Pfam annotation: Domain name=Transposase_23; Domain location=51-121; Score=8.6; E_value=0.00013; Accession=PF03017.5; Description =TNP1ENSPM transposase
  Subcellular localization annotation: CTP_CleavageSite=34; ConfidenceScore=5.35e-01
MASFSHMQSQLQSQMQSQGLAVPPNPLVGPSDPRVSTKGSCVDPSGNDPKTGDSDRCGLYIEADPTRLVAMGRVYEGSTVVHNTPLLPGQVKVSVKEVTDADAPVPVPTAEVSLVRQALHTFLAWPTHLIKSLSNQVVVSPPKPPPKPDPEVDDPLYLMTLSIPELFLRPYQVRWDATVFGVVNPDFPLYIKHEDLSEIAHGGQCLSISVLQLWILHLTETCMRAGNYDIYGFLEPQSIQRSGQSQFESESYIKSWMQSSTTRCVSWRGIL

SEQ ID NO: 180624 - protein, 133 aa, Glycine max
  Coding DNA Sequence Number=SeqID_88939
MKADLSALKDQMASISKVMLKLQKTIEDKATATASSTVREAEPVLQPALNPGLDRNTAVFGRRYSPQAYPYGLPPDFTPHANLEDLSQAPTFEGQLPPYEDYPGQDYGEGDTHLGPLLHLKDPSPHELPQPNI

SEQ ID NO: 180625 - protein, 288 aa, Glycine max
  Coding DNA Sequence Number=SeqID_88940
  Gene Ontology: Mol. function=aspartic-type endopeptidase activity; Biological process=DNA integration
  Homolog annotation: Hit_ID=A5C7C5; Match level="QueryCoverage=55%, HitCoverage=24%, E-value=3e-15, Identity=31%"; Hit description =Putative uncharacterized protein
  Pfam annotation: Domain name=zf-CCHC; Domain location=224-241; Score =33.4; E_value=8.2e-07; Accession=PF00098.14; Description=Zinc knuckle
YILCGTSRGYIYLGCYTENKRGYISCGLVQVEGTSTWLFKENKGGYIPCGSLACKGFYKVERNLKNRSLLGDWIKSLRTSTTTQKPRYKWIEEDRRRIQYNLKAKNLITSALGIDEYFRVSNCSNAKEMWDTLQLTHEGTTDVKRSKEHEMELQRLNQNKETDKRKRSIALKVSSSMQEEEESDDEEDFSLFVNKFHKFVKNRRMERSHNFNNGKRSQEVSPTLKCYKCNQPGHIKANCPTNESWPKKNEKKSYKERRSKKAHIAWDDNDSSDGLEKEINLLSKGGIL

SEQ ID NO: 180626 - protein, 253 aa, Glycine max
  Coding DNA Sequence Number=SeqID_88941
  Gene Ontology: Mol. function=transcription factor activity; Biological process=regulation of transcription, DNA-dependent
  Homolog annotation: Hit_ID=Q2K4X0; Match level="QueryCoverage=32%, HitCoverage=26%, E-value=1e-28, Identity=77%"; Hit description =Probable transcriptional regulator protein, LysR family
  Pfam annotation: Domain name=HTH_1; Domain location=148-207; Score =71.9; E_value=2.1e-18; Accession=PF00126.18; Description=Bacterial regulatory helix-turn-helix protein, lysR family
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPAMDRIDTMRVFTRVVARRSFTRAAEDLGLPRSTVTDAIKQLESRLGIKLLERTTRHVSPTLDGEAYYKRCVSILDDIEGYRARIRNHGHSCFLCEIVIRSQFHTTYEPEA

SEQ ID NO: 180627 - protein, 104 aa, Glycine max
  Coding DNA Sequence Number=SeqID_88942
LGRIDGDLALRGTRIRAMWEYVSSVESGTWRYVAGVRRPWGRQASSWQSTDKRNEDHKARRLVWWLASCELCLIYGIWPLVIDYQGLENEVRKLGGLLVIDYQA

SEQ ID NO: 180628 - protein, 350 aa, Glycine max
  Coding DNA Sequence Number=SeqID_88943
  Gene Ontology: Mol. function=fructose-bisphosphate aldolase activity; Cellular component=cytoplasm; Biological process=metabolic process
  Homolog annotation: Hit_ID=A1G1W1; Match level="QueryCoverage=53%, HitCoverage=55%, E-value=6e-89, Identity=90%"; Hit description =Fructose-bisphosphate aldolase
  Pfam annotation: Domain name=Glycolytic; Domain location=40-305; Score=162.3; E_value=1.3e-45; Accession=PF00274.10; Description =Fructose-bisphosphate aldolase class-I
STLEDPRSRRADPTQGQIRKGALTRRNRTSPVRKYMSIEQLAETAQAMVAPGKGIIAIDESTATIAKRFAGVGIENTEENRRAYRELLLTTPKLNEHISGAILFDETIRQSTKDGVPFAKYMADHGMIPGIKVDKGAHPLAGCPGELVTEGLDGLRERLQEYYKLGARFAKWRAVINIGESIPSGTCHRVQRPRAWPAMPRCARKCGLVPMVEPEVIMDGDTTSRPATKSPKPPCVRCSTPCRRRGSGRVDRDVPEEHRAGHPAGRGVPVRWPERRAVHRAPERDEPAGQPAVAAELLLRPRHAAGRAEAVGQGHEGQLRCCPEDRVRARQGQRPGRAGQVERLIRPIAG

SEQ ID NO: 180629 - protein, 59 aa, Glycine max
  Coding DNA Sequence Number=SeqID_88944
MVPIYTNPSLKFQLKIIVKTSAKTRGNWKGGLVPYLEGFESRRKGPTTLGAIGLRSTPN

SEQ ID NO: 180630 - protein, 172 aa, Glycine max
  Coding DNA Sequence Number=SeqID_88945
MSTVALVVVGSMVVGVAAGVDAGERQSKRLRGEDANDNENDDMCGFITELPWEAAMGSDAGLGVGLGGLGAGYGIGGSIGRGGGTSDGGGDRWAEEGNSSGGGSGGCGGGTDEGNGDRWRNIMVSNCWLMRSSLKSMDVWNASSRRLAAEGAASAIEERRGGQVGPIVMNSN

SEQ ID NO: 180631 - protein, 1068 aa, Glycine max
  Coding DNA Sequence Number=SeqID_88946
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=98%, HitCoverage=95%, E-value=0.0, Identity=59%"; Hit description =Functional candidate resistance protein KR1
  Pfam annotation: Domain name=LRR_1; Domain location=482-498; Score =0.4; E_value=2.5e+02; Accession=PF00560.24; Description=Leucine Rich Repeat
  Pfam annotation: Domain name=LRR_1; Domain location=568-593; Score =2.2; E_value=1.2e+02; Accession=PF00560.24; Description=Leucine Rich Repeat
  Pfam annotation: Domain name=LRR_1; Domain location=631-652; Score =8.5; E_value=8.1; Accession=PF00560.24; Description=Leucine Rich Repeat
  Pfam annotation: Domain name=LRR_1; Domain location=654-676; Score =13.5; E_value=0.81; Accession=PF00560.24; Description=Leucine Rich Repeat
  Pfam annotation: Domain name=LRR_1; Domain location=678-699; Score =3.5; E_value=68; Accession=PF00560.24; Description=Leucine Rich Repeat
  Pfam annotation: Domain name=LRR_1; Domain location=700-722; Score =15.5; E_value=0.2; Accession=PF00560.24; Description=Leucine Rich Repeat
  Pfam annotation: Domain name=LRR_1; Domain location=724-745; Score =8.7; E_value=7.6; Accession=PF00560.24; Description=Leucine Rich Repeat
  Pfam annotation: Domain name=LRR_1; Domain location=747-768; Score =8.1; E_value=9.8; Accession=PF00560.24; Description=Leucine Rich Repeat
  Pfam annotation: Domain name=LRR_1; Domain location=802-825; Score =1.5; E_value=1.6e+02; Accession=PF00560.24; Description=Leucine Rich Repeat
  Pfam annotation: Domain name=LRR_1; Domain location=827-848; Score =7.3; E_value=14; Accession=PF00560.24; Description=Leucine Rich Repeat
  Pfam annotation: Domain name=LRR_1; Domain location=850-875; Score =10.3; E_value=3.8; Accession=PF00560.24; Description=Leucine Rich Repeat
  Pfam annotation: Domain name=MotA_activ; Domain location=423-517; Score=-10.0; E_value=0.1; Accession=PF09114.1; Description =Transcription factor MotA, activation
  Pfam annotation: Domain name=NACHT; Domain location=218-371; Score= -0.4; E_value=6.3e-05; Accession=PF05729.3; Description=NACHT domain
  Pfam annotation: Domain name=NB-ARC; Domain location=179-470; Score =163.4; E_value=6.2e-46; Accession=PF00931.13; Description=NB-ARC domain
  Pfam annotation: Domain name=TIR; Domain location=14-153; Score =165.1; E_value=1.9e-46; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::MotA _activ::NACHT::NB-ARC::TIR; Domain location=482-498::568-593::631 -652::654-676::678-699::...
  Pfam module annotation: Domain location=700-722::724-745::747 -768::802-825::827-848::850-875::423-517::218-371::179-470::14-153
MAAISCSYVFTYDVFLSFRGSDTRHGFVGNLYKALNDKGIHTFIDDEKLQGGEEITPTLMKAIEESQIAITVLSHNYASSSFCLDELVHIIDCKRKGLLVLPVFYNLDPSDVRHQKGSYGEALARHEERFKAKKERLNQNMERLEKWKMALHQVANLSGYHFKQGDGYEYEFIGKIVEMVSGKTNRALLHIADYPVGLESQVLEVVKLLDVGANDGVHMIGIHGIGGIGKTTLALAVYNYVADHFDGSCFLENVRENSDKHGLQHLQSIILSELVKENKMNIATVKQGISMIQHRLQRKKVLLIVDDVDKPEQLQAIVGRPDWFGSGSRIIITTRDEKLLASHEVRRTYEVNELNRNDALQLLTWEAFKMQKVDPSYEEMLNRVVTYASGLPLALKVIGSNLFGKSIQEWKSAINQYQRIPNNQILKILKVSFDALEEEEKSVFLDIACCFKGCELEEVEDILHAHYGDCMKYHIGVLIDKSLLKLSVHGTMVTLHDLIEDMGREIVRQESPKDPGKRSRLWFHEDIIQVLEDNTGTSEIEIICLNFPLLDKEDIVEWNRKAFKKMKNLKTLIIKSGHFCKGPRYLPNSLRVLEWWRYPSHDLPSDFRSKKLGICKLPHCCFTSLELKFMSMRVLNLDKCKCLTQIPDVSGLPNLEKLSFQHCQNLTTIHSSIGFLYKLKILSAFGCTKLVSFPPIKLTSLEKLNLSRCHSLESFPEILGKMENIRELQCEYTSIKELPSSIHNLTRLQELQLANCGVVQLPSSIVMMPELTELIGWKWKGWQWLKQEEGEEKFGSSIVSSKVELLWASDCNLYDDFFSIGFTRFAHVKDLNLSKNNFTMLPECIKEFQFLRKLNVNDCKHLQEIRGIPPSLKHFLATNCKSLTSSSTSMFLNQELHETGKTQFYLPGERIPEWFDHQSRGPSISFWFRNKFPGKVLCLVIGPMDDDSGMLISKVIINGNKYFRGSGYFMMGMDHTYLFDLQIMEFEDNLYVPLENEWNHAEVTYEGLEETSTPKECGIHVFKQESSMKDIRFADPYGKRKLGNDRNSLESQNQQLLKKHRFVDMEVS

SEQ ID NO: 180632 - protein, 95 aa, Glycine max
  Coding DNA Sequence Number=SeqID_88947
MKTEAALVQDQTVSNIEEEHIVKASSSHLTPNHSSALPRPFHLPYGEVSRSFVVRWKNDLDDTWHLLYKDDNAKVGSYMEVTKTSINGWKLHGSY

SEQ ID NO: 180633 - protein, 26 aa, Glycine max
  Coding DNA Sequence Number=SeqID_88948
MVMEEQEENVGEEGEEAGNFWRKERE

SEQ ID NO: 180634 - protein, 112 aa, Glycine max
  Coding DNA Sequence Number=SeqID_88949
MAEKTNKILEEAAQSGSTEGIIDPPSPIRRHVKWKLARTKKTGQMTSEAAKEIAEKIDSLDEQASQGSFVPPWMSRCPNCCHWATRAPWPGPCRWSRCHHKAILRIGSTNVV

SEQ ID NO: 180635 - protein, 63 aa, Glycine max
  Coding DNA Sequence Number=SeqID_88950
MVPKTCSNPASAPDCASSIKRLILIKHHPQIPLVRLNSTRTALRQTYKQLGYHTPIPPDNTIN

SEQ ID NO: 180636 - protein, 211 aa, Glycine max
  Coding DNA Sequence Number=SeqID_88951
  Pfam annotation: Domain name=MAP7; Domain location=4-168; Score= -81.8; E_value=0.072; Accession=PF05672.2; Description=MAP7 (E-MAP -115) family
MSLHSSSSVNGEGSTPKDPLYKILDELRSLKLWKEKQERKEKGKKRVEEISQDEREKIREEERRKIMKEMKREKHVSYSSHNSCKSLSEELRDYYEGRHRSHLRPHSHRIENERKPQEVNIKLPYFHGKDNVEANLDWEIRVEKQLKRKSTSKSYGSHSYPKKDQGQGILGGHITSQCPTKKTMIMRGQDIYSSQDEATTSSSSSGSEEAK

SEQ ID NO: 180637 - protein, 153 aa, Glycine max
  Coding DNA Sequence Number=SeqID_88952
  Pfam annotation: Domain name=Transposase_23; Domain location=1-71; Score=7.7; E_value=0.00017; Accession=PF03017.5; Description =TNP1ENSPM transposase
MGDSDRCGLYIEADPAHLVAMGRVYEGSALVHNTPLLSGQVKVSVEEVTDADAQVPVPTDEVSLVGQALHTFFAWPTHLVKSLSQQVVVSPPKPPPKPHPEVDDPLYLMTLTIPELFLRPYQYFNDPRPLEPERLKALRIQWAQFYLRVRDQA

SEQ ID NO: 180638 - protein, 79 aa, Glycine max
  Coding DNA Sequence Number=SeqID_88953
MNPKERWSLVSSDNNQEVTPTSCNEPKKDVGLLCLVINQEANPASCNEPKERWSLVFNVFKSRSLEKLFVRMEERKKIE

SEQ ID NO: 180639 - protein, 133 aa, Glycine max
  Coding DNA Sequence Number=SeqID_88954
MDGKRSSYVIGSRGASLWTGAGALGCMGAELEESPTQAEKLGCSNPPSVGTCGGDIIELPSLQAHFDPFPGEYQVCEAGGHVPPTLSVLFKGLAFPFNHVLQLSPIGSHIRVVLILPKEGGNQILPSADAGSF

SEQ ID NO: 180640 - protein, 250 aa, Glycine max
  Coding DNA Sequence Number=SeqID_88955
  Gene Ontology: Mol. function=transcription factor activity; Cellular component=intracellular; Biological process=regulation of transcription, DNA-dependent
  Homolog annotation: Hit_ID=P0ACL3; Match level="QueryCoverage=99%, HitCoverage=96%, E-value=1e-103, Identity=72%"; Hit description=Exu regulon transcriptional regulator
  Pfam annotation: Domain name=FCD; Domain location=96-220; Score=87.6; E_value=4.1e-23; Accession=PF07729.3; Description=FCD domain
  Pfam annotation: Domain name=GntR; Domain location=9-72; Score=89.7; E_value=9.4e-24; Accession=PF00392.12; Description=Bacterial regulatory proteins, gntR fam
  Pfam module annotation: Pfam domain module=FCD::GntR; Domain location= 96-220::9-72
MDLNESRRLYQQLASELKQRIEAGSYAVGAKLPAERMIAEAHQVSRTVVREAIIMLEVEGYVEVRKGSGIHVISDQPQPRDSAADQLEFASYGPFELLQARQLIESNVAEFAATQIRPQDIVALLAIQEKARQEDHARDSTWDMEFHVRIAQATQNSALAAIVEKMWRHRLHNPYWLKLHEHIDARHITSWCDDHDQILKALMRKDPAASKLTMWQHLENTKQMLFDATADDFEFNVDRYMFAENPVILP

SEQ ID NO: 180641 - protein, 87 aa, Glycine max
  Coding DNA Sequence Number=SeqID_88956
  Homolog annotation: Hit_ID=A1AG32; Match level="QueryCoverage=98%, HitCoverage=65%, E-value=3e-35, Identity=68%"; Hit description =Putative uncharacterized protein
HSSRPAIAHWLKQPTRVQYGPYHVNPYLALLRVEFTVPRTVASRAACAPQALPGTLPYGARTFLPSARLPRKGRRQSGDCLVSFGAG

SEQ ID NO: 180642 - protein, 23 aa, Glycine max
  Coding DNA Sequence Number=SeqID_88957
NFAKVSTVLRRSSFVLHRSSIFN

SEQ ID NO: 180643 - protein, 92 aa, Glycine max
  Coding DNA Sequence Number=SeqID_88958
TGMEILILGQGLWWFEVLGQKACRTARHDVCQGVGILLPKHIVATYPSAGGRRVTRGMRVPRKEYARSRHQRLFEENVGKTGKDEIYELFSE

SEQ ID NO: 180644 - protein, 444 aa, Glycine max
  Coding DNA Sequence Number=SeqID_88959
  Gene Ontology: Mol. function=motor activity; Cellular component=cell projection
  Homolog annotation: Hit_ID=P15305; Match level="QueryCoverage=99%, HitCoverage=79%, E-value=6e-18, Identity=20%"; Hit description =Dynein heavy chain
STAQVLAFRGTHALTFRGLLALAFRGLHVLAIRGLHVLTFRGQHVLAIRGLHVLAFIGQQVLAFRKLHAPGFRGLHVLAFRGTTRPRLQRAERPHLQRATSLTIKGYMPLPSEGLHALTFRGLHALTFEGLHALTIRGLHVLTFRGLHAFNFRGLHVLAFKGLHVLPSEGLPHALTFRRLHVVTFRGLHAFNFRGLHVLAFRGLHVLPSEGLLHALTFRGRHVVTFRGLHALTFRGLHVLVIRGLHVLTFRGLHVLAFRGLNALTFRGLHALTFKGLHALTIRVLHVVAIIRLHVLAFRGLHALAIRRLHALAFRGLHVLPFRGLHVLTFRGLHVLTIRGLHVLAIRGLHALTFRGLHVLVIRGLDVLAFRGLHVLVIRGLHTLPLRGLHALAIRGMHALTFRGLHVLAIRRLHALTFRGLYVLAIRGLHSLTYRGLHVLTFRE

SEQ ID NO: 180645 - protein, 237 aa, Glycine max
  Coding DNA Sequence Number=SeqID_88960
  Homolog annotation: Hit_ID=A5BSR3; Match level="QueryCoverage=30%, HitCoverage=25%, E-value=9e-09, Identity=48%"; Hit description =Putative uncharacterized protein
KLLAEKTKKKLEEAAQPGSVDGVIDPPSSVRRHVKWKMARTKKTGEMTTEAVKEIAEKIGSFVPHGRQDVLTAAIGRPEHPGRVRVAGAGVTIKQYFRSAPRMSHSSSSLPPEELQQLTQQIRDQLEESITEKVTRQLMASFILVQSQMQSQGLALPPEPLVGPSGPQVSTKGSCVDPSGNDPETADSDRCGLYIEADPARLVTLGRVYEGSTVVHNTPLLLSQVKMGVEEVTDADF

SEQ ID NO: 180646 - protein, 142 aa, Glycine max
  Coding DNA Sequence Number=SeqID_88961
MRVFNRCGMQEVQLWSDTEGPPKGFVGVYHQLLALQWYIRAKARSRLDCDGEFHGSLPQFKRHVHDQFGVAGFQWAGWGRRVHLSNNAGSGNATALASIIFFTLIMASIIVAIFSLMASMSAFIFSCISSTSPITLALARVR

SEQ ID NO: 180647 - protein, 72 aa, Glycine max
  Coding DNA Sequence Number=SeqID_88962
MDDVATSQPSSQRPPLQSPPVEVDHTRKTPNGPEEVQQGPGVLALITGLRQFYGVTTTSISPCRSVNWFMPS

SEQ ID NO: 180648 - protein, 103 aa, Glycine max
  Coding DNA Sequence Number=SeqID_88963
MKNDEERWKSSRNRFTETIFLINFKGKEGGGCRPARPGELGCFHQKAPPSVGTPWKCHETLWIMQQCLLSTSRILQNFMDCATMLPFDFWHVAELHELPNDGC

SEQ ID NO: 180649 - protein, 154 aa, Glycine max
  Coding DNA Sequence Number=SeqID_88964
MLLSSNIIHIYVRVVMLVRMIRTRLLAAVRAKSCLARGLTPPLAVFALLALSQDQWVSQELTEGISIKRNPLAPHPGAYILGPLHGRPGISVELHDYLLIKFSHGCHKRCPAPAGYLSLKVRKLIVPQLDLSLSEERPSLDGLETLLVFCAPEP

SEQ ID NO: 180650 - protein, 50 aa, Glycine max
  Coding DNA Sequence Number=SeqID_88965
MCARSWLWSAENTGSMSYKVVAECANVMNEMVSDDEGEMMGAASVTNLEE

SEQ ID NO: 180651 - protein, 91 aa, Glycine max
  Coding DNA Sequence Number=SeqID_88966
MMSVTTYPLTEGEAKRKKERLPKKENVWESPLTFIRGKHYKKPKRKLLTFNPSKRQLYGANDRLRLNFTKERRLPMIEEGDEYAQNNKGDP

SEQ ID NO: 180652 - protein, 108 aa, Glycine max
  Coding DNA Sequence Number=SeqID_88967
MSILTLGSKKEKKENFQSKKKRRKISNQGESKKGREGKFPIKGKKEARKFPIKEREKAKRKERKFQVKEKRMGESKKKKKTPGQRNQKKCAERSLDRTISEQYRIVTT

SEQ ID NO: 180653 - protein, 17 aa, Glycine max
  Coding DNA Sequence Number=SeqID_88968
MASRSDQGSGLHRSTDK

SEQ ID NO: 180654 - protein, 147 aa, Glycine max
  Coding DNA Sequence Number=SeqID_88969
MNALLEPKFLHLRKTMNCLQPSLITSQESPSDSICVPKEEKVIAAGVSLSEAHSSLSVLGNPRRGSAREMHAPLAHPVSHLSLLAFSAPSSLSQNSLTRERAFRIYNIKEPLKHRSGRKIREESKNRARKEARTIEPQPPRKFRLEE

SEQ ID NO: 180655 - protein, 62 aa, Glycine max
  Coding DNA Sequence Number=SeqID_88970
MTKARQKGVRKEKEGDACHPARPGELSSSRRARLLPPEAITFWRNILEGPSGPGCYLNPHFY

SEQ ID NO: 180656 - protein, 101 aa, Glycine max
  Coding DNA Sequence Number=SeqID_88971
MSQKNDDLGLIHRWIVVKFEHHIRNPITSILTVGNFNVMSELREIPLALEKNKSHGDSTSGGFNPFSVSLTFGNSIEAVRGKNWRNLREPLEMLLLLAEDT

SEQ ID NO: 180657 - protein, 112 aa, Glycine max
  Coding DNA Sequence Number=SeqID_88972
MECLPKRKTCRCRHQRLFEENVRKTKKGSVNFENKGSRVVYAWGSLKSFGGPSEPKASLGEPGSRKLKKKTFLPPFLVSFAFLIKTLNDLSFCAITSVEQRQSTSKDQKINE

SEQ ID NO: 180658 - protein, 265 aa, Glycine max
  Coding DNA Sequence Number=SeqID_88973
  Gene Ontology: Mol. function=thioredoxin-disulfide reductase activity; Cellular component=cytoplasm; Biological process=removal of superoxide radicals
  Homolog annotation: Hit_ID=A6XJ27; Match level="QueryCoverage=73%, HitCoverage=37%, E-value=1e-93, Identity=88%"; Hit description=NADP -thioredoxin reductase C
  Pfam annotation: Domain name=DAO; Domain location=75-251; Score= -57.9; E_value=0.067; Accession=PF01266.15; Description=FAD dependent oxidoreductase
  Pfam annotation: Domain name=Pyr_redox_2; Domain location=75-260; Score=71.3; E_value=3.3e-18; Accession=PF07992.5; Description =Pyridine nucleotide-disulphide oxidore
  Pfam module annotation: Pfam domain module=DAO::Pyr_redox_2; Domain location=75-251::75-260
  Subcellular localization annotation: CTP_CleavageSite=56; ConfidenceScore=5.83e-01
MATAKIGLGVGPVPTTTHRVTAVAASSSAAFSPPPHRLFFLNSSRPPLRPRPLPLRVAAASSSPSVAAPGKGVENVVIIGSGPAGYTAAIYAARANLKPVVFEGYQAGGVPGGQLMTTTEVENFPGFPDGISGPDLMDRMRRQAERWGAELYQEDVEVIDVKSSPFTVQSSERKVKSHTVIYATGATAKRLRLPREDEFWSRGISACAICDGASPLFKGQVLAVIGGGDTATEEALYLTKYARHVHLLVRRDQLRASKAMQDRCV

SEQ ID NO: 180659 - protein, 135 aa, Glycine max
  Coding DNA Sequence Number=SeqID_88974
MAVFHGGFSKKRHRIAVAWRVWDGGRGGVAEMAEIRLAFVRACVQNSLPASLQQLAFRTSPACVPLAPRRTQPPPRHHPLLAVRTRMHRDEARNARTATTSSDDEPQQRTHRDTTPCFCLAKEEDEEEEEDAWVS

SEQ ID NO: 180660 - protein, 171 aa, Glycine max
  Coding DNA Sequence Number=SeqID_88975
MVERKLFHLTSMSLSWIHDKNMLRELWAEAIQCACHIEKLMDGYFVSLSKYAKNLLNQYQMNEAKEVCKEDRRIWAEVWKTQSIGKIPKSHIGWLNPWSVAYIPVGQLHLMSIGFEMKSNMVSKRALTWDLAFASAATSTHHLWFTHQDRRSTSSHCFLFGSVAITWCSGK

SEQ ID NO: 180661 - protein, 173 aa, Glycine max
  Coding DNA Sequence Number=SeqID_88976
MAKLMDNSGRRLSCIEALNEGQFAKRTIFTFKLSEELSFLGVFGCGATKKELSLKRKPSCRTLDEILRDCEKLPRYGELNPQLVLPMGNVGPLYPVITTKKLYPLLAMNPKDVGLLCPVIDQEANLASCNEPKEYWSLVFNVCNQEDLLLKIVTKSRSLEKLFVRLEERKKIE

SEQ ID NO: 180662 - protein, 167 aa, Glycine max
  Coding DNA Sequence Number=SeqID_88977
MSELVVDVSDRATYEGVRLVEKSTIRDVTNDIIANLSSSTVQLKDELGESQWHVNPGESHQNERDLEVVQKESLIIRAIKQCQSWLLMSRKGLPIENFNRWMILTNEELSEMSWCESDMNANGMEKEERERRRHVKEKMSLEEAHHHRRPWIRAWRKKEMNEGRGRE

SEQ ID NO: 180663 - protein, 191 aa, Glycine max
  Coding DNA Sequence Number=SeqID_88978
  Gene Ontology: Mol. function=protein serine/threonine kinase activity; Cellular component=nucleus; Biological process=protein amino acid phosphorylation
  Homolog annotation: Hit_ID=A7PYX0; Match level="QueryCoverage=30%, HitCoverage=21%, E-value=3e-19, Identity=77%"; Hit description =Chromosome chr12 scaffold_38, whole genome shotgun sequence
  Pfam annotation: Domain name=K-box; Domain location=1-74; Score=-4.0; E_value=0.00099; Accession=PF01486.8; Description=K-box region
MQENLKKLKEVNRNLRKEIRQRMGDCMNDLGLEDLKLLEEEMDKAAKVVRECKATKFNDVKSSKGSPYWMALEVSNLKNQGGYGLAVDIWSLGCTVLEMLTRQPPYSELEGVLPPIAQKHVIQLILSHERNFRADELMEFYKSYSQQAVSKGHKAVAILLCQLPMLTLKVEAKFQLEVINMRRKKSVKECK

SEQ ID NO: 180664 - protein, 80 aa, Glycine max
  Coding DNA Sequence Number=SeqID_88979
MVVVPPSTKWHRGGKPCKTKTDSQGCKPKDSYMAQHHPEEQCIAATSLTPNDKADMSDVSPAFDEVREKGLLCERPHTPM

SEQ ID NO: 180665 - protein, 162 aa, Glycine max
  Coding DNA Sequence Number=SeqID_88980
MYRILDELRFLKLWKEKQEIKEKGKKIVEEISQDERENIREEERRNEKKKKHVSYSSRDSCKSLSEELSNYYGGRHRSHTKHHSQRREKDRRPQEVNISLLYFHGKDSVEAYLDWEMKVEQLFACHHISEERKFHWLPLDFKGMPSIGGLPSLGKEGFMGIL

SEQ ID NO: 180666 - protein, 290 aa, Glycine max
  Coding DNA Sequence Number=SeqID_88981
  Gene Ontology: Mol. function=unspecific monooxygenase activity
  Homolog annotation: Hit_ID=Q9AVH2; Match level="QueryCoverage=85%, HitCoverage=100%, E-value=8e-75, Identity=56%"; Hit description =Putative senescence-associated protein
ILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGISKYVKSSGISLSLFPAPTYPTPLKSFHKVGLESSSTGSSFPADSAKPVPLAVVSLDSRQGQWESR

SEQ ID NO: 180667 - protein, 46 aa, Glycine max
  Coding DNA Sequence Number=SeqID_88982
  Subcellular localization annotation: CTP_CleavageSite=49; ConfidenceScore=5.05e-01
MTLPSPITLHHQTTLPFSTTSTLTPRKSFSQRDCRHDFRFINWLKQ

SEQ ID NO: 180668 - protein, 106 aa, Glycine max
  Coding DNA Sequence Number=SeqID_88983
MSKNWVFKKHNKTFCDCNTGVRTDDIGFTLVDLKKLGYHNDPFIMAEQARQGKTIGVNVEDDDSYMDTYVSPLTAQITANVVGEKKLTTFMLIEMIMMKEKLINIG

SEQ ID NO: 180669 - protein, 119 aa, Glycine max
  Coding DNA Sequence Number=SeqID_88984
MVTRTFHQPGANEPIDVQRLTSSSATFAIQGQRVRWQAVIPYGHPHLSSTEGNEFDVIRMMFYSRRPKTFKPDDARDSSLLGEGDRVRWRREVWWLSNFAAFKTLKFVDASDAFAFLSE

SEQ ID NO: 180670 - protein, 106 aa, Glycine max
  Coding DNA Sequence Number=SeqID_88985
DAGSRQARQGASAGVGGCRGWLNYAASEQIVLRVHHMRAIGAGLFAITPAGERGMCCKAIKLGNARVFPVTTLSTLEDPQSESGLMKPLIKPRAGKTNVNERRVVI

SEQ ID NO: 180671 - protein, 31 aa, Glycine max
  Coding DNA Sequence Number=SeqID_88986
MMHAPDLNFQMQCVFVEATQSCPVTPPPPRR

SEQ ID NO: 180672 - protein, 96 aa, Glycine max
  Coding DNA Sequence Number=SeqID_88987
  Homolog annotation: Hit_ID=Q8TGM5; Match level="QueryCoverage=40%, HitCoverage=58%, E-value=7e-08, Identity=74%"; Hit description =Uncharacterized protein ART3
MGPELTGSHVIGLERGSSTILSRQSRRALGLMASGATCVQRLDGSRDSAIHTKYRISLRSSSMQEPRYPLPRVIVCKCCVVTTPAGHRLRAPGSRT

SEQ ID NO: 180673 - protein, 50 aa, Glycine max
  Coding DNA Sequence Number=SeqID_88988
THLLLEVASPLSLAFFIPLSFIFQEAKESIDEEDPRPTSSNGPPNNFMLK

SEQ ID NO: 180674 - protein, 103 aa, Glycine max
  Coding DNA Sequence Number=SeqID_88989
MEDAPVSPRLAHPQKGRLRHTRMEILILGQGLWWFEVLGQKACRTARHDVCQGVGLASGSGIKGMSHIYFHDTHTTMMIWKFYAKRVMHAPMWTLKHQVFMVM

SEQ ID NO: 180675 - protein, 70 aa, Glycine max
  Coding DNA Sequence Number=SeqID_88990
MAEWLIAPVLKTGSHVSIKRSHGKNWFKISINSFFNPAAAARALPACHKWPTIGRILEQMRSSYQLLGET

SEQ ID NO: 180676 - protein, 83 aa, Glycine max
  Coding DNA Sequence Number=SeqID_88991
MSFSRDFLSANRLPKYVIDYQCPKTNYTAFAHWNLKVNRLPVAGACLFRYVTGSHWLTMPGLGQDWPSLVLGNSTPPDVPKVS

SEQ ID NO: 180677 - protein, 32 aa, Glycine max
  Coding DNA Sequence Number=SeqID_88992
MEKNEETTMEEKLACGASMEAGSLSFNEVLQW

SEQ ID NO: 180678 - protein, 78 aa, Glycine max
  Coding DNA Sequence Number=SeqID_88993
MESLLLEDEWKRMEKAEDWRCHFKEKMSQEEAHHHEKPWIRARRKEKMTQREKRSTKFSSSNEVHENVKLKDITKVCI

SEQ ID NO: 180679 - protein, 82 aa, Glycine max
  Coding DNA Sequence Number=SeqID_88994
MGVEGRSPEYEEPRDLRSNPFQGGGNDVILSRKGIESILQCEFKQTFLGRCRNLPFGGRATRDSRDACSTKGIRAESPPTFI

SEQ ID NO: 180680 - protein, 155 aa, Glycine max
  Coding DNA Sequence Number=SeqID_88995
  Homolog annotation: Hit_ID=UPI0000ECD483; Match level="QueryCoverage =56%, HitCoverage=88%, E-value=2e-08, Identity=47%"; Hit description =UPI0000ECD483 related cluster
  Subcellular localization annotation: CTP_CleavageSite=73; ConfidenceScore=5.43e-01
MSGPALRPYSPRNPKTLISHKVPAESLKATSVALNTGGTTRPVKDRSASPAEGTSRPVHTGGGPIDPTQAGITAAAGTRLALQWILVKGFRLYSFQLPDSMSPVLLFMSLPPRVRLSGHSPSKKLAFRGGLPPHSYLAAEVSFVNGINQTNRSTN

SEQ ID NO: 180681 - protein, 150 aa, Glycine max
  Coding DNA Sequence Number=SeqID_88996
MRCNRLPEMKILEIPLLIAWNLGDPRRQCEVLIPGHDSIHGYFIGASEEPARTLQRPVEWILPTPTPYRLVEPVQVIEVTSSEEDPEELPPEPAVDALDFLEGDEDPLPEVDSPEDVEILIPGDRCRTGCHDITLQNMQIVCVRMNRLNK

SEQ ID NO: 180682 - protein, 85 aa, Glycine max
  Coding DNA Sequence Number=SeqID_88997
  Gene Ontology: Mol. function=aspartic-type endopeptidase activity; Biological process=DNA integration
  Homolog annotation: Hit_ID=A5CA99; Match level="QueryCoverage=95%, HitCoverage=12%, E-value=3e-21, Identity=42%"; Hit description =Putative uncharacterized protein
  Pfam annotation: Domain name=RVT_2; Domain location=12-76; Score= -176.9; E_value=0.0048; Accession=PF07727.5; Description=Reverse transcriptase (RNA-dependent DNA pol
MHRYNSQTWIDVMKDEMKSMQDNDIWNLIELPKGIKILRDRSQGILRLSQESYIDNLLDRFGMKDSKSGDNPIAEGDKFSLKQCP

SEQ ID NO: 180683 - protein, 307 aa, Glycine max
  Coding DNA Sequence Number=SeqID_88998
  Homolog annotation: Hit_ID=A5B5V0; Match level="QueryCoverage=76%, HitCoverage=52%, E-value=7e-10, Identity=24%"; Hit description =Putative uncharacterized protein
MEFFSNENFECFQAFENSNLIPFMSLKLPVYSELVKAFYSNLEIHEGTLNSEVYGIKMVIDQSLFYDLTKLPSEGVSFEGALIDEWKFDFSVHDARRLVCTNQADMTERLLAGSLAFESHILHYLIFRILLPRSSNLAQVSEEDLIVMWAFHKGLQIDWAHLVRYRMHKALRLNAPLPYPHLFTLFLQHFNIPLDFEPYVPIKRSFLIGASVIASFGYIKEHDGSWVKKGARNIGEEGHEREDSSLLSKILERFDGLQTFVGERFDTLELQVDMRFNEMESRMTKVEEDVSYIRSSFDLPPPPPPSS

SEQ ID NO: 180684 - protein, 64 aa, Glycine max
  Coding DNA Sequence Number=SeqID_88999
  Subcellular localization annotation: CTP_CleavageSite=43; ConfidenceScore=5.21e-01
ALPVAPTRWALPVAPSSRALPDAPASGALPYCCLVRRAVPRVACSMEAPSWGALCNKKIDPPDK

SEQ ID NO: 180685 - protein, 48 aa, Glycine max
  Coding DNA Sequence Number=SeqID_89000
MNEVRRQGQGWIKGWIVKKEEEGREGGDGGDVVGGAGEKKKMEDIVSE

SEQ ID NO: 180686 - protein, 96 aa, Glycine max
  Coding DNA Sequence Number=SeqID_89001
ASALTSFDYRKDRDRQWLKKDALPPQDEHTPSPPTQRDDSSTLMNEVLSELWGLHTYVGERFDSLDGRFDGLDTRITQLEEDVGYLHRCFDLPPPS

SEQ ID NO: 180687 - protein, 86 aa, Glycine max
  Coding DNA Sequence Number=SeqID_89002
  Homolog annotation: Hit_ID=A7NZK0; Match level="QueryCoverage=91%, HitCoverage=67%, E-value=2e-08, Identity=48%"; Hit description =Chromosome chr6 scaffold_3, whole genome shotgun sequence
MRVQPHCNARTHVVYLKKVDLLASLSYNPLAAELPFSSVPQETKYIPSTQHRSSKDLEDPPTHESRDLSENGFLFEGCITAWISSH

SEQ ID NO: 180688 - protein, 119 aa, Glycine max
  Coding DNA Sequence Number=SeqID_89003
  Gene Ontology: Mol. function=oxidoreductase activity; Cellular component=cytoplasm; Biological process=metabolic process
  Homolog annotation: Hit_ID=Q6CQP2; Match level="QueryCoverage=94%, HitCoverage=44%, E-value=8e-34, Identity=57%"; Hit description =Similar to sp|Q8TTF8 Methanosarcina acetivorans Cyclohexanol dehydrogenase
MMKLGGSIVNLSAVNGLVGIPGLAPYTVAKHGIIGLTQTAALEFATQGIRINAVAPGYVQTPRMSEFPDNIVRSFANSHPMKRMAKMREIADFILFLLSENAAFCTGGVYPIDGGYLAE

SEQ ID NO: 180689 - protein, 147 aa, Glycine max
  Coding DNA Sequence Number=SeqID_89004
LLFSITSVSIYYGTQSDIRVKSYCRLNLLRASVFNYERLDILRDSIGHPSKKLLSFEFALELPVFNYERLDILPTQSDIRVKSYCRLNLLRASVFNFERLDILGDSIGHPSQKLLSFEFAQSFCFQLRASRYIMGLNQTSESKVIVV

SEQ ID NO: 180690 - protein, 95 aa, Glycine max
  Coding DNA Sequence Number=SeqID_89005
  Homolog annotation: Hit_ID=A4PUT7; Match level="QueryCoverage=46%, HitCoverage=6%, E-value=1e-07, Identity=59%"; Hit description =Polynucleotidyl transferase, Ribonuclease H fold
MVELDDVQVKENLTYETLPLRIEDRRTKHLRAKEIPLVKLPKTGLHSLTIGIWKIITFDVSLSEKGVLSAIPTKEGIALSEQGRAKRGIVQWKLR

SEQ ID NO: 180691 - protein, 100 aa, Glycine max
  Coding DNA Sequence Number=SeqID_89006
  Gene Ontology: Mol. function=structural constituent of ribosome; Cellular component=intracellular; Biological process=translation
  Homolog annotation: Hit_ID=Q32703; Match level="QueryCoverage=38%, HitCoverage=90%, E-value=3e-11, Identity=84%"; Hit description =Putative uncharacterized protein
MVRYSGVLGVEEPHQSIPNLVVKLYCGDDTVGEDTPGNRYPVEEDGVGPVAQRIRARGYEPRCRGFESLLAHNRPKKGRIFPSGGRKIMIGLADPKLWNL

SEQ ID NO: 180692 - protein, 59 aa, Glycine max
  Coding DNA Sequence Number=SeqID_89007
  Gene Ontology: Mol. function=transferase activity, transferring glycosyl groups; Biological process=metabolic process
  Homolog annotation: Hit_ID=A7NUW7; Match level="QueryCoverage=100%, HitCoverage=12%, E-value=8e-15, Identity=57%"; Hit description =Chromosome chr18 scaffold_1, whole genome shotgun sequence
MTFTIEAAHELGVPNVLFWPASACCFLSIINFPALVEKGLTPLKDESYLKNGHLDSKVD

SEQ ID NO: 180693 - protein, 72 aa, Glycine max
  Coding DNA Sequence Number=SeqID_89008
METSEANFKVNQHAIQNLEIQVGKLAKEMAELSFLVTREEKFVEVKAHDKSLVEEYDSKEKEEKYEERTQQQ

SEQ ID NO: 180694 - protein, 304 aa, Glycine max
  Coding DNA Sequence Number=SeqID_89009
AASGGALGDMTPAEARNLIEKMASNSQQFSARNDAIVIRGVHEVATNPSASSETKKLEGKLDALVNLVTQLALNQKFVPVARVCGLCSSADHHTNLCPSMQQPGAIEQPEAYAANIYNRPPQPQQQNQPQQSNYDLSSNRDNPGWRNHPNLRWSSPQQQQQQPAPSFQNAAGPSRPYIPPPIQQQQQPQKQPTVEAPPQPSLEELSLHSELNQSDGQLATQLNQQQSQNSDKLPSQAVQNPKNVSAISLRSGKQCQGPQPIAPSSSANEPAKLHSTPEKGDDKNLPNNFCAGESSSTGNSDLQK

SEQ ID NO: 180695 - protein, 78 aa, Glycine max
  Coding DNA Sequence Number=SeqID_89010
  Subcellular localization annotation: CTP_CleavageSite=51; ConfidenceScore=5.42e-01
MRVYLVVTRTFGQPGANEPVGARRLTSSSAPFSVLTREGNHMVTRTFGQPGANEPVGARRLASSSILSQPTLRREGDA

SEQ ID NO: 180696 - protein, 209 aa, Glycine max
  Coding DNA Sequence Number=SeqID_89011
MTLLLSNILPSDRIANLPLQKYQLVCVVPTWGSHPQRHPVDSKKSNRALGFPALVTGLYQSYRVPVPPRQGHVIIGIAPARHPVDPKKSNRVLELSSSNYGSLSVLRSTCHLQQGHQAPYQSSFHQEVLRLQAGAGRNTTAAWRWPAAGNRRTATSRVHLSSSAKRLERCLRHMADQQATKSKAKGKQSTRSVTYKPSCVQLKTLKKRY

SEQ ID NO: 180697 - protein, 173 aa, Glycine max
  Coding DNA Sequence Number=SeqID_89012
  Homolog annotation: Hit_ID=A5BTM1; Match level="QueryCoverage=65%, HitCoverage=4%, E-value=7e-12, Identity=35%"; Hit description =Putative uncharacterized protein
NPSDLQPFDPEIDRTFHRLVRHHFIPFDHSEHSITGESVHSVIGDFEHPDLEHYNFEHSDSEHSDLAHSENMAQPPPRERTLREMAAPDFTYESLCIQYPDEDVPYVLKTGLIHLLPKFHGLAGEDPHKHLKEFHIVCSTMKPPDVQEDHIFLKAFPHSLEGVAKDWLYYLAP

SEQ ID NO: 180698 - protein, 67 aa, Glycine max
  Coding DNA Sequence Number=SeqID_89013
MKMQRNSTHAAESTQVLKVRKVQRFGCKARQAACDILEISTRNFKMGPDGCRETRGIGTREAAHGIL

SEQ ID NO: 180699 - protein, 152 aa, Glycine max
  Coding DNA Sequence Number=SeqID_89014
MGEVEEVQEQMKADMEAMKEKMATMVEAMMSMKRIMEANTIVVAITSAVAKYGRPHDVKIQNKHAFPPYGSPPKEDVNNSAPILIESQQPQSDHAHVSLSVGETHEIPHHNLADFEPCLEYATEGQAVGGKIPPIIEGKGKVGSSGGKAQGH

SEQ ID NO: 180700 - protein, 81 aa, Glycine max
  Coding DNA Sequence Number=SeqID_89015
MGHLSDQGVPTNPKRTKVIPEWPTPPSVEGRSLEFQEPLDLRSNPFQGGGNDAILPPRTLDRRLQEDWALYLGLHNVGRVS

SEQ ID NO: 180701 - protein, 182 aa, Glycine max
  Coding DNA Sequence Number=SeqID_89016
MWEMLFNGNGPRGKLASKRSRKDKAAEGTSSAPEYDSHRFRSAEHQQRFEAIKGWSFLRERGVQLRDDEYTDFQEEIVRRRWAPLVTPMAKFDPDIVLEFYANAWPTEEGVRDMRSWVRGQWIPFDADAISQFLGYPLVLEEGQECEYGQRRNRSDGFDEEAIAHLLCIPGKDFARTAAGRR

SEQ ID NO: 180702 - protein, 73 aa, Glycine max
  Coding DNA Sequence Number=SeqID_89017
SFVSQVLQGKVAEEPQLSTVSGAVADVAAGLVEERMLCLGQQHFENKVVVAAVVKDSTIYGWDDSSTRDCTCW

SEQ ID NO: 180703 - protein, 226 aa, Glycine max
  Coding DNA Sequence Number=SeqID_89018
  Gene Ontology: Mol. function=ATP binding; Biological process=viral capsid assembly
  Homolog annotation: Hit_ID=Q66BK9; Match level="QueryCoverage=84%, HitCoverage=32%, E-value=7e-85, Identity=82%"; Hit description =Terminase subunit [Enterobacteria phage 186] gb|AAC3414
  Pfam annotation: Domain name=Terminase_5; Domain location=43-100; Score=115.3; E_value=1.9e-31; Accession=PF06056.3; Description =Putative ATPase subunit of terminase (gpP-like)
MAPRLNALRLEDLRHNKGLMRAARRFRSLGVMNTTPATTIISDPRRQAALLYWQGFSVRQIAETLNLKGPTVQSWKLRDKWDDIAPISRVEQSMEARLIQLIMKDVKEGKDFKEIDLLGRQIERLARVNRYSATGNEADLNPNVANRNKGERKPAERNVFSEAAVEKLQSIFTETTFEYQMGWYRAGLQHRIRNILKSRQIGATFFFAREALLDALTTGRNQISVG

SEQ ID NO: 180704 - protein, 286 aa, Glycine max
  Coding DNA Sequence Number=SeqID_89019
  Homolog annotation: Hit_ID=Q84VI1; Match level="QueryCoverage=98%, HitCoverage=41%, E-value=1e-111, Identity=75%"; Hit description =Envelope-like protein
MATSPKETSASGSPAVPSSPHQEQPEFNIQPIQIIPGQASVPEKLVPRRQQGVKIAENPSLATSPREVDTEMDKKIRGIVSSILKDASVPDAEKDVPTSSTPDVSVPDVNKDVPTSSAPNAEALPSPSEEESTEEEDQASEETPAPRAPEPAPGNLIDLEEVESDEEPIANRLAPGIAERLQSRKGKTPIKRSGRIKTMAQKKSAPITPATSRRSKVAIPSKKRKEISSSDTDDDVELDVSTSKRAKKSGRKVPGNVPDAPLDNISFHSIGNVEKWKYVYQRRTCG

SEQ ID NO: 180705 - protein, 35 aa, Glycine max
  Coding DNA Sequence Number=SeqID_89020
MEVEEPWLGLWLPLNYQVDMGASFFAGKFPPWLVF

SEQ ID NO: 180706 - protein, 213 aa, Glycine max
  Coding DNA Sequence Number=SeqID_89021
MEASLCIPGQGFILNTEGQPWKLLRKDLTTLAQRWSAFSYSNLAPTSRTSDLNTGRARLVYGLITRMDMSIGNLISRQMTMMAQSNSSRLGFSTLIIALCRSKGVGSDALTSYENLRPARKTKLRAIDVPSSFAPIAGIPASSTSAPPPTLADPSAQSSQTSDAKLQSLFEGQILIMQSLQELAQQRPIMSVEQFIEKVAWPGARPSFLGDNE

SEQ ID NO: 180707 - protein, 289 aa, Glycine max
  Coding DNA Sequence Number=SeqID_89022
  Gene Ontology: Mol. function=transporter activity; Cellular component= integral to membrane; Biological process=thiamin biosynthetic process
  Homolog annotation: Hit_ID=A8I6X8; Match level="QueryCoverage=99%, HitCoverage=92%, E-value=1e-79, Identity=50%"; Hit description=ABC transporter substrate binding protein
  Pfam annotation: Domain name=NMT1; Domain location=14-226; Score =225.5; E_value=1.2e-64; Accession=PF09084.2; Description=NMT1THI5 like
  Pfam annotation: Domain name=OpuAC; Domain location=18-233; Score= -67.4; E_value=0.067; Accession=PF04069.3; Description=Substrate binding domain of ABC-type glycine betaine transport system
  Pfam annotation: Domain name=SBP_bac_3; Domain location=19-239; Score= -86.4; E_value=0.029; Accession=PF00497.11; Description=Bacterial extracellular solute-binding proteins, family 3
  Pfam module annotation: Pfam domain module=NMT1::OpuAC::SBP_bac_3; Domain location=14-226::18-233::19-239
AAEKVRLLLDWFINPNHAAIFAAEYSGAFKQQGLDVEMIAPADSASVPLLLAAGKADLAISYQPQLYTLVDKQVPVIRVGTLINQPLNTLTAVSGDIHSIKDFAGKSIGYAIPGAEDVAIRNMLKSQGVDVNSVKLVNLNMDAVSALLTHKIDGALTIFRNYELLDLQDKGAKPVSFKPEDYGVPAYDELIILANSNTAANDPRIPTFLRGLDAGIAWLRAHPQQAWQAFIKRYPELDTPLNHQAWQATLPYFATHSAEFNQARYQAFGEYMKANGLITNVAPMARYSL

SEQ ID NO: 180708 - protein, 51 aa, Glycine max
  Coding DNA Sequence Number=SeqID_89023
MTACGGHQWSWVVEKGVTHLAFAVVEKSSWSATRSEEERRKQGQPISGDVE

SEQ ID NO: 180709 - protein, 65 aa, Glycine max
  Coding DNA Sequence Number=SeqID_89024
MTRGVNAQAVIKEIATWRREGDTFGSDPLGMTLGEIEDLMEQDWTGKMESDPTSHHKHLAIFQWG

SEQ ID NO: 180710 - protein, 178 aa, Glycine max
  Coding DNA Sequence Number=SeqID_89025
MSVLELYVEKDVAGGSMFHAANSVTSCERNVSHHESELPRNISNLHVDEHDDDDDDYLASNSYVEESFDEDDSDDGISDTDNEVTDIVEPFSIVHPSEEIQNPFWNDAMHYNNINWSHPDEEDICGLDMPTTFNVGQELYVGMDFDSKDAVKNALKQYVMKMHQSFKVVETKYQCSCL

SEQ ID NO: 180711 - protein, 702 aa, Glycine max
  Coding DNA Sequence Number=SeqID_89026
  Gene Ontology: Mol. function=nucleoside-triphosphatase activity; Cellular component=intracellular; Biological process=protein transport
  Homolog annotation: Hit_ID=O48566; Match level="QueryCoverage=72%, HitCoverage=98%, E-value=0.0, Identity=65%"; Hit description=CLP protease regulatory subunit CLPX precursor
  Pfam annotation: Domain name=AAA; Domain location=353-566; Score =22.5; E_value=1.8e-07; Accession=PF00004.20; Description=ATPase family associated with various cellular activities (AAA)
  Pfam annotation: Domain name=AAA_2; Domain location=349-555; Score =233.2; E_value=6e-67; Accession=PF07724.5; Description=ATPase family associated with various c
  Pfam module annotation: Pfam domain module=AAA::AAA_2; Domain location=353-566::349-555
MDNPNPTNDEEVNKQILQHEKSAAGILCQLRIHHGAQASHLTLTKDVVGIVATLGKVEDDILSRLFSEYLGVETMLAIVCRTYEEVKALEMPYAGNYMLEDAQRKLDILIPRLPNGELPSGFLGYAVTMINLDSSNLFCVTPSGYGLRETLFYNLFSCLQVYKTRAKMIQALPCISEGALSLDGGMPCCSYKETASLALAHFRHLVFNYARAGSSRCPPRAGFGVRRGYIVVASLGDPPEVWSGGGIVVRPGNSNFEVAGGGGAPNSGDSKEGCWGGSNLGNSFPTPKEICKGLDKFVIGQERAKKVLSVAVYNHYKRIFNETSLPKWPAGDSDNSVKVDAADDDRVELEKSNILLMGPTGSGKTLLAKTLARFVNVPFVIADATSLTQASYVGEDVESILYKLLMVADYNVAAAQQGIVYIDEVDKITKKAESLNISRDVSGEGVQQALLKMLEGTVVNVPEKGARKHPRGDNIQIDTKNILFICGGAFVDLEKTISERRHDSSIGFGAPIRANMRTGKVTEAAVASSLLETVESSDLIAYGLIPEFVGRFPILVSLSALTENQLIQVLSEPKNALGKQYKKMFQMNGVKLHFTENALRSIARKAISKNTGARGLRSILENVLVDAMYEIPDIRTDDDVIDAVVVDEEAVGGEGRGRGAKILYGKGALDQYLSEQKNDSETMEASAADNEADTELPSIVAS

SEQ ID NO: 180712 - protein, 427 aa, Glycine max
  Coding DNA Sequence Number=SeqID_89027
  Gene Ontology: Mol. function=calmodulin binding; Cellular component =nucleus; Biological process=glucosinolate biosynthetic process
  Homolog annotation: Hit_ID=A7QF29; Match level="QueryCoverage=97%, HitCoverage=92%, E-value=7e-61, Identity=39%"; Hit description =Chromosome chr16 scaffold_86, whole genome shotgun sequence
  Pfam annotation: Domain name=IQ; Domain location=118-138; Score=16.1; E_value=0.13; Accession=PF00612.18; Description=IQ calmodulin-binding motif
  Pfam annotation: Domain name=IQ; Domain location=96-116; Score=35.7; E_value=1.6e-07; Accession=PF00612.18; Description=IQ calmodulin -binding motif
  Pfam module annotation: Pfam domain module=IQ::IQ; Domain location =118-138::96-116
MLVFHYFHFQKENKEEQWQQHVAPEEVSVEHFPAESSPDVINEGSATSSTPVTEDRNHAVAFAAATAAAAEAAVAAAQAAARVVRLAGYGRQPKEERAAILIQSYYRGYLARRALRALKGLVRLQALVRGHNVRKQAQMTMRCMHALVRVQARVRARRLELTEEKLQRRVEEQHECPKQFLSPIKMLDMDASQHIKENHYFRKHEAVMKRERALAYAFNCQRQLKQYMHIDPNGDDIGCYNTERERPQLDWNWLERWMSSQQSPNLRPRETLYRTLANATTDDMSEEKTVEMDMAANMGFMNQESYDTSPISNRYHQRQHSAGIPSYMAPTLSAKAKVRSQGPQGPFKQRGSPGPHWNSSTRRSSAIGLGCDSSSSGGPTSAHVSPRSPNPKINEIRLQSRRISGGSPDNVHIEDWALPLGATNGWP

SEQ ID NO: 180713 - protein, 43 aa, Glycine max
  Coding DNA Sequence Number=SeqID_89028
MKVEVERQLKWKMIYGCCWAKDVGGKGMNVRGRTHNVELRINF

SEQ ID NO: 180714 - protein, 159 aa, Glycine max
  Coding DNA Sequence Number=SeqID_89029
MLNRKKKPQVRFEVNAQKDITSPQKKRALSSVAKVVDNEPFKLPRDCFIDEVATVSKELVDFGTSKELQHMLSPCELKSITCFSVCNQKQKYNQKLDIIPIRTVCVQFCISRSSVGFVEFGGTGRHSDAYSGFSAPNDYQRWELVQMVFLPSIACASCI

SEQ ID NO: 180715 - protein, 334 aa, Glycine max
  Coding DNA Sequence Number=SeqID_89030
  Gene Ontology: Mol. function=transferase activity, transferring glycosyl groups; Cellular component=cytoplasm; Biological process =metabolic process
  Homolog annotation: Hit_ID=A4F1R6; Match level="QueryCoverage=56%, HitCoverage=39%, E-value=4e-59, Identity=64%"; Hit description =Putative glycosyltransferase
MVLLMSSMHISTELLHLSMSSSSSTRSLDHLTHMKHKRHRTENGNDSGKVVGNSFQSVDINKELSLWHVKFDQFKRQQSGSGNADGENFSQQEEEENVDGGEMHKKKKKKKQEVESLHNIDSTVKFGVREADGKHVSFRIPRIEKCSSMLDNLVGSLDLPKSKIFWWLNFRLKDLPSFIRTIDPNDFMLEYLIEVAARVRSASAIVFDTFDELERNAMNGLSSMLPFLCTIGLFPLLLNQSPQNNFASLGSNLWKEDPKCLEWLESKESESVVYVNFGSITVMSAEQLLEFAWGLANSKKPFLWIIRPDLLIGGSVILSSEFVNETKDRSLIAS

SEQ ID NO: 180716 - protein, 196 aa, Glycine max
  Coding DNA Sequence Number=SeqID_89031
MGSSQKPSFKKRFYQVKIKSLEVTSLRELGQLMGQLQRQAFRKAYGIRPPKASRKWGGRNTEKIFGGSPLSKCGWVGGPGSDRRFLAYHNHKESPVVAMLADLYDTFDRRCEESNARIVCCTPALYVGLVSHLFFQEGRPVYPLQGYHSPVLAIRQLGYPMRGAPLGESITPFIARGFSDHNARVLQGVRKAWDAA

SEQ ID NO: 180717 - protein, 74 aa, Glycine max
  Coding DNA Sequence Number=SeqID_89032
MTTLVSACQRLTVGTYPSAGGRRETRGMRVPRKEYARSRHQRLFEENVGKTGKDAIYELLSERFRSCIYARGRY

SEQ ID NO: 180718 - protein, 150 aa, Glycine max
  Coding DNA Sequence Number=SeqID_89033
MNYKLALNTQEPNSNIVFNTIMFDSFKINIVERYAGSMNARPKLCEVLFKVRTLDDDIIQKRDGNMRVKIKGDTFDDYQKLSQKLNSYEYKNKLINRKDAEQDYVHFILSLVFLCLHLSDLLGSGNTELSDNYSFTHSSREKPALYAMEL

SEQ ID NO: 180719 - protein, 188 aa, Glycine max
  Coding DNA Sequence Number=SeqID_89034
MIEANLDCEIRVEQQLKEKSTSKSYGSHSYPKKDQGQGILGRTHYFSMPHHKNHDYEGQDIYSSQDEATTSPSSSESEEAKGEKSSEEIYPQEERQPLVVKEKCKETLASIATPLGLEFIPQVKKLLDEGLVRKSLNPCALLVPKIGIIRHQILMIGGMMNVLSGAILFCKITHAPNIFMICVHRDSL

SEQ ID NO: 180720 - protein, 95 aa, Glycine max
  Coding DNA Sequence Number=SeqID_89035
MLSFDFRHVTELHELPNDGCQVPRSGQTRVASQQTAGPRTKLGYDRCPTPSTIQSFIGSHANRRVKTIVINTRSQKILQQLNGPFSLAISLRMVG

SEQ ID NO: 180721 - protein, 155 aa, Glycine max
  Coding DNA Sequence Number=SeqID_89036
  Subcellular localization annotation: CTP_CleavageSite=29; ConfidenceScore=5.42e-01
MSPPPLRPHNHSQTHLKLSRRLHLQALVSASLHTAKSLKLSRTWTFLSLELSRHTKASRKGQTPSQNLISGLNRWLCSGSEWIKVVRLVGWPVAQRTCTALRLCSALFQIFPHAQPWSIVLSGWLAKPTGWLSQRVKISTIQTRLINLKLRENDY

SEQ ID NO: 180722 - protein, 214 aa, Glycine max
  Coding DNA Sequence Number=SeqID_89037
MTYQFKAVFHVDRNIIEVPSVYHKQWTPDYPDYVVLDYNGKKHHIRVRKFSNRVYIVDGLKHFRRDMGIYEGVMITFAAPDKNWKFDIHFSPPLHAQTCGRPVHSAREYVFTVDVDNRMIVRLYPLVLPLDVVGYVNAGDGYVTVLGVCGHCHFWKLSMHNGLKCFADPWFQFLTENDLMAGDEVVFYFRPNQLLWEVIARKQTVWDEDEDDSP

SEQ ID NO: 180723 - protein, 43 aa, Glycine max
  Coding DNA Sequence Number=SeqID_89038
MVRIVWLSFLNWYPQGSVSSLNAHRESVFVYVRAFTRKEAQKL

SEQ ID NO: 180724 - protein, 158 aa, Glycine max
  Coding DNA Sequence Number=SeqID_89039
MQLGGFDERTSFQILDFRIERDIERNQEFSLFLRFMDPIQFSGIFHSYFFPSREFYKTLGLPNLEYPTFTQFTGFNKQSIFHDQEKRAILVVRYLMKPLLELRSHSKRKISNIWSSFLYIIWMFANSKDHDWEFVDRLCLEKEAQHNQLGFGTAIRNL

SEQ ID NO: 180725 - protein, 139 aa, Glycine max
  Coding DNA Sequence Number=SeqID_89040
MPISPCRCIGWDHTHKTPSGPEEVQQGPGVSSSGYGPLSVLQGARSPSEESHPQRHPVDPEKSNRALGFPALVTGLCSPTGCPFPPARSRHHDIGIAPARHPVDPKKSNRVLELSSSNYGSLSVLQSTCHLQQGHQAPY

SEQ ID NO: 180726 - protein, 20 aa, Glycine max
  Coding DNA Sequence Number=SeqID_89041
AKSAQFPLHVWLPDAMGGIL

SEQ ID NO: 180727 - protein, 137 aa, Glycine max
  Coding DNA Sequence Number=SeqID_89042
  Homolog annotation: Hit_ID=Q9LHC7; Match level="QueryCoverage=79%, HitCoverage=14%, E-value=7e-09, Identity=32%"; Hit description =Retroelement pol polyprotein-like
MAERGEGNRSPRRTLGDYAYQQGPKHYNSIVIPPFNNKVMELKLALLSLIGSHPFAGMDHEDPYTHLSTFMELCSTMGASDEDVEVVYLRAFSFFISSEVLSSFKIYQCKNLPSRLSPKDLTNLSMRRGKDSKLYYG

SEQ ID NO: 180728 - protein, 80 aa, Glycine max
  Coding DNA Sequence Number=SeqID_89043
MTLGRVIDSQEFPQRKLSMIMRGQDIIVVTEEILLPSSREVKMKWPKDQAQEEWEATPSKQKKRCKTIEKYTLRLVPRKD

SEQ ID NO: 180729 - protein, 135 aa, Glycine max
  Coding DNA Sequence Number=SeqID_89044
  Subcellular localization annotation: CTP_CleavageSite=53; ConfidenceScore=5.16e-01
MAIDQSFFFKLTQLSSDGVSFEVKRSFSIGANVVSSFVYRKKRDGSWVKKDAPAQAAEECSPSPPPQRDDSSSLMHNILDRLDGLHTFIGERFDSLDNRIDAIDARFAGMDTRITQLEEDMSYIHQCFDLPPPSS

SEQ ID NO: 180730 - protein, 327 aa, Glycine max
  Coding DNA Sequence Number=SeqID_89045
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q9PGJ4; Match level="QueryCoverage=58%, HitCoverage=99%, E-value=2e-90, Identity=84%"; Hit description=NADH -ubiquinone oxidoreductase, NQO6 subunit
  Pfam annotation: Domain name=Oxidored_q6; Domain location=209-316; Score=222.0; E_value=1.4e-63; Accession=PF01058.13; Description=NADH ubiquinone oxidoreductase, 20 Kd sub
GGSDAIRRGSSPLLGTIGAAAEARENRCAGRIFAVSAVSDRCHRYRRYADAGWSIPRSPPPRSGKAVAVRVRLRGLRRRAHEVRRALLPDRDPVHRLRPGNHLHRAVDPGLHGAGCPFAHHHGPVRRHAVPRFHLRLEEGSAGMGVIQTLDGLMNNPTPEGRVDDILRPEGDNPLLEKGFVTTSVDALLNWARTGSMWPMTFGLACCAVEMMHAGAARLDLDRYGVVFRPSPRQSDVMIVAGTLVNKMAPALRKVYDQMPDPKWVISMGSCANGGGYYHYSYSVVRGCDRVVPVDVYVPGCPPTAEALVYGILQLQKKIWRTQTIAR

SEQ ID NO: 180731 - protein, 32 aa, Glycine max
  Coding DNA Sequence Number=SeqID_89046
MTVKKRLSHEVLKVIVGLSTSVTLALGNVLLP

SEQ ID NO: 180732 - protein, 104 aa, Glycine max
  Coding DNA Sequence Number=SeqID_89047
  Homolog annotation: Hit_ID=A5AZ88; Match level="QueryCoverage=85%, HitCoverage=7%, E-value=2e-07, Identity=34%"; Hit description =Putative uncharacterized protein
MDIEEDTKIPLILGRPFMLTASCVVDMGKKKLEMGIADQKINFDLFDEDKHLLNQDVCSKVDEGWKEMVLKRALCAKRIFVHTLSESPLVLSASTPTHWLKGPH

SEQ ID NO: 180733 - protein, 199 aa, Glycine max
  Coding DNA Sequence Number=SeqID_89048
  Pfam annotation: Domain name=Transposase_23; Domain location=115-185; Score=-1.9; E_value=0.0019; Accession=PF03017.5; Description =TNP1ENSPM transposase
DSFKEQATQRYFIPHGRQDVLTAAIGPILWISSTNVPQLFLPASRRIAVVDPTNQGQARGVHHRKSDAAAHDILQPDAVPDSVPAPPPDPLVGPFGPRVSTNGSCVDPSGNDPETGDSDRCGLYIEADPARLVAMGRVYEGSTVVHNTPLLFGQVKVSVEEVTDADAPVLVPTDEVSLVGQTLHTFLAWPTHLVKSLSQ

SEQ ID NO: 180734 - protein, 61 aa, Glycine max
  Coding DNA Sequence Number=SeqID_89049
AGSSWATFWGGDQTWTAETNQGSPKAQAGEAPPEVPGDGEEAHEDEEMADLLDFLGGSGAS

SEQ ID NO: 180735 - protein, 97 aa, Glycine max
  Coding DNA Sequence Number=SeqID_89050
TSLKLKDPASIEALQESFHHILCGTSRGYIYLGLTENKKGWNGVEVLKQWKRYFAGYISEKKRQQLNESELWHMPTLISSGEAFSTIFSITLRVLPR

SEQ ID NO: 180736 - protein, 218 aa, Glycine max
  Coding DNA Sequence Number=SeqID_89051
  Gene Ontology: Biological process=regulation of transcription
  Homolog annotation: Hit_ID=Q8RW43; Match level="QueryCoverage=92%, HitCoverage=52%, E-value=5e-32, Identity=43%"; Hit description=TCP1 protein
IKYNSGSGFLPASLDTDNIAETIKTFFPVEATTTSFQSYPPAPPDLGQQDLRLSLQSFQDPIMLHHQPQSHHEPVLFAGTAAAALGFDGGYGWSEHQHQNHHSEEQRLLYAGGNSGHGGGFVFNTPAPVPAFGQFFSQRGPLQSSNTPSIRAWIDPSVDHHHHHHHYLSQLIHQGSVAGGSGFSSGFSGFRIPARIQGEEEHDGVSDKPSSASSDSRH

SEQ ID NO: 180737 - protein, 41 aa, Glycine max
  Coding DNA Sequence Number=SeqID_89052
MELQLRWIFCKPEEQITDMKRHDEKLKAYDTPIQKKGLRGF

SEQ ID NO: 180738 - protein, 35 aa, Glycine max
  Coding DNA Sequence Number=SeqID_89053
MTTMMMKKERIKKEEAKYSWEGKKREGNREKSKWR

SEQ ID NO: 180739 - protein, 71 aa, Glycine max
  Coding DNA Sequence Number=SeqID_89054
  Gene Ontology: Mol. function=oxidoreductase activity, acting on single donors with incorporation of molecular oxygen, incorporation of two atoms of oxygen; Biological process=L-phenylalanine catabolic process
  Homolog annotation: Hit_ID=Q9ZRA2; Match level="QueryCoverage=73%, HitCoverage=11%, E-value=5e-18, Identity=82%"; Hit description =Homogentisate 1,2-dioxygenase
MENPIDGGEFVYLSGFGNHFSSEALAGALPVAQNSPLVCPYGLYAEQISGTSFTSPRNRNLFRFFFASLFN

SEQ ID NO: 180740 - protein, 23 aa, Glycine max
  Coding DNA Sequence Number=SeqID_89055
MTTAIIGDGGGDSGSCAGDLDIN

SEQ ID NO: 180741 - protein, 157 aa, Glycine max
  Coding DNA Sequence Number=SeqID_89056
  Homolog annotation: Hit_ID=A0ST23; Match level="QueryCoverage=29%, HitCoverage=93%, E-value=3e-20, Identity=100%"; Hit description =Putative reverse transcriptase
DAGSRQARQGASAGVGGCRGWLNYAASEQIVLRVHHMRAIGAGLFAITPAGERGMCCKAIKLGNARVFPVTTLIPFIKGYATIAAPFTALMTKDQFHWTLEADQAFLKLKGLTHINCVALTARFPVGKPVVPAALMNRPTRGERRFAYWALFRFLAH

SEQ ID NO: 180742 - protein, 156 aa, Glycine max
  Coding DNA Sequence Number=SeqID_89057
VVPEDMSRGSGDLGDVRWGAIAQNQAWPIPTQPGHSQPVRTCDVPQQASFWQSTNKGTKVHEAGRLIVMAAQLIHDRVVMVCLEGVWETLKGDERCRFRGTVRLTATSLVHPKQPARTLQQLMEWILPTPVEWILVEPVQLIEVSSSEEDLEEDPE

SEQ ID NO: 180743 - protein, 72 aa, Glycine max
  Coding DNA Sequence Number=SeqID_89058
MAPRKLASKRSRKNAAAAGTSAAPEFDSHRFKSAEHQQHFKAIKGWSFHRERRVQLRDDEYTDSRVLRQCLG

SEQ ID NO: 180744 - protein, 110 aa, Glycine max
  Coding DNA Sequence Number=SeqID_89059
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
GITISGGCVIAAVAEVVVSGEEAVQSRGHVVVVIVIGGRGRGVGVMATVEEEGGGDDGMQAWHWPSFYNVVTGKTLALPNLIALQHIPLSPAGVIAKRPAPIALPNSCAA

SEQ ID NO: 180745 - protein, 88 aa, Glycine max
  Coding DNA Sequence Number=SeqID_89060
  Gene Ontology: Mol. function=structural constituent of ribosome; Cellular component=ribonucleoprotein complex; Biological process =translation
  Homolog annotation: Hit_ID=A6H5N0; Match level="QueryCoverage=88%, HitCoverage=63%, E-value=2e-37, Identity=100%"; Hit description =Ribosomal protein S12
  Pfam annotation: Domain name=Ribosomal_S12; Domain location=1-87; Score=121.6; E_value=2.4e-33; Accession=PF00164.16; Description =Ribosomal protein S12
NYLLFELEKITPKKPNSALRKVARVRLTSGFEITAYIPGIGHNLQEHSVVLVRGGRVKDLPGVRYHIVRGTLDAVGVKDRQQGRSSAL

SEQ ID NO: 180746 - protein, 194 aa, Glycine max
  Coding DNA Sequence Number=SeqID_89061
  Homolog annotation: Hit_ID=A5B939; Match level="QueryCoverage=26%, HitCoverage=33%, E-value=4e-15, Identity=76%"; Hit description =Putative uncharacterized protein
  Subcellular localization annotation: CTP_CleavageSite=55; ConfidenceScore=5.36e-01
MALKRATIPGVGQDQAPMSRRARRSLQNPGREPGRSGRRCRSWCLPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDGNGPFGASSPGVEQSNRRLNLGHRGERLIEPSSSWFPPKFPSG

SEQ ID NO: 180747 - protein, 19 aa, Glycine max
  Coding DNA Sequence Number=SeqID_89062
MAGYKYRNGNKSSYRAPNE

SEQ ID NO: 180748 - protein, 102 aa, Glycine max
  Coding DNA Sequence Number=SeqID_89063
MASSGVLNLIFPLAEASRSCLEWGHKPSMKMLSWIGSLNPCVGVFRSNPWKRSNASLSDSSGCWWKDEIFTFPSTVLDSGKYFFRNFFTTSSHVRKLFPLNG

SEQ ID NO: 180749 - protein, 58 aa, Glycine max
  Coding DNA Sequence Number=SeqID_89064
MEPEKCLNGRQNYSNKAPSVVINRLTTIQRHFLWGGGAEANWLPKSWLQSAVGNQSTS

SEQ ID NO: 180750 - protein, 70 aa, Glycine max
  Coding DNA Sequence Number=SeqID_89065
MARSVLAPCPYFRDLYGGELKGLLTIIPKVVISLLMVSRGIIPFEEHIAAIGTTSNNMLSKRKTLDEGSL

SEQ ID NO: 180751 - protein, 145 aa, Glycine max
  Coding DNA Sequence Number=SeqID_89066
MRSQFLSQMQSQGLALPPESEVGPSAACVSTKESCVDPLRNDPNTVKVGVEEVRDAYAPILVPTKEGAVGPAKPADRPDHDVDDHLYLMTLTIPQLFLKSLQVMWDATVFGVFNDNFPLYIKHEDVSEIAHGGQCLNISILQLWV

SEQ ID NO: 180752 - protein, 173 aa, Glycine max
  Coding DNA Sequence Number=SeqID_89067
  Subcellular localization annotation: CTP_CleavageSite=61; ConfidenceScore=5.04e-01
HKTPVDRRSQQALGFQLWLRASVSPTGCSFPPARSHHHDIGVAPTKTPSGPGEVQQGPRVSSSGIAPVRHPVDPKKSSRVLGFPTLITGLCQFHREPVAPNKVIRPPLTGFSSRSNVPPGRRRARHHSSLGMAGSGQQTHRRHLQSPSAHPQEVSTLPMTHGQPAADQVQSQR

SEQ ID NO: 180753 - protein, 198 aa, Glycine max
  Coding DNA Sequence Number=SeqID_89068
  Homolog annotation: Hit_ID=A7K7L5; Match level="QueryCoverage=94%, HitCoverage=67%, E-value=4e-53, Identity=50%"; Hit description =Putative uncharacterized protein
MRLEGLVSDPESLPDEKTPGAVAADLIRSRASEFKERGKGDSLPRLIRVALSQREFRKQFTGGPYSGYETSCDVLPPDYKYYACFSTRHYQNDDRVCSTEEYWATGSVYVQRYVAKVVDNKPVPVASCSYNGNDASCPGSIDDDARWNTGPKVKAPTYSSKPLPQLDGEVDDSDDHAWIKACLTDSGFPLSNPTKAGG

SEQ ID NO: 180754 - protein, 80 aa, Glycine max
  Coding DNA Sequence Number=SeqID_89069
MGHLSDQGVPTNPKRIKVILECPTPPNVEGRSPEFQEPLDLRSNPFQGGGNDAILPPQGHWIEDSKKIGLEMQEKTLGFS

SEQ ID NO: 180755 - protein, 96 aa, Glycine max
  Coding DNA Sequence Number=SeqID_89070
MNTGAREIVSFLDTTSWGNTVPDCGKRHATCLLRAPILGTYMGMELKGLLVIIPKVVIYLLMVSRGIIPFEEHIAAVGTTSNNMLSKRKTLDEGSL

SEQ ID NO: 180756 - protein, 219 aa, Glycine max
  Coding DNA Sequence Number=SeqID_89071
RKQDVVDPNNANTAALGEVVETLQYMVSPQGRNTWTVDDLVPYVDKLAIISEEQERITEPMSHGPASVREFPAPEFHILQSSVETQGIGRRREPVEAEQYSQQMMERGHGMYYTPATFSEYPSQMYRYPFAGHDTDTSETSHSFGGVAETQPHFSWPTMTPSQQHDAPMATPNAPFAPQWNKRGDNAAAEEILIVKCEDGIDHVAHSHDIMDTIMIDFD

SEQ ID NO: 180757 - protein, 80 aa, Glycine max
  Coding DNA Sequence Number=SeqID_89072
MELIENMAASDQAILRDRSYVPTKRSLLELGTQDATFSGTFIPSKVPSALVCHPHPLCLEILLRMDTARLVLVKEPWWMM

SEQ ID NO: 180758 - protein, 180 aa, Glycine max
  Coding DNA Sequence Number=SeqID_89073
MGEIEEVQERMKADMEAMKKQMITMMEAMMSTKKITEVNVAAVAATSAVAQVDPTPLSGLNQINHPTSNMVGQEGKELGSAGSPHFVQVQNEHPFPPYGLPPNYMPPNVAHTPDENVNNSNLILAENQQPQSDHARVSQCMGETHEIPYHNLPDFEPRLGYTTKGQTVGGVALPNTLEGS

SEQ ID NO: 180759 - protein, 138 aa, Glycine max
  Coding DNA Sequence Number=SeqID_89074
  Gene Ontology: Mol. function=microtubule motor activity; Cellular component=microtubule associated complex; Biological process =microtubule-based movement
  Homolog annotation: Hit_ID=A7P105; Match level="QueryCoverage=100%, HitCoverage=18%, E-value=4e-29, Identity=47%"; Hit description =Chromosome chr19 scaffold_4, whole genome shotgun sequence
MMDYIKRLKVCIRWFQDLEISYSLEQEKLKSSLELAQQKCTKIELLLKIKEEKLNSIIMEMRRNCTPLQEKLVKKESEKIVTTESLLKERETRLNFEMSQSTLQEDLARAQRELQSANQKISSFNDMYKRLQDYITSL

SEQ ID NO: 180760 - protein, 74 aa, Glycine max
  Coding DNA Sequence Number=SeqID_89075
MEAGSLSFNEALQRRRGERRRHPLGNKPWKKELHDQESALDKKFREETSMEEKKEREKEREGSTKLKEEKRERS

SEQ ID NO: 180761 - protein, 124 aa, Glycine max
  Coding DNA Sequence Number=SeqID_89076
  Homolog annotation: Hit_ID=Q9SND3; Match level="QueryCoverage=52%, HitCoverage=16%, E-value=2e-09, Identity=49%"; Hit description =Putative uncharacterized protein F11C1_180
MENDGVERLGHGVEMRTKEEEEHKTIEDKKGSNWTRIESRWGCEIYVCLPLQNAPQRALSDAEFAHVEAEFGFMFPLDLHNAHVVDLLVSSRFPDWHSGATRLDIRMSLNLSIAMISFQICTEH

SEQ ID NO: 180762 - protein, 267 aa, Glycine max
  Coding DNA Sequence Number=SeqID_89077
MPKEMEETYIQLVIISSSYPLNIPIKSAPLKDDYLTSGSSGPFIGQVDDATQSKKTSSRASQSVIIGGETTYRLSESQRSSNNVSSFGGKVSHAIRSEVRSQYSNSIGPSFGGQVSHAIRSEQPSKESNSTIPSFEGRVSHAIWSAKTSKESNSSIPSFEGRVNHAIWSEKPSKESNSTIPSFEWRVSHAIGSEKPSPYSNNNRPSFGEQVTHAIQSQDAYTSLYFSNIPNPNPNQDLVHHTIRARSAPLRRSISKLWRACKSCNIS

SEQ ID NO: 180763 - protein, 101 aa, Glycine max
  Coding DNA Sequence Number=SeqID_89078
  Subcellular localization annotation: CTP_CleavageSite=58; ConfidenceScore=5.25e-01
MASSLATMFSINSIANSGVYSLILPPAEASRSFLIHLGINGRMKSLMQFYPARALGRRFQVDWARDPREGPRVLMSLRLSFSFFRNLLKEASQGGELSYER

SEQ ID NO: 180764 - protein, 89 aa, Glycine max
  Coding DNA Sequence Number=SeqID_89079
  Homolog annotation: Hit_ID=A5B471; Match level="QueryCoverage=68%, HitCoverage=4%, E-value=3e-10, Identity=47%"; Hit description =Putative uncharacterized protein
MGRAMRWLKGPYNTACVRWAPTALINRLTAIQRQFLWGGSFEGKKIASVAWRQMSASRDLGGLGIKHIKVLNNALLIKWKWLMFHQSRF

SEQ ID NO: 180765 - protein, 83 aa, Glycine max
  Coding DNA Sequence Number=SeqID_89080
  Homolog annotation: Hit_ID=A7PUS7; Match level="QueryCoverage=55%, HitCoverage=7%, E-value=2e-07, Identity=65%"; Hit description =Chromosome chr4 scaffold_32, whole genome shotgun sequence
MELNVLEVGINDRTLSQAEVELKKYLQDQLWNAAYAFESGQTEVIIEVLIQIAKNEEIDLFVNFVAKIATKSKQNLRRAIMAL

SEQ ID NO: 180766 - protein, 114 aa, Glycine max
  Coding DNA Sequence Number=SeqID_89081
MGFFWFYFRHGVVLYVNSAPCRTQTAIANGEFGVTEQAANGTGETCLNRHYRWRFVQAQNRQSNWRVPLSFKGELQLPLASCLEVATPIGDLGLKIAITSGDFMPIYTFQLCVF

SEQ ID NO: 180767 - protein, 195 aa, Glycine max
  Coding DNA Sequence Number=SeqID_89082
  Gene Ontology: Mol. function=microtubule motor activity; Cellular component=microtubule associated complex; Biological process =microtubule-based movement
  Homolog annotation: Hit_ID=A7P105; Match level="QueryCoverage=52%, HitCoverage=16%, E-value=2e-21, Identity=48%"; Hit description =Chromosome chr19 scaffold_4, whole genome shotgun sequence
MRRGQRRRRGRDHRNHHRHCQKKKVGQGEWRWRGGCRKKKVCLLVGYDSFNEVCFLPSAIVSRFQGKHDGLYKKVEELLRKIKEEKLNSTIMEMRRNCTPLQEKLVKKESEKIATTESLLKERETRLNFEMSQSTLQEDLGRAQRELQSANQKQYNGKLHSELCTVGNELKRVEKDKAIVLESLTMLKGQLTLSM

SEQ ID NO: 180768 - protein, 195 aa, Glycine max
  Coding DNA Sequence Number=SeqID_89083
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=20%, HitCoverage=3%, E-value=2e-10, Identity=82%"; Hit description =Phosphoenolpyruvate carboxylase
MAIDLYIREVDGLRFELSMNQCSDKLSELAHEILKDYHVNLMVLLKPLILPCNILNDDIMLYLFILEALVIHLIPLCLLYALLLGASRHCPLGLEIPLKIILTYLFCGLIFSRQPNHKGGETSSSTESNGGSQNVRLSIPILPNSSSSLVSMTYSPSFNSSQLVAQRKLFAESQIGRTSFQRLLEPNSGSWNCSL

SEQ ID NO: 180769 - protein, 110 aa, Glycine max
  Coding DNA Sequence Number=SeqID_89084
MDAKHLTRTKERSHVIKQRSPDEIRSLLLRNLGLRVSQRALRGRARARLTGALSEGGRCAESPPTFIFGKRRENRWKLVKMKILSSGVVFTLEEGISTSHVCPEGQQSIF

SEQ ID NO: 180770 - protein, 120 aa, Glycine max
  Coding DNA Sequence Number=SeqID_89085
MTWLHIKGALPLSPKQHFLQHLGVQLAGVRMNRWQYWWLALTWSIWKLRNNIVFSNASFNANALFEDATFLLWPWLRDFEKAVGRGPTIMGLGDNHRLGSRHMSLVFYSKLCRYGGQRQK

SEQ ID NO: 180771 - protein, 163 aa, Glycine max
  Coding DNA Sequence Number=SeqID_89086
MTDPLDESISCFLIRVDPWVLVTLTFRGLHVLTFRGLHTLAIRGLHVLTFVGLHALTFRGLHDYTSSPSEGCTPSPLRGLHVLALRGLPALALGYTGLHALAIRGLHVLTFVGLHALTFRGLNVLPRGLHALRTTRPRQQRAARPHLERTTRPRQQRAARPHL

SEQ ID NO: 180772 - protein, 125 aa, Glycine max
  Coding DNA Sequence Number=SeqID_89087
MAASDIAILRDRTHVPTKKSLLELTSQDALLAQNKLQGVPSVVKLTILAVVSPMKNELMKSIIWGTSQDKISMQVDIPGFSMVSHIIHNRDNGVITLETSSTKTMGRPSNRPQQQGPSLYDQTMK

SEQ ID NO: 180773 - protein, 52 aa, Glycine max
  Coding DNA Sequence Number=SeqID_89088
MGLHHFGNQSFGSRVVVNIIGWGTKILVGCSQCSNAKTIERTTRSCMKELSD

SEQ ID NO: 180774 - protein, 216 aa, Glycine max
  Coding DNA Sequence Number=SeqID_89089
MEAMKDQMSTMMDSMMSMRKMMEVNAASVATTSTTTEVDPTHPSGMNQGGEVLGSMGGPHFAQVQSKHSFPLYGLPPNYEPPNVVHVPDENIDHYAPIPLESQQPQSGHAHVAQPMGETHEVLADFEPYPGYATEGQAFGGIPQPNTLGGLQYCPQPQPQPLHFSVGRVPPAMVEREKYDHLEERLKAIEGGGDYPFVDMAELCLVPDIIIPPKFK

SEQ ID NO: 180775 - protein, 15 aa, Glycine max
  Coding DNA Sequence Number=SeqID_89090
MLNVTCDIDFLKTDV

SEQ ID NO: 180776 - protein, 91 aa, Glycine max
  Coding DNA Sequence Number=SeqID_89091
MKSVFKFFLSLSKKDVALIELGPGGLFFTGDESGLLMVWKWLESVFKFFLSLSKKDVALIELGPGGLFFTGDESGLLMVWKWLEVPKVASS

SEQ ID NO: 180777 - protein, 109 aa, Glycine max
  Coding DNA Sequence Number=SeqID_89092
  Homolog annotation: Hit_ID=UPI00005FA43D; Match level="QueryCoverage =91%, HitCoverage=47%, E-value=1e-18, Identity=43%"; Hit description =COG2184: Protein involved in cell division
MSRYHVSSSEGQYEKESGEQVLANKLGITDSDELDGAELVLLEQLYRSVFEQHFPLGRITVEMLKGWHHRWLGNIYAWAGQARAVNISKGGFIVCPFDAIAQNYWTISK

SEQ ID NO: 180778 - protein, 120 aa, Glycine max
  Coding DNA Sequence Number=SeqID_89093
DAGSRQARQGASAAVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSP

SEQ ID NO: 180779 - protein, 69 aa, Glycine max
  Coding DNA Sequence Number=SeqID_89094
  Subcellular localization annotation: CTP_CleavageSite=31; ConfidenceScore=5.44e-01
MVAIIPTKWAKRASTAKHNFSALSATKESRRASALRPHIKREISALSATGVFSQAQRKTGAKPKPTYSR

SEQ ID NO: 180780 - protein, 253 aa, Glycine max
  Coding DNA Sequence Number=SeqID_89095
  Homolog annotation: Hit_ID=A5CB76; Match level="QueryCoverage=42%, HitCoverage=37%, E-value=4e-07, Identity=34%"; Hit description =Putative uncharacterized protein
ARATVEELKKFLVADSLEEMNRKLDKFYMVLILRSLHSDFDHVRDQVLAGDQVPSMDYLITRLLRVPHALKEENPADVVETSTMVASRGRGGGHNSRRGRSGKGGRPQCTYCKRIKKNENYVKQANKKRKEVVLEPGDDLGHLRTNVFQEGGNDENHETGQIQAKGPSGEGRRPKDFWHLIKFGESFSLSSLLNQSQTYQGNPCGVYPDLFSFTGSGVNQTSVACIKRSTPTQVRIICKRIAIPCMDFLKKLP

SEQ ID NO: 180781 - protein, 113 aa, Glycine max
  Coding DNA Sequence Number=SeqID_89096
  Pfam annotation: Domain name=G-patch; Domain location=1-42; Score =27.7; E_value=4.4e-05; Accession=PF01585.14; Description=G-patch domain
MVARVMLGYGYELGMGLGKNNSGRTSLVSTRGNRSKFGLGYKPTQADIRKSISERKNRGQGSRLGQQAEGAPPCHISRSFISAGLRHEGQVAAICEDDSPRRSDLVRPCPPGF

SEQ ID NO: 180782 - protein, 163 aa, Glycine max
  Coding DNA Sequence Number=SeqID_89097
MTGRLLVGSLALESRILHYLIVRILLPRSSNLAQVSEEDLLVMWAFHIGRKINWAHLFRSFLIGVVVVASFGYCKERDGSWVKKGAQPNDDEGHLPVERDSSLLQSILDRFDGLQTYVGERFNSLERQVDTQFEEMNSRITKVEEDVTIIHNYLDLPPPPPPV

SEQ ID NO: 180783 - protein, 125 aa, Glycine max
  Coding DNA Sequence Number=SeqID_89098
  Subcellular localization annotation: CTP_CleavageSite=12; ConfidenceScore=5.04e-01
ALCPDVLQHKVPLSTSPSHLLPRTQGSGSSQDPNTNSKPGQAHETIYAKTQAYMQCGTMSVKNLVGRLGVHDKTNHTICFARMLQPYGINIGLKEHSNRVTPKAYTPKSPSGPLPPDSGPTQKTF

SEQ ID NO: 180784 - protein, 72 aa, Glycine max
  Coding DNA Sequence Number=SeqID_89099
  Gene Ontology: Mol. function=drug transporter activity; Cellular component=membrane; Biological process=multidrug transport
  Homolog annotation: Hit_ID=A7PEG4; Match level="QueryCoverage=75%, HitCoverage=12%, E-value=2e-12, Identity=54%"; Hit description =Chromosome chr11 scaffold_13, whole genome shotgun sequence
MNLRAFSLVGMPVAVGLAFWLEVCCAGLMLYMIGTADWEYQACRAQLLTALDQGSDGHKQPLLAAVDKNNNS

SEQ ID NO: 180785 - protein, 397 aa, Glycine max
  Coding DNA Sequence Number=SeqID_89100
  Homolog annotation: Hit_ID=A7PEG2; Match level="QueryCoverage=99%, HitCoverage=96%, E-value=1e-107, Identity=52%"; Hit description =Chromosome chr11 scaffold_13, whole genome shotgun sequence
  Pfam annotation: Domain name=IQ; Domain location=121-141; Score=31.4; E_value=3.3e-06; Accession=PF00612.18; Description=IQ calmodulin -binding motif
  Pfam annotation: Domain name=IQ; Domain location=143-163; Score=18.5; E_value=0.026; Accession=PF00612.18; Description=IQ calmodulin -binding motif
  Pfam annotation: Domain name=IQ; Domain location=169-189; Score=6.7; E_value=8.2; Accession=PF00612.18; Description=IQ calmodulin-binding motif
  Pfam module annotation: Pfam domain module=IQ::IQ::IQ; Domain location=121-141::143-163::169-189
MGRATRWVKSLFGIRKEKEKKQNFKCGEAKSMEFCCSESTSNSRVLCHNPGTITPNLSQAEAAWLQSFYTEKDQNKHAIAVAAATAAAADAAMAAAQAAVAVVRLTSQGRGGTMFGVGPEMWAAIKIQTVFRGYLARKALRALKGLVKLQALVRGYLVRKQATATLHSMQALVRAQATIRSHKSRRLMTTKNEAYRSQIRARRSMERFDDTKSEYAVPIHSRRWKWTLSRLSQGIEGQYQILVMNHHFKHFQTEPPTRLSIPDQRNFQDSEWGLTGEECRFSSTAQSTPRFTNSCSCGSVAVPMTPKSVCTDNLFFLRQYGNFPNYMASTQSFKAKLRSHSAPKQRPEPGPRKRISLNEMMESRSSLSGVRMQRSCSQVQEVISFKNAVMGKLQKST

SEQ ID NO: 180786 - protein, 69 aa, Glycine max
  Coding DNA Sequence Number=SeqID_89101
MSLSLRRFVALSKIVQADYQPRRPQDKTTQITATKNFIATERKREKFAGNASVEIWEGERKVEEMLLNW

SEQ ID NO: 180787 - protein, 126 aa, Glycine max
  Coding DNA Sequence Number=SeqID_89102
  Homolog annotation: Hit_ID=A5B2U1; Match level="QueryCoverage=93%, HitCoverage=30%, E-value=2e-08, Identity=35%"; Hit description =Putative uncharacterized protein
MDEIWSQIHKSQPHYNEANNSLARNEPLLKRQQTLGEMTLEDFLVKARVVQESSSLFKSSLLYQNQIGNIASNGPLSASYRFRHVIGTGSIIKDVTTNGAVEKCPSLGESSGKGNRKGSLMTLVKW

SEQ ID NO: 180788 - protein, 342 aa, Glycine max
  Coding DNA Sequence Number=SeqID_89103
  Homolog annotation: Hit_ID=A2Q1D6; Match level="QueryCoverage=13%, HitCoverage=7%, E-value=7e-07, Identity=62%"; Hit description =Ovarian tumour, otubain, related
MDNSHVTDNDGCSKLNGMNAEHANTCEGGGSGGVRCCSGRQRWHTRYTMLGAFWCTAFHTDQVDLRDDVLWWAQSVAYENGFVAVIVRKKEFVRRDTETRKYRYPFKLRGKLVVGGQGWMTKLICGIHNHELAKSLVGHSYAGTYKTNMYRLSLLDFVEVTPTGMTFSTDFVYLEGERLNNVIWALERYALNQIATKFERVHYAGNNPSSCGCVMRTTHDLPCACELSKYVVGCILLDSIHMFWRRLSFSDQGIFEPKTKLRGIAYPDQNSMCSPLAKQNNNSSVRRSSSSSDQPNPRRMMSMLDQFQSFIHVFIDNIVDVGADGNCGYQAIAGLLGMSEAS

SEQ ID NO: 180789 - protein, 593 aa, Glycine max
  Coding DNA Sequence Number=SeqID_89104
  Gene Ontology: Mol. function=transporter activity; Cellular component= membrane; Biological process=oligopeptide transport
  Homolog annotation: Hit_ID=Q7XJQ3; Match level="QueryCoverage=96%, HitCoverage=98%, E-value=0.0, Identity=66%"; Hit description =Putative peptide/amino acid transporter
  Pfam annotation: Domain name=MFS_1; Domain location=46-514; Score =20.3; E_value=0.004; Accession=PF07690.7; Description=Major Facilitator Superfamily
  Pfam annotation: Domain name=PTR2; Domain location=108-506; Score =319.8; E_value=5e-93; Accession=PF00854.12; Description=POT family
  Pfam module annotation: Pfam domain module=MFS_1::PTR2; Domain location=46-514::108-506
MEKKVSLEVKPEEGDEVKWVLDSSVDHKGRVPLRASTGSWKAALFIIAIETSERLSYFGIATSLVLYLTKVMHQELKTAARNVNYWAGVTTLMPLFGGFIADAYLGRYSTVLASSIVYLIGLVLLTLSWFLPSLKPCDGTDMCTEPRRIHEVVFFLAIYLISFGTGGHKPSLESFGADQFDEDHDGERRQKMSFFNWWNCALCSGLIVGVTLIVYIQDNINWGAADIIFTVVMAFSLLIFIIGRPFYRYRVPTGSPLTPMLQVLVAAISKRKLPYPSNPDQLYEVPKYNSNNRRYLCHTNKLKFLDKAAILVDDGSSAEKQSPWNLATVTKVEEMKLIINIIPIWVSTIPFGMCVAQTATFFVKQGTQLNRKIGEGFEIPPASIFTVAALGMVVSVAIYDKILVPALRRVTQNERGINILQRIGFGMLFSIATMIVAALVEKKRLEAVERDPLKGSLTMSVFWLAPQFLIIGFGDGFTLVGLQEYFYDQVPDSMRSLGIAFYLSVIGAASFLSSMLITVVDHITKKSGKSWFGKDLNSSRLDKFYWLLAAIATVNLFLFVFVARRYSYKNVQKLAVADCYEGKSDCEGVETKV

SEQ ID NO: 180790 - protein, 50 aa, Glycine max
  Coding DNA Sequence Number=SeqID_89105
MGPNGRSFNSAVKLCCDDGVNTEIFSLEVREVVWQGRPKCRQCSLVAARI

SEQ ID NO: 180791 - protein, 67 aa, Glycine max
  Coding DNA Sequence Number=SeqID_89106
MTKGKKEEEGRGDREGGHGGGRRKKQRMRIEGGGGEEKRRRKVRRGEGEEKEKGSVGWEKEVYFGVG

SEQ ID NO: 180792 - protein, 107 aa, Glycine max
  Coding DNA Sequence Number=SeqID_89107
  Gene Ontology: Mol. function=3-beta-hydroxy-delta5-steroid dehydrogenase activity; Cellular component=endoplasmic reticulum; Biological process=steroid biosynthetic process
  Homolog annotation: Hit_ID=A7P4W1; Match level="QueryCoverage=63%, HitCoverage=11%, E-value=2e-24, Identity=75%"; Hit description =Chromosome chr4 scaffold_6, whole genome shotgun sequence
MALSMPFLCYLSHVAFRPRVKIPTFVIMPIAHLVEWIYKQLGPYGMKLPQLIPSRIRLISCSRTFDCSKAKDRLGYAPIVTPQEMKYEMLLLNGDISVHQGGSAEDN

SEQ ID NO: 180793 - protein, 131 aa, Glycine max
  Coding DNA Sequence Number=SeqID_89108
  Gene Ontology: Mol. function=inositol oxygenase activity; Cellular component=cytoplasm; Biological process=L-ascorbic acid biosynthetic process
  Homolog annotation: Hit_ID=O82200; Match level="QueryCoverage=52%, HitCoverage=27%, E-value=9e-22, Identity=58%"; Hit description =Inositol oxygenase 2
  Pfam annotation: Domain name=DUF706; Domain location=19-130; Score= -103.8; E_value=6.7e-08; Accession=PF05153.6; Description=Family of unknown function (DUF706)
MSLSLRRFVALPKIVQADYQPRRPQDKTAQITAKKMREEYGKLNKVKMSIWECCEMLDKIVDVSDPDLEESQIQHALQTVFTDFGKALILPSFGGLPQWAVVELNELDQLLIEGAERLDEEPSRAGLLDDL

SEQ ID NO: 180794 - protein, 119 aa, Glycine max
  Coding DNA Sequence Number=SeqID_89109
MVRIRGLRRTLGKVLRRALGRQVSDDVKEAPQRQRPTTSAHRQQAAATVAEDERTELKLTSHGMKIEKFGRPTSEIEGIVAATGLSSLITCLLDTSDRGLLSTFVEAGTRKLVVFFYRK

SEQ ID NO: 180795 - protein, 190 aa, Glycine max
  Coding DNA Sequence Number=SeqID_89110
MTSIGEESSNDDGGDGGGLLYVSSNGDSPNAIKDFRLSIGLWMVHGAKSQLGATESKKVATLYAEWCGGKAPKWAPLEKRSTTTKIVVKPWDWGSPMMKSIEMSTQIPFGIDRGGPVKWNIPGGHLDEAQPCSISPKKQGTAKVTFVGLPRNRMLNTAPIVKPEASISSVKGMEKSRGTKIEAVVMACFS

SEQ ID NO: 180796 - protein, 185 aa, Glycine max
  Coding DNA Sequence Number=SeqID_89111
  Gene Ontology: Mol. function=(+)-abscisic acid 8'-hydroxylase activity; Cellular component=integral to membrane; Biological process=response to stress
  Homolog annotation: Hit_ID=A7NYX2; Match level="QueryCoverage=65%, HitCoverage=35%, E-value=6e-39, Identity=53%"; Hit description =Chromosome chr6 scaffold_3, whole genome shotgun sequence
MAAFLMNLESNFDNKQQGHESSLKLNVKVSIRPCKSCGEKLERANVKWHSTSPYATPLISSTTYIFKTNILGCPCVMISSPEAARIVPVTHAHLFKPTYPPSKEKLIGPEAVFFQQGAYHSMLKRLVQASFLPSTIKHSVFEVERIVIKMELEMEEIRELYRCLEKGYNSYPLHVPGTSYWKAMK

SEQ ID NO: 180797 - protein, 75 aa, Glycine max
  Coding DNA Sequence Number=SeqID_89112
MRIEELMHWRLIKTLRENCQKLSGLPTKVELRPHWQPTKSRPPKRKQGCQVQKMWQDLKKETTNSQKQKLHLLQG

SEQ ID NO: 180798 - protein, 151 aa, Glycine max
  Coding DNA Sequence Number=SeqID_89113
  Homolog annotation: Hit_ID=A5B371; Match level="QueryCoverage=97%, HitCoverage=12%, E-value=5e-20, Identity=36%"; Hit description =Putative uncharacterized protein
MKDGELIQSELPPTTQYQLPNVKDSNNKLVMAIPFKTKDVNEEATSKDIKSLMEQANYTNKYLQVFGESIKTKRTTAPDLLLEERGEKNFKSFSANNIYEWNIDAQTEYNIMNTLQHMTMVATTYKTSHECSEETIIDILVAGFFEQLKGW

SEQ ID NO: 180799 - protein, 126 aa, Glycine max
  Coding DNA Sequence Number=SeqID_89114
MVEVSIKNKTRWAKSINRKHINEWFLAIRTCLMPPPNYVFGPRDAVNVFLLEASELRDSNLADCGGLIGYHNGKYVLGFMVKLGTCSVSRAQLWAIFQGLKLALDRELTNILIESDSTEAEAEAVQ

SEQ ID NO: 180800 - protein, 361 aa, Glycine max
  Coding DNA Sequence Number=SeqID_89115
  Homolog annotation: Hit_ID=A4PP05; Match level="QueryCoverage=37%, HitCoverage=34%, E-value=1e-20, Identity=39%"; Hit description=IMP dehydrogenase/GMP reductase, putative
MVRTRGLGRALEAALVAEDAPDMTEDILAPGAEVADGCEGFPIDDAEGFPGGSRDPSVLTEFGDHVALSIWNGEERSKLKLASHKRKVEKFRRPAPEIEGLVAATGLTPLIACSIDTGNWGVISAFVESFEPLHMDEAMLMLVELLEVSGEEARAETTQCHGAYSGSYAWGATALVHMYDHLNDACKSGGQQLAGYITLIQCWIYEHFPSVHESVIDLEYDETSPHACRWLTMKAYSKGFPASTYWTHIDALTIPDVCWMPYGGLRWGPVVVTHRPERVVRQFGYVQTIPPLPMGASLSYEDIDNKWMHYSDHLVAVDPPRHPSVPQHDTYEEPDIPEVLVALEVGPSHAPSDAEQPRHAV

SEQ ID NO: 180801 - protein, 193 aa, Glycine max
  Coding DNA Sequence Number=SeqID_89116
  Subcellular localization annotation: CTP_CleavageSite=58; ConfidenceScore=5.18e-01
MERMRKRQPMKEPMAKPTMSSLRALRLMWARKGSSASLLLSRFSANFSPCAARGVILEAALGRGGEGEAHEDEDREEGVHAYQAATAQRTLKGAGGVKEREAQETVGEVEPEGIVAGEAIATEDDVEDAEFLGNSGSPAEEDVKDDKKFMFMVLDEDAGAGFDEANDEEVRDGIGVLCVGREAVVRGVGFGRG

SEQ ID NO: 180802 - protein, 76 aa, Glycine max
  Coding DNA Sequence Number=SeqID_89117
  Subcellular localization annotation: CTP_CleavageSite=49; ConfidenceScore=5.54e-01
MEAKTDAHLVQTVNQTSNSKGLASLFSFQSTPRRGATSRLELPSWEHIRTTANTYFTGLQTGKFVFACIYVFTMYM

SEQ ID NO: 180803 - protein, 44 aa, Glycine max
  Coding DNA Sequence Number=SeqID_89118
MDWVVPESHQKHHGGGGLQWWWRKINPCASLMILPFGEVSKGLW

SEQ ID NO: 180804 - protein, 95 aa, Glycine max
  Coding DNA Sequence Number=SeqID_89119
MDFSHNPTHPDRFITPTVGKHLRDFLGGFLEYDEHNNQGVKVEELHVNQSEIGCAGHNDKFCAQLFAKEEDDGVKNWSVDLRVDIRRIGGIEGGK

SEQ ID NO: 180805 - protein, 77 aa, Glycine max
  Coding DNA Sequence Number=SeqID_89120
MKIACGERRFQNTREWKVGDGHLIRRKDGNGTLTGEGVGSSGRNKCWGNSTTKYKPVSQGKEYVTTGYGVGTILDHS

SEQ ID NO: 180806 - protein, 66 aa, Glycine max
  Coding DNA Sequence Number=SeqID_89121
MLKKRGLSLEQKREKMLPIFYESQDFYLLRNVSCKLDFDLESSKKRHDIIGNKFVCPRSKSSCNQF

SEQ ID NO: 180807 - protein, 235 aa, Glycine max
  Coding DNA Sequence Number=SeqID_89122
MLMCNEQYSCVGSIELLCIVIRTPDAILNLLQSTITPTHDAIITTGSGTYHVQVSFWGYSFTGTNPIRFDIPSGCGMEKLKDLIKQVAPIGVPPNGIHGSQLVRRLFFRQPVMQIAEDIGEFRLGVTRGTGLASATGDLSSMGLASLIDELSSWDTGTHVKIKEGECGVKDESCSCNCMRHQTWSALPVGKREKIFRVYIPTYTTRQSNLASPMELKSPVALVSPIPSAICMAFT

SEQ ID NO: 180808 - protein, 310 aa, Glycine max
  Coding DNA Sequence Number=SeqID_89123
  Gene Ontology: Mol. function=molecular_function; Cellular component =cellular_component; Biological process=multicellular organismal development
  Homolog annotation: Hit_ID=A7PEA8; Match level="QueryCoverage=99%, HitCoverage=96%, E-value=1e-146, Identity=75%"; Hit description =Chromosome chr11 scaffold_13, whole genome shotgun sequence
  Pfam annotation: Domain name=Abhydrolase_1; Domain location=40-261; Score=1.7; E_value=0.0038; Accession=PF00561.11; Description =alphabeta hydrolase fold
  Pfam annotation: Domain name=Ndr; Domain location=3-270; Score=420.0; E_value=3.5e-123; Accession=PF03096.5; Description=Ndr family
  Pfam module annotation: Pfam domain module=Abhydrolase_1::Ndr; Domain location=40-261::3-270
MAESVSVDMEMIFLGGKADMSCFQGLFFCPEATSLLLHNFCIYHISPPGHELGAAAICSDDPVPSAEDLADQIIEVLNYFRLGAVMCMGVSSGAYILSLFATKYRERVLGLILVSPLCKSPSWTEWFYNKVMSNLLYFYGVCGLLKECLLQRYFSKEVRGNAEFPESEIVQACRKLLDERKGINVFRFLQAINERPDITEGLKRLKCRTLIFVGDSSPFHSEALHMTSKLDRRYTALVEVQGCGSMVTEEQPHAMLVPMEYFLMGYGLYRPCHFSDSPRSPLSPSCISPELLSPESMGLKLKPIKTRVLL

SEQ ID NO: 180809 - protein, 446 aa, Glycine max
  Coding DNA Sequence Number=SeqID_89124
  Gene Ontology: Mol. function=transferase activity, transferring nitrogenous groups; Cellular component=cytoplasm; Biological process= biosynthetic process
  Homolog annotation: Hit_ID=Q9SEJ6; Match level="QueryCoverage=98%, HitCoverage=97%, E-value=0.0, Identity=85%"; Hit description=1 -aminocyclopropane-1-carboxylate synthase 5
  Pfam annotation: Domain name=Aminotran_1_2; Domain location=48-434; Score=416.4; E_value=4.2e-122; Accession=PF00155.12; Description =Aminotransferase class I and II
  Pfam annotation: Domain name=Beta_elim_lyase; Domain location=97-351; Score=-128.9; E_value=0.06; Accession=PF01212.12; Description=Beta -eliminating lyase
  Pfam module annotation: Pfam domain module=Aminotran_1_2::Beta_elim _lyase; Domain location=48-434::97-351
MGIEMEQPCVELSKVAVSETHGEDSPYFAGWKAYDENPYDELTNPSGVIQMGLAENQVSFDLLEKYLEEHSEASTWGKGAPGFRENALFQDYHGLKTFRTAMASFMEQVRGGRAKFDPQRLVLTAGATAANELLTFILANPGDALLVPTPYYPGFDRDLRWRTGVNIVPIHCDSSNNFQITPEALEAAYKDAEAMNSKVRGVLITNPSNPLGVTIPRSVLEEILDFVTRKNIHLVSDEIYSGSVFSSSEFTSVAEILEARQYKDAERVHIVYSLSKDLGLPGFRVGTIYSYNDKVVTTARRMSSFTLISSQTQHLLASMLSDKKFTENYIRTNRERLRKRYQMIIEGLRSAGIECLKGNAGLFCWMNLSPLLGNYKAKGSRELGGELELWNAILHELKLNISPGSSCHCSEPGWFRVCFANMSEQTLEIALQRIRDFMERIRTESV

SEQ ID NO: 180810 - protein, 518 aa, Glycine max
  Coding DNA Sequence Number=SeqID_89125
  Homolog annotation: Hit_ID=A7PEB1; Match level="QueryCoverage=93%, HitCoverage=90%, E-value=1e-100, Identity=44%"; Hit description =Chromosome chr11 scaffold_13, whole genome shotgun sequence
MEITGLFPLVGENYSLKLKRSMQDLLAEIPKESPNFTPFVDAFYELMQAKVDPPFEVTWVYAAINFRGRNSEKKGDALDRILAAKDLFQLLSACSASVRASKSIALMAPVVFAVNGVIQELFGRELRLKREKKAMREVKSLVDVVLGYISICCDNNKVYEEEPDSVNLIFPFTDLARVWVDMNDDEGFKSLLPLVSGDVCGWIRSRDFHGGYLGGAVIMEAFFMKLCLSFHLATSKDELEMNLKSWAVGSISSFQNIYFLEILMRTILETALPLISILKPEGEILSRKILFDAVLLVDYPFLYLNAKYIKNLILTRLIVTLKAVEYFRGLGDQNRAISYIKAFSASRLPLQIIKWVTSQNGLEEKTGRANGSSPRALINWLLSLENRGIRVFEDDILKSHATSGHDISQSEHPAGNLEGKVADDDLFYVDNIGEEGNTGDNDKQNKLVSDAFVAAAQTMKLSDDGARKRKGKHSEKKIKFVKYDLHQNSEPVKARTSAADDSSSGESEVEDPVSDTDA

SEQ ID NO: 180811 - protein, 706 aa, Glycine max
  Coding DNA Sequence Number=SeqID_89126
  Gene Ontology: Mol. function=hydrolase activity; Cellular component =mitochondrial inner membrane; Biological process=protein amino acid phosphorylation
  Homolog annotation: Hit_ID=A7PS78; Match level="QueryCoverage=84%, HitCoverage=98%, E-value=0.0, Identity=64%"; Hit description =Chromosome chr14 scaffold_27, whole genome shotgun sequence
  Pfam annotation: Domain name=PPR; Domain location=197-231; Score =23.1; E_value=0.001; Accession=PF01535.11; Description=PPR repeat
  Pfam annotation: Domain name=PPR; Domain location=299-333; Score =26.6; E_value=8.9e-05; Accession=PF01535.11; Description=PPR repeat
  Pfam annotation: Domain name=PPR; Domain location=400-434; Score =45.8; E_value=1.5e-10; Accession=PF01535.11; Description=PPR repeat
  Pfam annotation: Domain name=PPR; Domain location=435-469; Score=6.9; E_value=1.2; Accession=PF01535.11; Description=PPR repeat
  Pfam annotation: Domain name=PPR; Domain location=537-571; Score=7.0; E_value=1.1; Accession=PF01535.11; Description=PPR repeat
  Pfam annotation: Domain name=PPR; Domain location=90-124; Score=3.9; E_value=2.7; Accession=PF01535.11; Description=PPR repeat
  Pfam module annotation: Pfam domain module=PPR::PPR::PPR::PPR::PPR::PP R; Domain location=197-231::299-333::400-434::435-469::537-571::90-124
  Subcellular localization annotation: CTP_CleavageSite=74; ConfidenceScore=5.43e-01
MCYLGIKSRSFPQATYSIFFFLFFRVRHLHWSLQTNLKKLTLPLRFLSFLTVSVSIMLPAISLPTNITVKTNITATSTPRTTNTHKHKTTPFNSTLKSLCKWGNLDKALRLIESSKPTPIEEEEEEESISLFLHACISRRSLEHGRKLHLHLLRSQNRVLENPTLKTKLITLYSVCGRVNEARRVFQIDDEKPPEEPVWVAMAIGYSRNGFSHEALLLYRDMLSCCVKPGNFAFSMALKACSDLDNALVGRAIHAQIVKHDVGEADQVVNNALLGLYVEIGCFDEVLKVFEEMPQRNVVSWNTLIAGFAGQGRVFETLSAFRVMQREGMGFSWITLTTMLPVCAQVTALHSGKEIHGQILKSRKNADVPLLNSLMDMYAKCGEIGYCEKVFDRMHSKDLTSWNTMLAGFSINGQIHEALCLFDEMIRYGIEPNGITFVALLSGCSHSGLTSEGKRLFSNVMQDFGVQPSLEHYACLVDILGRSGKFDEALSVAENIPMRPSGSIWGSLLNSCRLYGNVALAEVVAERLFEIEPNNPGNYVMLSNIYANAGMWEDVKRVREMMALTGMKKDAGCSWIQIKHKIHTFVAGGSSDFRCSAEYKKIWNELSNAVKNLGYVPNTGVVLHDINEEMKAVWVCEHSERLAAVFALINTGAGMPIRITKNLRVCVDCHSWMKAVSKVTRRLIVLRDTNRFHHFENGSCSCKDYW

SEQ ID NO: 180812 - protein, 858 aa, Glycine max
  Coding DNA Sequence Number=SeqID_89127
  Gene Ontology: Mol. function=nuclease activity; Cellular component =intracellular; Biological process=DNA repair
  Homolog annotation: Hit_ID=A7PEA5; Match level="QueryCoverage=52%, HitCoverage=96%, E-value=1e-132, Identity=54%"; Hit description =Chromosome chr11 scaffold_13, whole genome shotgun sequence
  Pfam annotation: Domain name=PPR; Domain location=513-547; Score=2.8; E_value=3.6; Accession=PF01535.11; Description=PPR repeat
  Pfam annotation: Domain name=PPR; Domain location=579-613; Score =26.3; E_value=0.00011; Accession=PF01535.11; Description=PPR repeat
  Pfam annotation: Domain name=PPR; Domain location=614-648; Score =18.2; E_value=0.031; Accession=PF01535.11; Description=PPR repeat
  Pfam module annotation: Pfam domain module=PPR::PPR::PPR; Domain location=513-547::579-613::614-648
MALGMSRFKREQCNRTKHDSSFSHWKILIGPRDWEDHSKGKEGCSRYRIHNLPQQSGPGVYELGIAAAASVSERKIYKLVPHRHRIVVVYLGQTENVRERLRRYGGNGDHLEDSSLHLFQQVFSQGFSILYRWAPMQNKEDALRTETELLSTFDYAWNTRSNCVRRPDDILQKLHQIASGTRTLSDIARALLPFTQKQVGIQIKSIKLDEADNGSSYNNLLSRLFSFNRSRPRLVQDITGAIQEQENGKICGVALGDGSICTRPPAEKRMRCPEHKGMRTNVSTAKAIIGAPMSESHDLEDPPQTVVDESLTNTDYICGILLSDGSTCTRQPVKGRKRCHEHKGRRIRAASIQTKDNGYKYQNNVSNDVEDPPQTLVDESITNTNICGIILNDGSTCTRHPVKGRKRAESMELKLRASMASIPRAVFTNSSSFVPFCTYTVPDASRRRNGNTGSRSTHKITPLRKEKHPNEQKLKLDHQNQNPLNVDLVALCEEGNLDQVLELMGQGAVADYRVYLALLNLCEHTRSLESGKRVHEILRRSAFRGDVELSNRLIGMYCKCGSVKNARRVFDQMLDRNMATWHLMIGGYTSNGLGCDGLLVFQQMKQAELPPDGETFELVLAACSQAEAVEEGFLHFESMKEYGIVPSMEHYLEVINIMGNAGQLKEAEEFIENVPIELGVEAWESLRKFARIHGDLDLEDCAEELLTRFDPSKAIADKLPTPPRKKQSDVNMLEEKNRATEYRYSIPYKEEDNEKLGGLSGQMREAGYVPDTRYVLHDIDEEEKEKALQYHSERLAIAYGLISTPPRTTLRIIKNLRICGDCHNAIKIMSKIVGRELIVRDNKRFHHFKDGKCSCGDY

SEQ ID NO: 180813 - protein, 307 aa, Glycine max
  Coding DNA Sequence Number=SeqID_89128
  Gene Ontology: Mol. function=acyl-[acyl-carrier-protein]-UDP-N -acetylglucosamine O-acyltransferase activity; Cellular component =cytoplasm; Biological process=lipid biosynthetic process
  Homolog annotation: Hit_ID=A7PEA1; Match level="QueryCoverage=97%, HitCoverage=90%, E-value=1e-128, Identity=74%"; Hit description =Chromosome chr11 scaffold_13, whole genome shotgun sequence
  Pfam annotation: Domain name=Hexapep; Domain location=112-129; Score =2.1; E_value=81; Accession=PF00132.15; Description=Bacterial transferase hexapeptide (three rep
  Pfam annotation: Domain name=Hexapep; Domain location=136-153; Score =10.5; E_value=6.4; Accession=PF00132.15; Description=Bacterial transferase hexapeptide (three rep
  Pfam annotation: Domain name=Hexapep; Domain location=154-171; Score =7.9; E_value=17; Accession=PF00132.15; Description=Bacterial transferase hexapeptide (three rep
  Pfam annotation: Domain name=Hexapep; Domain location=17-34; Score =17.2; E_value=0.063; Accession=PF00132.15; Description=Bacterial transferase hexapeptide (three rep
  Pfam annotation: Domain name=Hexapep; Domain location=172-189; Score =0.0; E_value=1.5e+02; Accession=PF00132.15; Description=Bacterial transferase hexapeptide (three rep
  Pfam annotation: Domain name=Hexapep; Domain location=190-207; Score =2.8; E_value=67; Accession=PF00132.15; Description=Bacterial transferase hexapeptide (three rep
  Pfam annotation: Domain name=Hexapep; Domain location=41-58; Score =11.7; E_value=2.8; Accession=PF00132.15; Description=Bacterial transferase hexapeptide (three rep
  Pfam annotation: Domain name=Hexapep; Domain location=59-76; Score =14.8; E_value=0.32; Accession=PF00132.15; Description=Bacterial transferase hexapeptide (three rep
  Pfam annotation: Domain name=Hexapep; Domain location=81-98; Score =10.1; E_value=8.4; Accession=PF00132.15; Description=Bacterial transferase hexapeptide (three rep
  Pfam module annotation: Pfam domain module=Hexapep::Hexapep::Hexapep:: Hexapep::Hexapep::Hexapep::Hexapep::Hexapep::Hexapep; Domain location= 112-129::136-153::154-171::17-34::172-189::190-207::41-58::59-76::81 -98
MADVADGERFDSCIHPTAVVHPNAVIGQGVSIGPFCSVSSSAKLGNGCQLHPGSHVFGSTELGDNCMLMTGAVVGDDYPGCTVIGSNNTIGYHAVIGVKCQDMKYKPEDECYLEVGHNNDIREHTSIHRSSKSTDRTVIGNANFIMGSCHIAHDCKIGNNNIFANNTLLAGHVEVEDYVHTAGATVVHQFCHLGSFSFLGGGSVVSQDVPKYMMVAGERAELRGLNVVGLTRCGFSIAEIKSMRTAYRKIFMCVDANAGSLEERLAEVEQHEELVHVPAVRAMLQSIRNSFAENRRGICRFRQWNAS

SEQ ID NO: 180814 - protein, 133 aa, Glycine max
  Coding DNA Sequence Number=SeqID_89129
MSQTSGYLVPTSGRRSGEDMVPEPGGEANEHGLLEASSRDMIGSIGSSDDEREDKKEKEKRNEDGHAAKVKGQEPLLVPVSTHKACKRDEEYEEAKYEDVPAEVVDALVVWAMKFNTALMLLPTPIGSDVLLA

SEQ ID NO: 180815 - protein, 335 aa, Glycine max
  Coding DNA Sequence Number=SeqID_89130
  Gene Ontology: Mol. function=ribonuclease H activity; Biological process=defense response
  Homolog annotation: Hit_ID=Q2HRG4; Match level="QueryCoverage=41%, HitCoverage=13%, E-value=2e-12, Identity=30%"; Hit description =Ribonuclease H
MVINNKEITTNRSSISNLKITKGVSRRKYKYSHAIIITTNMIKEMGCPSKLRKSTSSMIITISLHGLVVPRPSSMRSLACETKTEFEFDEASSEIVPYVAASFLDRPFKYRVGNDEISVFYDNWLGDGPICDCMDYVHISDTQLLIRDVLVNGQWSWGKFYSIIPDEEFSLPNLPMSSGFMSLPIIVIFQGTGTGCGLEDESIIHLLRDCSEAREIWSHINMYADTDFFAMNGDTWFVWSAWYTLALLQGSTKVNNTPSHRLVAWTPPVADFVKGNPRMSGIGGILRDSNGKWLTGFSSCGGITTNMTAELLAILHGLRVAWNSGFKRVICETDL

SEQ ID NO: 180816 - protein, 91 aa, Glycine max
  Coding DNA Sequence Number=SeqID_89131
  Homolog annotation: Hit_ID=A7QPG4; Match level="QueryCoverage=72%, HitCoverage=72%, E-value=1e-18, Identity=69%"; Hit description =Chromosome chr18 scaffold_137, whole genome shotgun sequence
MVAWWEQKVKGNKGDVEKAEMVMTDEGIEKVEVDCNSQQVVVTRYAHKNKILKAMRKSGLKADFLYAQNDLLNAYVSASYANLRFNNFSIF

SEQ ID NO: 180817 - protein, 1581 aa, Glycine max
  Coding DNA Sequence Number=SeqID_89132
  Gene Ontology: Mol. function=protein kinase activity; Cellular component=cellular_component; Biological process=protein amino acid phosphorylation
  Homolog annotation: Hit_ID=Q9M0E5; Match level="QueryCoverage=96%, HitCoverage=99%, E-value=0.0, Identity=65%"; Hit description =Putative uncharacterized protein AT4g29380
  Pfam annotation: Domain name=HEAT; Domain location=520-556; Score =29.7; E_value=1.1e-05; Accession=PF02985.13; Description=HEAT repeat
  Pfam annotation: Domain name=HEAT; Domain location=565-601; Score =11.0; E_value=0.61; Accession=PF02985.13; Description=HEAT repeat
  Pfam annotation: Domain name=HEAT; Domain location=688-724; Score =6.2; E_value=3.2; Accession=PF02985.13; Description=HEAT repeat
  Pfam annotation: Domain name=HEAT; Domain location=727-763; Score =17.3; E_value=0.057; Accession=PF02985.13; Description=HEAT repeat
  Pfam annotation: Domain name=HEAT; Domain location=768-803; Score =6.4; E_value=3; Accession=PF02985.13; Description=HEAT repeat
  Pfam annotation: Domain name=Pkinase; Domain location=27-293; Score =13.9; E_value=1.8e-09; Accession=PF00069.16; Description=Protein kinase domain
  Pfam annotation: Domain name=Pkinase_Tyr; Domain location=27-291; Score=-111.0; E_value=1.3e-05; Accession=PF07714.8; Description =Protein tyrosine kinase
  Pfam annotation: Domain name=WD40; Domain location=1111-1149; Score =45.1; E_value=2.5e-10; Accession=PF00400.23; Description=WD domain, G-beta repeat
  Pfam annotation: Domain name=WD40; Domain location=1159-1197; Score =7.2; E_value=4.1; Accession=PF00400.23; Description=WD domain, G -beta repeat
  Pfam annotation: Domain name=WD40; Domain location=1262-1298; Score =6.1; E_value=5.6; Accession=PF00400.23; Description=WD domain, G -beta repeat
  Pfam annotation: Domain name=WD40; Domain location=1494-1533; Score =7.9; E_value=3.4; Accession=PF00400.23; Description=WD domain, G -beta repeat
  Pfam module annotation: Pfam domain module=HEAT::HEAT::HEAT::HEAT::HEA T::Pkinase::Pkinase_Tyr::WD40::WD40::WD40::WD40; Domain location=520 -556::565-601::688-724::727-763::768-803::27-293::27-291::1111 -1149::1159-1197::1262-1298::1494-1533
MGNKIARTTQVSASEYYLHELPSTYNLVLKEVLGRGRFFKSIQCKHDEGLVLVKVYFKRGDFLDLSDYERRLSQIKHIFTSIDHPHVWPFQFWQETDKAAYLLRQYFFHNLHDRLSTRPFLSLIEKKWLAFQLLVAVKQCHENGVCHGDIKCENVLITSTNWVYLADFASFKPTYIPYDDPSDFSFFFDTGGRRLCYLAPERFYEHGGEMQVAQDTPLKPYMDIFAVGCVIAELFLEGQPLFELSQLLAYRRGQYDPSQHLEKIPDLGIRKMILHMIQLEPEFRLSAERYLKEYAAVVFPIYFSPFLHDFYRCWSPLHSDMRVLLCQSAFPEILKQMMNNKSSDDAGVNSAELLEEMVAKESASFMKDSLMKREDIGKGLVHDHYELLGDINSLLRDAKKNNNPSHVAENAHNSTFPENLKNLQTGKLLQTISNAFRGNDHPFLKSITMNDLNSLMSEYDSQSDTFGMPFLPLPKDSMRCEGMVLITSLLCSCIRNVKLPHLRRAAVLLLKASALYIDDEDRLQRVIPYVIVMLSDSAAIVRCAALETLCDILPLVRDFPPSDAKIFPEYILPMLSMLPDDPEESVRICYASNIAKLALTAYGFLIRSISLSEAGVLDELSLPQKPLTSSTQTSGRMKRINGDAQLLQLRKSIAEVVQELVMGPKQTPNIRRALLQDIGKLCCFFGVRQSNDSLLPILPAFLNDRDEQLRTVFYEKIVYVCFFVGQRSVEEYLLPYIEQALSDVTEAVIVKAVECMTILCKSGFFRKRILLQMIERAFPLLCYPSEWVRRSVVSFIAASSENLGAVDSYVFLAPVIRPFLRTQPVSLASEKALLSCLKPPVSRQVFYEVLENSRSSDMLERQRKIWYSSSQSKLWEMDLLKKGIDELDSLKNWTDKQQGPGVQQTVGTAFQQPGITDCDKAEAKLRDMGAFMHNDSNTVGHRDTQCSEKLQFSGFMSPHFSGMNSLTYEKPSEGIPLYSFSVDRRGMGIPSAASDPPLPMNSLGVSSSAMPWVNPLSKSFNLANSVPAPKLFSGSYSISNGSKQFHRVVHEPDARENETAYVNNTFQDVGLSANIKGTSIALEDATAQTDLSGFPSFARASIPDSGWRPRGVLVAHLQEHRSAVNDIAISADHSFFVSASDDSTVKIWDSRKLEKDISFRSKLTYHMEGSRVLCATMLPGSAQVIIGASDGFIHMFSVDHISRGLGNVVEKYSGIADITKKDIKEGAILNLLNCPVDNYTIMYSTQNCGIHLWDTRSNSNTWTLQATPKEGYASSLASGPCGNWFVSGSSRGVITLWDLRFLIPVNSWQYSLACPIEKMCLFLPPSNASVSSAARPLVYVAAGCNEISLWNAENASCHQVLRMTNYDSDAEMSDLPWALARPSSKPTSQSDLRRNGNRKYGVDELNEPPPRLPGIRSLLPLPGGDLLTGGTDLKIRRWDHYSPDRSYCICGPNLKGIGNDDFYETKSSFGVQVVQETKRRPLTIKLTAKAILAAAATDSAGCHRDSIVSLASIKLNQRLLLSSGRDGAIKVLTHQVVIRAPSLFLSDTFPFLCTPDLYQQEKVAILIFLDRPQFYLKVSIV

SEQ ID NO: 180818 - protein, 32 aa, Glycine max
  Coding DNA Sequence Number=SeqID_89133
MDYYRGWCTGKAECVEGQGGDKYVVPIPIPTQ

SEQ ID NO: 180819 - protein, 439 aa, Glycine max
  Coding DNA Sequence Number=SeqID_89134
  Gene Ontology: Mol. function=protein serine/threonine kinase activity; Cellular component=ubiquitin ligase complex; Biological process=protein amino acid phosphorylation
  Homolog annotation: Hit_ID=A7P526; Match level="QueryCoverage=82%, HitCoverage=46%, E-value=9e-66, Identity=42%"; Hit description =Chromosome chr4 scaffold_6, whole genome shotgun sequence
  Pfam annotation: Domain name=Usp; Domain location=13-152; Score=45.7; E_value=1.6e-10; Accession=PF00582.17; Description=Universal stress protein family
MSRMNSEKKLGAGRVVAVAIENNKTSQHAAKWAVDNLLPKDQCLLLIHVRQRASSAPSSDHLSEAVADKESKELFESFRVFCNRKSIQCKEVLLEDMDISKALIDAISTNTIELLVLGAPSRSGLVRRFRTTDVPSTVSKGAPQFCTVYIISKGKISSVRSATAPLALKKAAIAAASPRNQLQPQQQQPHPQTMPSPERFSDPQLPRNYPPRPTSERAAPHGSHGARPTMMDEDDIISPFTRAGKTYESSKLLDSDISFVSSGRPSVDRMFPTMYEDMDSAMSGIAPGRFSDYDGRSSFASSYSSQSQGMDDCYSFSSQSRLSDCSTDDVEFEMRRLKLELKQTMEMYSSACKEAMTAKQKAMELKRLKVEEQKKLEESSSLSSGGEAAAAASSMALMMEMEKEKIREEALRIRNHGHSCFLCEIVIRSQFHTTYEPEA

SEQ ID NO: 180820 - protein, 155 aa, Glycine max
  Coding DNA Sequence Number=SeqID_89135
  Gene Ontology: Mol. function=guanyl-nucleotide exchange factor activity
  Homolog annotation: Hit_ID=Q93ZY2; Match level="QueryCoverage=24%, HitCoverage=6%, E-value=1e-09, Identity=84%"; Hit description=Rop guanine nucleotide exchange factor 1
MRLSEYVEVMQLGVIHPPPINFDLCEGEHFNDSCHLYSMKNSWWEKELHPYNQYEEEKLSNLENVKANEESLVEEHDSRERDEEKGEEGTQQQWKKCSQVEIQQEKQFHFVEVEMMKERFAKLLLEEEMPGGGKRVCTALAISNAITKLLLDFGV

SEQ ID NO: 180821 - protein, 268 aa, Glycine max
  Coding DNA Sequence Number=SeqID_89136
  Gene Ontology: Mol. function=metal ion binding
  Homolog annotation: Hit_ID=A9NUP8; Match level="QueryCoverage=31%, HitCoverage=22%, E-value=2e-09, Identity=41%"; Hit description =Putative uncharacterized protein
MPNQIHMKCINIILHFHDSAYPKRKLDKRYLMLVDHHCSLYVVNATLAIIEMQFFNLIVAIDHQKGNRSLPYVESVHHPYEEFISIARKASYAFNEDNWFSCFGFRDGPWDMKTFDDIIPSWPFDNLKFLKFVEIMNIVVFVQELQFCFVPHGRVLFGKAIAGILGSLYNSLEDTIVQTYRIMNDKGVITKNEAFMTEVLAMHGASADGAFDRDEPRGHGSTIPSSAFPFAERCKLACNREAPVVVAILEAPLVPATCMKTSMVMAFE

SEQ ID NO: 180822 - protein, 115 aa, Glycine max
  Coding DNA Sequence Number=SeqID_89137
  Homolog annotation: Hit_ID=A7PNM1; Match level="QueryCoverage=40%, HitCoverage=11%, E-value=1e-10, Identity=63%"; Hit description =Chromosome chr8 scaffold_23, whole genome shotgun sequence
  Subcellular localization annotation: CTP_CleavageSite=22; ConfidenceScore=5.33e-01
MPSSSSSSSSSSALTVPNLHLRALRIWSSKYYAIAAFIFLVLFSLLLFSHLDSRSRYSNLIPLTLLRNANQTLALCLDGSAPGYHFRSRFGSGSRNWLIHIGVSGSLVVKNEFGF

SEQ ID NO: 180823 - protein, 149 aa, Glycine max
  Coding DNA Sequence Number=SeqID_89138
  Gene Ontology: Mol. function=DNA binding; Cellular component=nucleus; Biological process=regulation of transcription
  Homolog annotation: Hit_ID=Q0PJD3; Match level="QueryCoverage=34%, HitCoverage=23%, E-value=3e-10, Identity=64%"; Hit description=MYB transcription factor MYB65
VGYFRKNTSSGNFPENVLPELPEEPLRGLPEDSSVSDFRHFFRRPLVFSPLVFYPRFRLYPKATYLESKWVQGLSEKLAEKKLVGEERREEAFCERDTDMAEVVKSEECCQENKQSTAASCSSVSEGSGSAIHKSPGRCSPASTSPSHR

SEQ ID NO: 180824 - protein, 110 aa, Glycine max
  Coding DNA Sequence Number=SeqID_89139
  Gene Ontology: Mol. function=nucleic acid binding; Cellular component= nucleus; Biological process=regulation of transcription, DNA-dependent
  Homolog annotation: Hit_ID=Q9M2L7; Match level="QueryCoverage=90%, HitCoverage=6%, E-value=8e-29, Identity=70%"; Hit description =Helicase-like protein
MLTSAFDTECLSLRQAGEIDPLPPNVVGASNIDLQTPSTMLVASTVQTPELFKGVLKEYKPKGLQWLAFGIFQGLNVILADKMGLGKTIQAMAFLAHLAEVAIQPHVLGK

SEQ ID NO: 180825 - protein, 154 aa, Glycine max
  Coding DNA Sequence Number=SeqID_89140
  Gene Ontology: Mol. function=nucleic acid binding
  Homolog annotation: Hit_ID=A7PWK4; Match level="QueryCoverage=78%, HitCoverage=9%, E-value=3e-24, Identity=47%"; Hit description =Chromosome chr8 scaffold_34, whole genome shotgun sequence
MKKIQGLQAPHGATSETKFLMLSLLLNFPLMKFQLPKQDDGFDYYRNSSQDESRDNQGGGITNHSNGNVHEKEVNLFKKRRWSLNSDNKEKSSFYGAHMMEEQYRSMLGEHIQKYKRRFMGALSSPVQNQVIAPLVKSNIVEEDYMWQRVHQNG

SEQ ID NO: 180826 - protein, 54 aa, Glycine max
  Coding DNA Sequence Number=SeqID_89141
MAPPKEIATVIYYNGHIADNPVQGSVVRHVIFKHNYSTMTISEARWKQFSRIHN

SEQ ID NO: 180827 - protein, 132 aa, Glycine max
  Coding DNA Sequence Number=SeqID_89142
MLVPTISYEEISTLVCGGCGHNDSWRRKDRRRGHDDEGGVEGYTYMKKMYWRHLGDIRANKPSATRWLDHVPKNCWVQCFDEGKRWGHMTTNLSESVNSMLKNTNICQCHPWLRRRTSRLHNSLLVEAKLKQ

SEQ ID NO: 180828 - protein, 93 aa, Glycine max
  Coding DNA Sequence Number=SeqID_89143
  Gene Ontology: Biological process=double fertilization forming a zygote and endosperm
  Homolog annotation: Hit_ID=A9PH21; Match level="QueryCoverage=49%, HitCoverage=9%, E-value=3e-16, Identity=86%"; Hit description =Putative uncharacterized protein
  Subcellular localization annotation: CTP_CleavageSite=34; ConfidenceScore=5.46e-01
MAPKDPKQVADAASSGGGGGFFASIASSLSNFGSAMSKSVNGLVGYEGLEVVNPDGGTEDAEEEARKGRWKQEDERIIRVEESLSCEEAIPLY

SEQ ID NO: 180829 - protein, 224 aa, Glycine max
  Coding DNA Sequence Number=SeqID_89144
  Gene Ontology: Mol. function=catalytic activity; Cellular component =chloroplast; Biological process=cellular metabolic process
  Homolog annotation: Hit_ID=A7PNN9; Match level="QueryCoverage=71%, HitCoverage=63%, E-value=1e-77, Identity=88%"; Hit description =Chromosome chr8 scaffold_23, whole genome shotgun sequence
MQCGKDVYSNCTRQIVYKKLRERPNQYVARGLVRTDESKQNIGAADDVIVGDIRDAESIVPAIQGIDALIILTSAVPQIKPGFDPTKGQRPEFYFEDGAYPEQVDWIGQKNQIDVAKAAGVKHIVLVGSMGGTDLNHPLNSLGNGNILVWKRKAEQYLADSGIPYTIIRYGTKVKFGRTRKQHDSMTLRNPCKIYRVKIGNSICKISPRHLFILEVVQAPSPKN

SEQ ID NO: 180830 - protein, 146 aa, Glycine max
  Coding DNA Sequence Number=SeqID_89145
MATHGALGGDNDGAGVAELVRYGGVGEEGEVDATEGGEEGRGDTVVGDVEGALLAAGVYEGISIEVEGESKSEIGKVELTAHSGDVVTGRTYCHQSGVSGGEVSHVRKTRVRSFQQAGKVEVRREDGARFFAVCCSFDVSSCGEGT

SEQ ID NO: 180831 - protein, 64 aa, Glycine max
  Coding DNA Sequence Number=SeqID_89146
MNVTTFNSEVVTSVRTYLKMGNNLKSTPSCLTHVEEGPTWIGDYVCGVVWEVCGACECGSDGAT

SEQ ID NO: 180832 - protein, 25 aa, Glycine max
  Coding DNA Sequence Number=SeqID_89147
MPTARPTIIRKGYASAHLNEGNKSN

SEQ ID NO: 180833 - protein, 152 aa, Glycine max
  Coding DNA Sequence Number=SeqID_89148
LQKTVTAWVVWVWVFDVVLVVLGRVSEWVTVFAVLVVHGGCVGSADGWAWPMVVFGGCVGSADGWARPMVVVQWLCWLGRWLGSADGGGSRRRKGAEWWLVVALGCSGVLTVHHSRMSGVNMMAIWKLYHDRVDTFVGMEIAQGTSYMICSS

SEQ ID NO: 180834 - protein, 68 aa, Glycine max
  Coding DNA Sequence Number=SeqID_89149
MVNETRIVVLSRQLWVFTGKKKATMQKGIFLSSNMISKFPTEKERVLKKEERKNEIEKQRKLRSQSEN

SEQ ID NO: 180835 - protein, 109 aa, Glycine max
  Coding DNA Sequence Number=SeqID_89150
  Gene Ontology: Mol. function=transferase activity; Cellular component= nuclear pore; Biological process=transport
  Homolog annotation: Hit_ID=Q2HVW5; Match level="QueryCoverage=85%, HitCoverage=10%, E-value=1e-20, Identity=58%"; Hit description =Nucleoporin interacting component; Protein prenyltransferase
  Subcellular localization annotation: CTP_CleavageSite=67; ConfidenceScore=5.18e-01
MIGFVSYFYFCNRPWLRTNIVGNNNVGTLLGQIASMSSTSSVSFGISSMEIVPLTGIPIVEKKTSVDAEIVKNLNKARESGLPFKLAAVVKDAYENLGINASGGKSVKM

SEQ ID NO: 180836 - protein, 191 aa, Glycine max
  Coding DNA Sequence Number=SeqID_89151
  Gene Ontology: Mol. function=catalytic activity; Biological process =metabolic process
  Homolog annotation: Hit_ID=A2Q5Z6; Match level="QueryCoverage=41%, HitCoverage=24%, E-value=3e-11, Identity=41%"; Hit description =Phosphoglycerate/bisphosphoglycerate mutase
MAQGMTPVLRAGEHLRRVMNSDNCSPDWRVQLYVSPYVHTRLMFHKLRRRFLKKRIIGVREESQVRELDFGNFMIKPILNIIVYVGTTFQTLHNINPWYWLCITVQQEPIAVIRSLQISLRDRIEGRVEAMERGSRRLMNSFKGLKTCKLSNWEIGIQGDSELSWERGGGGGGRGDDQFRSPTISQAQCKC

SEQ ID NO: 180837 - protein, 103 aa, Glycine max
  Coding DNA Sequence Number=SeqID_89152
MKVEGIGSVRIKLHDGAIRTFSNMKGDDITRVQICWFKVGMQSVQRKTLGVAREKNKGNICYFDGQVLKRNHDSKVKKKVKFSNVVKVLGDTSIREGVCSLSN

SEQ ID NO: 180838 - protein, 87 aa, Glycine max
  Coding DNA Sequence Number=SeqID_89153
NLQDSGTLKRVAWGLDVGTRRLLDQAAGKDSLQKAAPRAVHEHLALRRMDCYWCIIVHALANGCGAPGISLPKYPELTSHPSFVMGD

SEQ ID NO: 180839 - protein, 58 aa, Glycine max
  Coding DNA Sequence Number=SeqID_89154
MRVAVTMMDIPGEENRMVNTCTWGHATRFGILLKLRLMTIGGEELPVHDKVISTLAAC

SEQ ID NO: 180840 - protein, 450 aa, Glycine max
  Coding DNA Sequence Number=SeqID_89155
  Homolog annotation: Hit_ID=Q9M343; Match level="QueryCoverage=80%, HitCoverage=66%, E-value=3e-87, Identity=47%"; Hit description =Putative uncharacterized protein F5K20_130
MPSNDAIRECDPDRATCSNLHVIVRRGARYNPVIDTLSSNFKPLIGVFLAMTETEALEDAKEVVVLEEEECAEKMVYMWGYLPGASPEKSPILSPAPVNLSDRSLAGDSWKDVCGGGCGFAMAISEKGKLITWGSADDEGQSYLISGKHGEIPGLYQLPTEASVVKAAAGWAHCASVNGNASCSFLIQWLCEDDAVVSPGAAVKLCLGDLLVMEEGEVYAWGWKECVPSGKVITDFITVGSFQKDVAGKQSSSIPEQGSPQSSNTSSGSDSHHDNKKVGDEVLKRRKITFSRQDSDSQASGDEFFTVSPSLVTLASGVKITSVAVGGRHTLALSGSMKYEDKDDVGQVWGWGYGGEGQLGLGSRVKMVSSPHLIPCIESSGKDKSSAFHQGSGAGAQGSNVTGSYVMDIACGGRHSVVITDAGALLTFGWGLYGQDKIELAHVENSHILL

SEQ ID NO: 180841 - protein, 181 aa, Glycine max
  Coding DNA Sequence Number=SeqID_89156
  Gene Ontology: Mol. function=aspartic-type endopeptidase activity; Biological process=RNA-dependent DNA replication
  Homolog annotation: Hit_ID=Q69F85; Match level="QueryCoverage=53%, HitCoverage=8%, E-value=5e-09, Identity=47%"; Hit description=Gag -pol polyprotein
  Subcellular localization annotation: CTP_CleavageSite=22; ConfidenceScore=5.07e-01
MVAEGNNFLVKRKNKQKPSQTSVNHITTTSSRRSISPITFTDVDFTGVDPEQDDPIVITVGIINWDVRKVLIDEGSSIGLLFLSTFQRTSLKALGVIVSMPHLTMKFPNPNGGILTVKADQMEARECYAKSLLIKPYILTSTKLAKVVDVNNVEGALPSWANFDPRRDEEDRRPTPIEELH

SEQ ID NO: 180842 - protein, 26 aa, Glycine max
  Coding DNA Sequence Number=SeqID_89157
MNKKVKWWLDRNIEMAINEATGLQMR

SEQ ID NO: 180843 - protein, 669 aa, Glycine max
  Coding DNA Sequence Number=SeqID_89158
  Gene Ontology: Mol. function=glutamate-5-semialdehyde dehydrogenase activity; Cellular component=cytoplasm; Biological process=amino acid biosynthetic process
  Homolog annotation: Hit_ID=Q9AYM4; Match level="QueryCoverage=96%, HitCoverage=83%, E-value=0.0, Identity=70%"; Hit description=VuP5CS protein
  Pfam annotation: Domain name=AA_kinase; Domain location=9-257; Score =152.1; E_value=1.5e-42; Accession=PF00696.19; Description=Amino acid kinase family
MTLSNQYPNTVVGTAVVTRSDGRLALGRLGALCEQLKELNNNDYEVILVTSGAVGLGRQRLRYRRLVNSSFSDLQNPQGDLDGKACAAVGQSSLMALYDLMFSQLDVTSSQLLVNDGFFRDTAFRKQLSDTVSSLLDLRVIPIFNENDAVSTRKAPYEGKNCLQDSSGIFWDNDSLAGLLALELKADLLVLLSDVEGLYSGPPSDPKSKLIHTYVKEKHQSEITFGEKSRLGRGGMTAKVNAAVCAAYAGTPVIITSGYATDNIIRVLRGERIGTVFHKDAHLWTSIKEVSAHEMAVAARNSSRRLQASKVLNSEERRKILLAMADALEINESVIRLENGADVADAEEMGYEKALISRLTLRPEKISSLVKSVRMLADMEEPIGQILKRTELADKLILEKISCPLGVLLVIFESRPDALVQIAALAIRSGNGLLLKGGKEAKRSNAILHKVITSIIPDTVGDKLIGLVTSREDIPDLLKANLVVPRGSNKLVSQIKGTTKIPVLGHADGICHVYVDKTANIDMAKKIIRDAKIDYPAACNAMETLLVHVDLSRNGGLDELVAELQREDHAVKLENMYNRDNMTAMMYLLPLTTYITMEGKFKFPYKIYVLILYIINIIILKIYFFLSCFCSAHTECIVAEDSEVAEAFLSQVDSVKFQEILMWQIGMVV

SEQ ID NO: 180844 - protein, 117 aa, Glycine max
  Coding DNA Sequence Number=SeqID_89159
MAWAIEKIWLASSCAITSNNVLILFEQRPQSWEKKITKLPKVLAVWHMILVGWDIIHERFDLCNQHLDGDAWVCFDNWLDDLCYDVFVKFPIILSEHWRKTSVMTSDILDNRFVMPI

SEQ ID NO: 180845 - protein, 135 aa, Glycine max
  Coding DNA Sequence Number=SeqID_89160
RALGKQVSGDAEEAPQCRRPTTSTCRQRATAIVAEDVNHVDHVADEVHEQPQELVTDHVGVDTKGFPDESHDTLVLTSYADHECTELKLASHGRKVEKFERSALKIEGIVTVIGLRSLIICSLEIRDRGLLSAFA

SEQ ID NO: 180846 - protein, 46 aa, Glycine max
  Coding DNA Sequence Number=SeqID_89161
MGVRRQATVACGGHRWSWVVENEISLSELVLLSGNPIFALSATIRA

SEQ ID NO: 180847 - protein, 45 aa, Glycine max
  Coding DNA Sequence Number=SeqID_89162
MTMSGLKEHSNRVTPKAYTPKSLLGPLPPDSGSTPKIIFASRHCL

SEQ ID NO: 180848 - protein, 111 aa, Glycine max
  Coding DNA Sequence Number=SeqID_89163
NVRHKGTNIEKKANMGCFCFRARKEGDDNKYKPNDIMTAGAAAAAAAAPTKTCDETHGTTTDHNHGTHDTTAHHHGSHDTTGHHLHHHTVGHDGGAHFSDGGAHFSDGGGF

SEQ ID NO: 180849 - protein, 52 aa, Glycine max
  Coding DNA Sequence Number=SeqID_89164
MDLDLELRTGRPTSTPEVSNEVKLEKLDHSNRMCIMIMKTRRPTSTPEASNE

SEQ ID NO: 180850 - protein, 147 aa, Glycine max
  Coding DNA Sequence Number=SeqID_89165
MEGVCFGHVTADSGFRHCCWRNRTRGRDFATPSGETGQKQDTWTKCPFETHNMSKYSKLKEESPGKFSKGIWSTDFSKNRNFIIPWGMVIQRRSKDTWGLLLARRGTTAMGSGARKGVCGMRLYECGGWRRSRHGRRRWHGRQNRHG

SEQ ID NO: 180851 - protein, 51 aa, Glycine max
  Coding DNA Sequence Number=SeqID_89166
MEHYLSWAQALASAWGFMLVVALMCCCLSTKPRQDSDIISGIEVSSFSPVV

SEQ ID NO: 180852 - protein, 102 aa, Glycine max
  Coding DNA Sequence Number=SeqID_89167
  Gene Ontology: Mol. function=oxidoreductase activity; Cellular component=cytosol; Biological process=auxin mediated signaling pathway
  Homolog annotation: Hit_ID=A7Q601; Match level="QueryCoverage=56%, HitCoverage=16%, E-value=9e-22, Identity=84%"; Hit description =Chromosome chr14 scaffold_54, whole genome shotgun sequence
MENGPVARVASNALVSATLISIIITVLTPLYPLKTLFLWIWQMGELKKLVQEGKIRYIGLWEASLDTIRRAHAVYPISAVQMEWSLWTREIEQDIVPLCRNN

SEQ ID NO: 180853 - protein, 226 aa, Glycine max
  Coding DNA Sequence Number=SeqID_89168
  Subcellular localization annotation: CTP_CleavageSite=50; ConfidenceScore=5.16e-01
MSYFIFQVFYFNKQTTWILDNTHNDTVMVNCLHNLINQFSKSSIFPTKVLSFLRRSLIRGRPLLQPQSYAAVSFLRRPLLQPQSLGNKTPHHTVSPNATKKRKSHKESYIKGTDTFPFGTVTSRNPIFFSRLQAEVTQRLTSAKESSSKPALQSHEDLAKKLQQTQVQKLLKQLADERFSEASNHSSNVNLADKSRKVKDNISSIPLIAFINERLKKVQNMILGSF

SEQ ID NO: 180854 - protein, 132 aa, Glycine max
  Coding DNA Sequence Number=SeqID_89169
  Subcellular localization annotation: CTP_CleavageSite=9; ConfidenceScore=5.18e-01
MTVSFLFVSQFGFSSGVPLVVRTKGFSPVDNFVLQFSFAEFDREKLRVWDYKFMARVADKIKLIDGSREALKLSIRITDLWYIGIPGKTEQVEMVVIDSDGDEIDVVCKQDQLKSRKADLKENLTYVMHNFK

SEQ ID NO: 180855 - protein, 99 aa, Glycine max
  Coding DNA Sequence Number=SeqID_89170
MSIASSTASTRMRYAIVRPPAIIQFRAALHNDQTFKEIPPFYHEQWAPNYPQEEIPSHARKYLEECDNHLTIIRKNAPPLQWDVVTLDRGIKDKSISQP

SEQ ID NO: 180856 - protein, 168 aa, Glycine max
  Coding DNA Sequence Number=SeqID_89171
MCSTSSLGNTNFEANGECTKGKGTNKQGNHSTLGPTCETMHDPVTWASRVNADFKGQQRPTRLCKCIYQSLWSSHEWANKNAQCKGLGLAHNMGSNSNDTMEILPSPTHMDGMNMASDPIMVIARISKMVGMCGRGWIGVWLIQLGDCSNLMVSWRSSIPMLQTITLY

SEQ ID NO: 180857 - protein, 99 aa, Glycine max
  Coding DNA Sequence Number=SeqID_89172
MKSFSKLICERILEEYEARLSQARFDATLSVGESQLTPLDPAEEQRLRTQCWVVAAGPKCKGCLYGTGDLAHPYKCGDDSFMQHKQGSSSCTQDVVDIN

SEQ ID NO: 180858 - protein, 204 aa, Glycine max
  Coding DNA Sequence Number=SeqID_89173
  Gene Ontology: Mol. function=protein binding; Cellular component =cytoplasm; Biological process=potassium ion transport
  Homolog annotation: Hit_ID=A7QFG1; Match level="QueryCoverage=80%, HitCoverage=35%, E-value=2e-44, Identity=44%"; Hit description =Chromosome chr8 scaffold_88, whole genome shotgun sequence
  Pfam annotation: Domain name=Kelch_1; Domain location=20-65; Score =46.7; E_value=8.4e-11; Accession=PF01344.16; Description=Kelch motif
  Pfam annotation: Domain name=Kelch_1; Domain location=67-112; Score =21.8; E_value=0.0026; Accession=PF01344.16; Description=Kelch motif
  Pfam module annotation: Pfam domain module=Kelch_1::Kelch_1; Domain location=20-65::67-112
MDLYFTSQNVIKSLKPMSSIRSYASIVWLNGEMYVFGGGNGYVWYDTVESYNPIHDSWTLCPSLNQNKGRLSKVALNDKIFVVGGGNGVDCFPDVEMLDLDIRWWIPTCSMLDKRFSFVAVQLNGAIYAIGRFDGNDYLRVLCFIRTNVNTLLHNCRYALGGFDGFFLDLSSVILHTPCLYRDYNLTFLTLTATIWDRFKMFQD

SEQ ID NO: 180859 - protein, 243 aa, Glycine max
  Coding DNA Sequence Number=SeqID_89174
MGNLAKLPIISPKTQYPRKSSEKEVYPNLKFRGPTRRDALHDSENAFLSRFGAEMMTKGWSFVGASMEDERGEKATYATCLHLSGAKGPTFSLDVTHAQSQEEEKNLTFEMLKSYLGLRAISLVPIPRVSLHPSGPVFETIQNAPFTKIPGRNFQDVTQTNTLTYIMSSRSTSLEPKSQLTINLSLKRKQKGENSRSKESTKSKKRKFPIKKKMGESKKERKFLIKDRKKNGLSEPSSLSSHT

SEQ ID NO: 180860 - protein, 193 aa, Glycine max
  Coding DNA Sequence Number=SeqID_89175
MHYTFLAWPTHLVKRLSEQAAVSPAKPPESPDEEVDDPLYLMTLTIPQVFLKPLQVMWDATIFGVFNQNFPFHLTETSVRAGNFDVYGFLEPQSIQRSGQSQFESESYIKSWIQSSKRDVYLGAYLNRPDNYLKGIINSALKGLDDTPQPKSKAVARWIVVKYFNEVRPLEAERFKALRIQWAQYYLKVRNQT

SEQ ID NO: 180861 - protein, 86 aa, Glycine max
  Coding DNA Sequence Number=SeqID_89176
  Subcellular localization annotation: CTP_CleavageSite=38; ConfidenceScore=5.20e-01
MGSLARDLASSSQGRRGSHRSATREKSPEATLKPPTPVADTTSPQQVADPSTLEDQTTPVLSPNTSPVATPVLYLSEEEEGQTQET

SEQ ID NO: 180862 - protein, 25 aa, Glycine max
  Coding DNA Sequence Number=SeqID_89177
NRTLSLFSSEDQGFFKGSIRLMEEQ

SEQ ID NO: 180863 - protein, 482 aa, Glycine max
  Coding DNA Sequence Number=SeqID_89178
  Gene Ontology: Mol. function=inositol or phosphatidylinositol phosphatase activity; Cellular component=cytoplasm; Biological process=carbohydrate metabolic process
  Homolog annotation: Hit_ID=A1G0Q2; Match level="QueryCoverage=54%, HitCoverage=96%, E-value=1e-134, Identity=92%"; Hit description =Inositol monophosphatase
  Pfam annotation: Domain name=Inositol_P; Domain location=30-296; Score=270.3; E_value=4e-78; Accession=PF00459.16; Description =Inositol monophosphatase family
  Subcellular localization annotation: CTP_CleavageSite=40; ConfidenceScore=5.36e-01
MVNCAAGHCAGPALFPRQSISSAFPGAHAMQKPAVTVMVKAARLAGNVLLRNINKLEALNVVQKGRMDYASEVDADAEKVIVKELKRAYPDYGIFGEEGGVQGERRQMWVIDPLDGTSNYLRGVPHYCVSIALVENGEPTDAVIFDPLRNELFTASRGAGAVLNDRRIRVADRKDLEGTMIHTGFAPRERSRASAQLKAVDALLVHGEDIRRTGSAALDLAYVACGRADAYFEAGVKAWDIAAGLLLVREAGGKVCDFKGATLGRMDNRGPETHQIVAGNLKVAESLQKVLVNTAIHGDGTCEGAVFVSAVIVLVTFFARKEGNQRNAPPAASRRAAHAGALRSSARRGTVRELAALRHPHLFALAGPAVLGSLEGGLEAVAFDLGSALSEPSIAGESGAKGRRCLSEASSAPPPDSPRSAGYRRVATARAPAACFFGYFLCTSKETDTSPQARKRSARHDPASAMHPHKQKRPARGQAFLH

SEQ ID NO: 180864 - protein, 108 aa, Glycine max
  Coding DNA Sequence Number=SeqID_89179
NFSTGKCTVSSKLDRAGLDNCIARDRLQDIEAATTPEEPLSSEASSSFPTQGQSHTILAEANIMAEEPRRVTLEDYLSSSVWKFFTSIAQPKVQEQNITYPHLLIQLI

SEQ ID NO: 180865 - protein, 160 aa, Glycine max
  Coding DNA Sequence Number=SeqID_89180
MWAVHKGLQIDWAHLVRYRMHKVLRLNAPLPYPHLITLFLQHFNIPLDSEPYVPIKRSFLIGASVIASFGYIMEHDGSWVKKGARNVGEEGHEGEDSSLLSKILERFDGLQTFVGERFDTLELQVDMRFNEMESRMTKVEEDVSYIRSSFDLPPPPPPSS

SEQ ID NO: 180866 - protein, 39 aa, Glycine max
  Coding DNA Sequence Number=SeqID_89181
MRDESMKDVRYRPYFRDCIGAIDGREGSAHDTKISMEAL

SEQ ID NO: 180867 - protein, 137 aa, Glycine max
  Coding DNA Sequence Number=SeqID_89182
  Homolog annotation: Hit_ID=UPI0000ECBAF8; Match level="QueryCoverage =29%, HitCoverage=48%, E-value=1e-16, Identity=100%"; Hit description= UPI0000ECBAF8 related cluster
  Subcellular localization annotation: CTP_CleavageSite=54; ConfidenceScore=5.69e-01
MTMITNSSSVPHPRPRFTLSLLFATVSAFSAALSLSAAAPAAHTLPGVSRLGFRGFLVGSLFGAHYVFKRRWVLHFPIIQSRPAGMQAWHWPSFYNVVTGKTLALPNLIALQHIPLSPAGVIAKRPAPIALPNSCAA

SEQ ID NO: 180868 - protein, 177 aa, Glycine max
  Coding DNA Sequence Number=SeqID_89183
  Homolog annotation: Hit_ID=A6N1F2; Match level="QueryCoverage=27%, HitCoverage=60%, E-value=2e-08, Identity=62%"; Hit description=Imp biosynthesis protein
PKGVVDGQQVNIPVLPFWSRGTEEARVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAI

SEQ ID NO: 180869 - protein, 114 aa, Glycine max
  Coding DNA Sequence Number=SeqID_89184
MAGVGDNGGVYHQLDGSQCLLLDTMTTQIQRLLNRKNEELYKRIEGLEHQMNPNVGRPYGGNRRVNDGSIRIEGQDRIEGVKLNAFKGRSDPDAYLDWEMKIQHSFSYNDYPEE

SEQ ID NO: 180870 - protein, 89 aa, Glycine max
  Coding DNA Sequence Number=SeqID_89185
MGEVDEVQEQIKADIEALKEQMATMMEAMMSLKKMMEVNVAAIAATSVVVEVDPTAPSGLNQINHPTSDMVGQDVKELGSTGGPHFVQV

SEQ ID NO: 180871 - protein, 150 aa, Glycine max
  Coding DNA Sequence Number=SeqID_89186
  Subcellular localization annotation: CTP_CleavageSite=29; ConfidenceScore=5.64e-01
MKKQQQQRQMVPPNRGINNNNNNNNNVVTVGNVVNGLGLSGSAWVPPPGSRMRAVFLAGKIEKSTGTGVFLPRCVDTRNNNDSRNNNDSRKKPGCITVLVPDRVAQVLNLNLDGVVGGGHKQQHKPRFIGENGSAVSGLGVTITIIIIIM

SEQ ID NO: 180872 - protein, 149 aa, Glycine max
  Coding DNA Sequence Number=SeqID_89187
  Subcellular localization annotation: CTP_CleavageSite=27; ConfidenceScore=5.33e-01
SARRRSAGLAPGFAATAAPPTHRGLVLAPTAGAQLGTVTQLPVHPASPVLLTKNGPLGALDSMARLNRAAAPSYLFKGNFGGNQLLDGSISLSPLYPSQTNDLHVCSHSNPSQKIRVGRRCNPQGDPTNQLPCALRVYSPVDSHMSDSL

SEQ ID NO: 180873 - protein, 84 aa, Glycine max
  Coding DNA Sequence Number=SeqID_89188
MGVQIAPRPIWALQKIPPEGGNEEGRGPAPLGTSLSFEFAWKNCFREENLSRALPKRFRNVFREEFREGFDRSSTFFIVLRSSM

SEQ ID NO: 180874 - protein, 117 aa, Glycine max
  Coding DNA Sequence Number=SeqID_89189
  Subcellular localization annotation: CTP_CleavageSite=27; ConfidenceScore=5.16e-01
MRITKLTRRSWLLAQQGGALPHRRRTRGSVRGGASGFQCTASKIRTSLPADHCRPILETGKRGGIGTTGPPTSKGKTEVRVSAPAEKALSPYSNKLGAGYGILVVGWTNIQPREGSL

SEQ ID NO: 180875 - protein, 40 aa, Glycine max
  Coding DNA Sequence Number=SeqID_89190
MASSGTPAIFTVLQILIWMRKYGYEMLAACTSGMAMLVKY

SEQ ID NO: 180876 - protein, 134 aa, Glycine max
  Coding DNA Sequence Number=SeqID_89191
  Pfam annotation: Domain name=zf-CCHC; Domain location=77-94; Score =30.9; E_value=4.6e-06; Accession=PF00098.14; Description=Zinc knuckle
MELQRLNQNEETNKRKRSIALKASSSIQEEEEQEESDDEEDFSLFVKKFHKFINNRRMERSHNFNNGNRSQEVSPTLKCYKCNQPDHIKANCPSNESWPEKNEKNEKETSFMMMNQVDSSSFDDDKDDDKMSKE

SEQ ID NO: 180877 - protein, 48 aa, Glycine max
  Coding DNA Sequence Number=SeqID_89192
ATGKGWGPGAACAVYTGSKYHSTAPGPYGWPPTGQPNAACRAPSSACE

SEQ ID NO: 180878 - protein, 62 aa, Glycine max
  Coding DNA Sequence Number=SeqID_89193
MSHGRLYQSRVKKAFNKRVCPLLFLCTFIVVGHERTLSFLLTHMTDILEPFGTFSRGALCVK

SEQ ID NO: 180879 - protein, 193 aa, Glycine max
  Coding DNA Sequence Number=SeqID_89194
  Pfam annotation: Domain name=G-patch; Domain location=60-104; Score =12.5; E_value=0.0059; Accession=PF01585.14; Description=G-patch domain
MAEGQLVIVLGEEKILVSCPSSTPYVEATKESLETSFQALEIVDNAYMEAPPMQSHLSGASLMVARVMLRDGYEPGMGLGRNSDNTTSLVRFIENHGRYDLGYEPTQADKRRVALERKERSLTHSQGRGPQMERVSIYRISKSFVSTGWMHENQVAVLDEETNQKKPSWVQLCSLGFELAIVERPEISVSNPM

SEQ ID NO: 180880 - protein, 59 aa, Glycine max
  Coding DNA Sequence Number=SeqID_89195
MMAHHNDKLLKQWPPQGRDPMQPRKRRLSLTDTISEARSISTASKQLRIGLSSKKDESN

SEQ ID NO: 180881 - protein, 208 aa, Glycine max
  Coding DNA Sequence Number=SeqID_89196
MAKYDPEIVMEFYANVWPTEEGVVDKCSWVWGQWIPYDEDAINQSLGHPLVLEEGQRCEYTEKRRQVSGFDEEAIGQLLCYPGQDLAWSVTGRQISVHVAQLISDAIYKFVGNHIFETPSGPRKVQQDTEISSIDHRSLPILRQQHPATDAPLPPPHQPPSLESISAHMQRMELYMQHLVDQQAANHRGQVPQRPEEMKIELRKIETW

SEQ ID NO: 180882 - protein, 53 aa, Glycine max
  Coding DNA Sequence Number=SeqID_89197
MGGEDDKVCEKYDISKEKWNQFCQSRKDPSWEKKIDGGQEKETIGGSSPIQEH

SEQ ID NO: 180883 - protein, 109 aa, Glycine max
  Coding DNA Sequence Number=SeqID_89198
MYENLNDASKRSAMQLAGYITLLQIIMRGNHVLVVGGLGRHYQCRSIMGFVHCHIPIREGCATIWEACQEITKSLECLINPKVVTEGIEAYTVTEECLRIARGVTAQRN

SEQ ID NO: 180884 - protein, 83 aa, Glycine max
  Coding DNA Sequence Number=SeqID_89199
MITTKKLCPLLAMNPKAVSLLSPAITTKKLYPLLAMNPKAVSLLDLVINEAANPLLALNPKEVSLLSLVFNQEDLLLKNSNQE

SEQ ID NO: 180885 - protein, 172 aa, Glycine max
  Coding DNA Sequence Number=SeqID_89200
FEVKAIGVGGGEKSDQNSKRVIVGVKVKRGQRWHGLSGKKCIPKEEGAGWVWLETRSIDGGRILKVYRDVGFNEGALVTKYPRKIVSLGRWVGGGKGHGFGGWHAKGSGLNGRNLWDEYKILLRNDIVGDDLVVFKRMWKYAAPSNVTPFTWRLLLDKSIDQKQFENQECCA

SEQ ID NO: 180886 - protein, 161 aa, Glycine max
  Coding DNA Sequence Number=SeqID_89201
MWAFHTGRKIDWAHLVRYRMHKVLRLNALLPYPHLVTLFLQHFNIPLDSEPYIPIKRSFLIGAVVVASFGYRKERDGSWVKKDAQPNDDEGQLPIEGDSSLLQSILDRFDGLHSYVGERFDALEQQVDMRFDAMDSRMTKVEEDVTIIRDCLDLPLPPPLV

SEQ ID NO: 180887 - protein, 137 aa, Glycine max
  Coding DNA Sequence Number=SeqID_89202
  Homolog annotation: Hit_ID=A2Q1D6; Match level="QueryCoverage=83%, HitCoverage=18%, E-value=1e-10, Identity=35%"; Hit description =Ovarian tumour, otubain, related
MDRLKKLVRNPCERRAPWASPWTWARVPTPRFVTVILRSDTNTGSRGRTMFVLIGCEKTDEYRCRKKEFIRRDIGTRKYECPFKLCCKPVVGGECWMVKLICGVHNHELAKSLVGHPYAGRLTKAEKTLIADMTKSM

SEQ ID NO: 180888 - protein, 139 aa, Glycine max
  Coding DNA Sequence Number=SeqID_89203
MVAITPAKVHQPPFFREYDSNATCACHGEAPGHSVEHCRVLKRKVQVQPIGLFAQATCAPEFGLPSPFNQRLLFLHVGGGPVNQQGQPFPCVQESPTTIDPRSLNPFSEIRRREEEISLKRDGLYNEDQSKFFIEYASD

SEQ ID NO: 180889 - protein, 226 aa, Glycine max
  Coding DNA Sequence Number=SeqID_89204
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=96%, HitCoverage=35%, E-value=1e-96, Identity=66%"; Hit description =Photosystem I P700 chlorophyll a apoprotein A1
  Pfam annotation: Domain name=PsaA_PsaB; Domain location=1-226; Score=- 184.4; E_value=0.0011; Accession=PF00223.10; Description=Photosystem I psaApsaB protein
DPPGCRNSIAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGSPYVFYAPYPYLATDYGTQLSLFTHHMWIGGFLIVGAAAHAAIFMVRDYDPTIRYNDLLDRVLRHRDAIISHLNW

SEQ ID NO: 180890 - protein, 115 aa, Glycine max
  Coding DNA Sequence Number=SeqID_89205
ENRGGVCHPARPGELGCFLQKQPPSGGTSWKAQGSCNHPFLPFGTLRNFTDCALTLPFNFRHVTELHGLCYNAFLLASGMSWNFTNCLTMGAKYLEVVKRGSHPNNGWSPDEIRV

SEQ ID NO: 180891 - protein, 229 aa, Glycine max
  Coding DNA Sequence Number=SeqID_89206
  Homolog annotation: Hit_ID=UPI00006A2939; Match level="QueryCoverage =54%, HitCoverage=75%, E-value=7e-10, Identity=31%"; Hit description =UPI00006A2939 related cluster
LPSPLRGLHVLALRGLHVLTIRGLHAFTSRGLHVLTFIGLHALAIKGLHVLTFVGLHALTFGGLHALAIRGLHVLAFRGLQALTLRGLHVLANRGLHALTLRGLHVRAIRGLHTLTSKGLHILALKGLHALTFRGLRVLIFRASSFLLTILGPPPDIGGGPTVRAQPEREAITLLLCIPGDRTHKTPSGPGIVQQGPRVSSSGYGPLSILQGARIAPARHPVDPKKSNK

SEQ ID NO: 180892 - protein, 196 aa, Glycine max
  Coding DNA Sequence Number=SeqID_89207
  Homolog annotation: Hit_ID=Q2HW90; Match level="QueryCoverage=66%, HitCoverage=26%, E-value=3e-12, Identity=34%"; Hit description =Putative uncharacterized protein
MSPFLVRDFGAQNSKTIQRIHKAWETPLKKDQELRGIRNGIIGGYHEWLKVHIRGASFRKTYGKILELTIAEVSIEAIASLTQYYDQPLRCFTFADFQLVPTIEEFEEILGCPLGGRKPYLSSGCLPSLSRIATVVKDSARGLDRIKQTRNGIAGLPQKYLEDKARGMGQSRRLGPVYGCVALLILGSSLSNVMGW

SEQ ID NO: 180893 - protein, 91 aa, Glycine max
  Coding DNA Sequence Number=SeqID_89208
HFGFYKGTSFGNFDHANVTGVQCRVSSENNGDLWWLMVIMGDGERSWNVGNGFGRKKEKKMTFFLSYTKAKAETLKKAGVAAHDVQRYVKE

SEQ ID NO: 180894 - protein, 120 aa, Glycine max
  Coding DNA Sequence Number=SeqID_89209
  Homolog annotation: Hit_ID=A5C7Z4; Match level="QueryCoverage=93%, HitCoverage=40%, E-value=1e-07, Identity=31%"; Hit description =Putative uncharacterized protein
MVVILPKGNVVIWFCSLHNRPDNYLKGIINSALKELNHTPQSKSKAAARWIIVKCNRQKGSTEYGYYVMHWMSAIILGSFKNNWETYFNDVKPLEPERLKALRIHWAIYYLKDKNETISV

SEQ ID NO: 180895 - protein, 238 aa, Glycine max
  Coding DNA Sequence Number=SeqID_89210
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
  Subcellular localization annotation: CTP_CleavageSite=56; ConfidenceScore=5.25e-01
MVKVGTSYVPINVSFSPKVGPRASPVLQWLLFLSAVPPVQLLTGWCVTAKAPPDISAGKCSGHAARRVPFAIQAAQLLGRAIGAGLFAITPAGERGMCCKAIKLGIRCPRLQRATRPHLQRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 180896 - protein, 211 aa, Glycine max
  Coding DNA Sequence Number=SeqID_89211
  Homolog annotation: Hit_ID=UPI00006A2939; Match level="QueryCoverage =80%, HitCoverage=100%, E-value=2e-13, Identity=31%"; Hit description= UPI00006A2939 related cluster
MTDPLDESISCFLIRVNPWGYPPSPWVLVTLTFRGLHALAIRGLHVLTFKGLHALAIRGLHVLTFVGLHALTFRGLHALAIRGLHVLTFRGLHALAIKGLHVLTFVGLHALTFRGLHVLANRGLHALTLRGLHVFANRGLHALTLRGLHVLANRGLHALTLRGLHVFANRGLHALTLRGLHVLTNRGLHALTLRGLHVLANDRIPAARGIH

SEQ ID NO: 180897 - protein, 39 aa, Glycine max
  Coding DNA Sequence Number=SeqID_89212
MEVEEPWLGLWLPLHHQVDMGARMTFVDNLVVGKEKGCY

SEQ ID NO: 180898 - protein, 52 aa, Glycine max
  Coding DNA Sequence Number=SeqID_89213
MVWCLQSSFFLLHSSTIDLQEAMDSIDEEDPRPTSSTWSYIKQPIRDRGTTT

SEQ ID NO: 180899 - protein, 36 aa, Glycine max
  Coding DNA Sequence Number=SeqID_89214
MAKNPGEESNDLAISHGGLNQDNFESEFSIFVHPSL

SEQ ID NO: 180900 - protein, 23 aa, Glycine max
  Coding DNA Sequence Number=SeqID_89215
MATKMKRCPLEALGEALSLSVKV

SEQ ID NO: 180901 - protein, 69 aa, Glycine max
  Coding DNA Sequence Number=SeqID_89216
  Homolog annotation: Hit_ID=Q5CEG7; Match level="QueryCoverage=100%, HitCoverage=65%, E-value=8e-24, Identity=79%"; Hit description =Senescence-associated protein
  Subcellular localization annotation: CTP_CleavageSite=52; ConfidenceScore=5.09e-01
MIGRADIEGSKSNVAMNAWLPQASYPCGNFSDTSSFKFRRTKGSIGHAFTVRIRTGNQNHRIPAARGIH

SEQ ID NO: 180902 - protein, 52 aa, Glycine max
  Coding DNA Sequence Number=SeqID_89217
EFDFRKLGDKCAETNSAPLVIPHTFSLSRGDRVQQNAETNYGSADREVHWPK

SEQ ID NO: 180903 - protein, 678 aa, Glycine max
  Coding DNA Sequence Number=SeqID_89218
  Homolog annotation: Hit_ID=Q2HVW1; Match level="QueryCoverage=18%, HitCoverage=51%, E-value=8e-09, Identity=29%"; Hit description =Putative uncharacterized protein
MRERDSERDYEGLRERDIGTERESGWERVRTRGRTTAGDRVHPTGSSRWINPANLGRNQQVHTSNWRDKKDISSFYFTRFSDEITEKDLWRHFRQWGVHDTHQLAKQLDGLLIGGLKMYVNIPRYSREGPRQCVTGNKICDRKESNPEVAVRSHRQHHINQGSYAEVLRRNVDIERPRVLHNSHLHGYQASMFSVHLTLDPDDTDEMLWETRLDISPKYLGDDQVLLLGLTNRGAEQLMNDRQQGGRPLFSTIEKWNPSLHTTFRLTWVQVWGIPPQAWNLKHIRSILAAMGDTVDVDDDTEAKRRLDRARVLVKTQWRPTINHMVDVHISGDIGNSFKVYIVEESGGGSHECRRRRCSLSGTSDKIVSDDSSLGHFSLPSSSCNYRHTADQPDEVGRFRRTPHGRNSGASIQRKNQHQSHHTRTGGVSHNGYLSERVEYCTGMGEECWGCNRCRREPVESRYRKQWEKEIRKEEAGLHASDVADGDVANILNVAETYEAGVANITSNEGQNKSHLFTKVLRNLMVYYIKRLRKSGIEPRCWGLQKKKARIQSYPDSRIWRVEIRRKQKGWEIVVEHVDMICIQETKRESVDKSLCQSLWGDVGVSWEMQSASNTAGGEWVKEAQQVSVLTIYSPCEIQNKRDLHERFGICQRGSGPLKDLSNIQQSRTPKGFRPPAI

SEQ ID NO: 180904 - protein, 145 aa, Glycine max
  Coding DNA Sequence Number=SeqID_89219
  Gene Ontology: Mol. function=receptor activity; Cellular component =photosystem II; Biological process=photosynthesis
  Homolog annotation: Hit_ID=Q5Z5A8; Match level="QueryCoverage=48%, HitCoverage=18%, E-value=2e-18, Identity=65%"; Hit description =Photosystem II stability/assembly factor HCF136, chloroplast precursor
MCSMRYWDDKIFSVFIWQGQGIYLSLLLLQNSFSGISGASYYTGTFNTVNRSPDGRYVVVMAFAFASICLPLWLPHNRAVARRIQNMRWRADGGNDPRRKFLLHGEVTIDTMTDDVEFTEHGYDRTKFLKLSNRIEYTIRTWYLL

SEQ ID NO: 180905 - protein, 157 aa, Glycine max
  Coding DNA Sequence Number=SeqID_89220
MDNAEVSWLLTGRNGNLTVNSNIEAHAAKISPLESYLNNHEPQVYSRGSWSQRRHQRQEGQVNANQEQANNTHADSRSNAPHSGTRDIRSDFNKEAVEAVTRVRKNYSLTCLLYFIQNNIYIHQGRKGQLDKTSHTVVFYNKLSRKTKKAKQQKISQ

SEQ ID NO: 180906 - protein, 68 aa, Glycine max
  Coding DNA Sequence Number=SeqID_89221
MALDKKLREEASMEEKKEREREMGGGGGVMQSYPARALDRKFQVDWAKDAREGPRVLMSLRVDFGPMG

SEQ ID NO: 180907 - protein, 323 aa, Glycine max
  Coding DNA Sequence Number=SeqID_89222
  Gene Ontology: Mol. function=isomerase activity; Cellular component =membrane; Biological process=carbohydrate metabolic process
  Homolog annotation: Hit_ID=A9PBR5; Match level="QueryCoverage=59%, HitCoverage=62%, E-value=4e-65, Identity=64%"; Hit description =Putative uncharacterized protein
  Pfam annotation: Domain name=SIS; Domain location=158-267; Score=2.7; E_value=0.026; Accession=PF01380.13; Description=SIS domain
MRSSNGDYPPWRCSGRQKRRGETRRHPLGNKPWKKELYHQDEPWIRSLEGCFNGGKERGRERERGEHEIEGIKEGEKWNFEGISTSCLREEWWPEKCLVEWVKRSDLVGAEMEAIGWVGGSHIDEATLSALFKSQQSHLNFFFDHIDHSQTLAFTCALLNAAGIVFFTDVEKSGFVAHKISQTLVSLASGCFPRKSYATEELLRLVLCAGAKGALLIALTSVEGNALTTACDMSVHLPLRRELCPINLAPVTSTAIQMVFGDTIAIALMEARNLTKEEYAANHPAGKIGKSLFLKVKDVMKKQDELPICRESNFFDSVPIFNW

SEQ ID NO: 180908 - protein, 148 aa, Glycine max
  Coding DNA Sequence Number=SeqID_89223
MPRTPEQNNKKINPKASRCFFIGYSDCAKGCRFFHPSKENKIVECMSANFLELDVADPVIPFYGTDVESHEIVSLPLPIPVVSVSNVVLIETRVQIVATKTRVPIVPIKTTIVTGDIVGSHANDMLDPPTMNENAQPVEQVPLRRTTR

SEQ ID NO: 180909 - protein, 98 aa, Glycine max
  Coding DNA Sequence Number=SeqID_89224
MESVFGQAINQHGICVHMIHHYGTIFDKISNSQILQLQDIAPPTIIKMYPEVDLLSLENPPRSESMYPITSKLSTLLYISIYYLVFWKYLIIFLVAIQ

SEQ ID NO: 180910 - protein, 77 aa, Glycine max
  Coding DNA Sequence Number=SeqID_89225
MEMQQKIKEKSLERMLQWRKRKRDRKRGRGEHEIEGGKGGEKLNFELCLTRLSFIKVTKIVTHVSIYSLCSFLEKLP

SEQ ID NO: 180911 - protein, 128 aa, Glycine max
  Coding DNA Sequence Number=SeqID_89226
EQQAEWVNAQRQILRPLSFRSSEAGDKCAETNSAPFVIQISQVGLDRVQQNAETNYGHSVSCINHEEKIGQYQDDVSLKGSVSAQSVKFRNILEGKKGDDYVIRKGVQIATRPTWAFQEVLQKAPPSG

SEQ ID NO: 180912 - protein, 151 aa, Glycine max
  Coding DNA Sequence Number=SeqID_89227
MARTRGLGRAIGRVVGRDRPVDEDAGDVPERRRPTASARRLRVHQMTTEGRDMAEDVADMTDDVPEQPTEAPEMRADAQGADSGEGKLTLIGRPVPEIEGLVAATGLSPLIDCSVITGDPGLISAFVERWHSETSTFHLPVDRIPAARGIH

SEQ ID NO: 180913 - protein, 97 aa, Glycine max
  Coding DNA Sequence Number=SeqID_89228
  Gene Ontology: Mol. function=protein kinase activity; Biological process=protein amino acid phosphorylation
  Homolog annotation: Hit_ID=Q2R1R7; Match level="QueryCoverage=84%, HitCoverage=5%, E-value=4e-19, Identity=58%"; Hit description=AT hook motif-containing protein, putative
SIYNQIVEVVNKDEGGMFFLYGYGGRTAHSKFKILVPVFEDSTCNIHQGTQLAELLNQTSLIIWDEAPMAHKFFFEALDHNLRDIIKHNSKDNKIFG

SEQ ID NO: 180914 - protein, 70 aa, Glycine max
  Coding DNA Sequence Number=SeqID_89229
MVKEAMKILQKEVKSNDEHPKVNGKLQKKYIPLKSRINHVLVINLQKALYGLKQAPRHSALNDLSNFPVT

SEQ ID NO: 180915 - protein, 258 aa, Glycine max
  Coding DNA Sequence Number=SeqID_89230
  Homolog annotation: Hit_ID=A4PY46; Match level="QueryCoverage=55%, HitCoverage=36%, E-value=2e-07, Identity=30%"; Hit description =Ankyrin
MVEALSQNIVTLTGLPLILLSESDLTNSLCGVSCYVLLSAPGWFFTNMRVSQFSLANVPLLEEELRAKITLNERIEIYVTRLRKRISNDTRNALLMGAILFVTSTYEAALSPPGGVYQGEASSVTTSKKTRASLLQRDYATPEIVGKVVMKMQTFFWFWSFNTWSFYLSILMICLLMPRGRIRLIVTFPLSIFSGFYVFSMMVISPSLRLNTATVVMPCIFIVFYCWGSSIYIRLAKKLKMYGHRQKDALKFSRENRW

SEQ ID NO: 180916 - protein, 66 aa, Glycine max
  Coding DNA Sequence Number=SeqID_89231
  Subcellular localization annotation: CTP_CleavageSite=21; ConfidenceScore=5.10e-01
MGVQIATKPTWASRRFLQKVVASGGSNPARLGELGGKLLPQFSINRGRNEEEFRAALLKIRVEALP

SEQ ID NO: 180917 - protein, 47 aa, Glycine max
  Coding DNA Sequence Number=SeqID_89232
MEDRQPTLGNHQAYRYRRPRGGARYQLLFPLVRVNFELGVIMVIAVS

SEQ ID NO: 180918 - protein, 49 aa, Glycine max
  Coding DNA Sequence Number=SeqID_89233
MSMRPDDLVEGDGNFVELTEARNQSWKPQDPVGLLWVHWVSCGGDPRKQ

SEQ ID NO: 180919 - protein, 101 aa, Glycine max
  Coding DNA Sequence Number=SeqID_89234
  Gene Ontology: Mol. function=mannose-6-phosphate isomerase activity; Cellular component=cytoplasm; Biological process=carbohydrate metabolic process
  Homolog annotation: Hit_ID=Q5BMC5; Match level="QueryCoverage=79%, HitCoverage=18%, E-value=8e-32, Identity=82%"; Hit description =Phosphomannose isomerase
MVLWLEKQCPSDVGVIVAFFVNHVKVAPDEALFLGANEPHAYICGECIECMATSDNVVRAGLTPKHRDVQSLCSMLTYKQLHGDFFLTDKKEENILGWGYK

SEQ ID NO: 180920 - protein, 188 aa, Glycine max
  Coding DNA Sequence Number=SeqID_89235
MKNVEERLKPLRNSSRKTLWKRFGSASGEMLAAQLAQASQVASSRSNSLLEESSGGPKWAWLLFAPPFLLSTPPLPFFGDSFFRKVTETYEFRNDTCFLSVMLRNLVDYIIIPFLTYGMLRNLTNYATMLPFDFRCVTEPYGLCINISFVSGMSRNFTNRLMMGAKHLTRAKQRSHVIKQRSPDEIRV

SEQ ID NO: 180921 - protein, 155 aa, Glycine max
  Coding DNA Sequence Number=SeqID_89236
  Gene Ontology: Mol. function=transferase activity, transferring phosphorus-containing groups; Cellular component=integral to membrane; Biological process=regulation of transcription, DNA -dependent
  Homolog annotation: Hit_ID=A6X123; Match level="QueryCoverage=90%, HitCoverage=18%, E-value=1e-49, Identity=76%"; Hit description =Sensor protein
MRCIDATLLGNMVNMSTANLTTDMNGEKQSSQGGEGRRLLALPGIITVVSALITASISFAILIGITPITPDRTVTLALVIINVALILFLILLICREVYRIVMARRLGKAASRLHVRIVALFSLIAAVPAIVVAIVASVTLNLGLDRWFDTNTRDI

SEQ ID NO: 180922 - protein, 102 aa, Glycine max
  Coding DNA Sequence Number=SeqID_89237
MAYTHIPLSKLPHVWHFLSMLGFTRNSPQISASPYQLDFTLYASGSYNAQWNAPGLLHDKHTLHSSRILRKVEVDEPWLGLWLPLNYQVDVGASQHRTLELG

SEQ ID NO: 180923 - protein, 292 aa, Glycine max
  Coding DNA Sequence Number=SeqID_89238
  Homolog annotation: Hit_ID=Q6WAY6; Match level="QueryCoverage=93%, HitCoverage=55%, E-value=4e-18, Identity=27%"; Hit description =Putative uncharacterized protein
MGSSQAPPLKKRFYQVKVKSLGITSLKELGQLMGQLQRQAFRKAYGKIWDLAMAEVSIEAIASLAQYYDQPLRKQVENGVVGVSRKCLEAKAKARILVGRGEWAPFIDILALLIFGGVLFLNVDGLVDLEAINAFLAYHDRKESLVVAILAYLYDTFNRRCEKSSTRIFCYTLALYVWLVSHFFCQEVRHACPLESHRSCTEKRGANWDRLLASKEGASVNWFPRWKEGRTGVLISCRGFPNVPLMGTRGCISYNPILAIRQLGYPMRGAPLEEELAPTIARGFNNTNVGAL

SEQ ID NO: 180924 - protein, 54 aa, Glycine max
  Coding DNA Sequence Number=SeqID_89239
MVADLLAVGGDWTISNGESDLRTNPSQEGENDEDMTKSKGKDPLEGLGGPMTMI

SEQ ID NO: 180925 - protein, 80 aa, Glycine max
  Coding DNA Sequence Number=SeqID_89240
  Subcellular localization annotation: CTP_CleavageSite=19; ConfidenceScore=5.34e-01
MKGNQQRGKSRSPVESPTVATYPSAGGRRVTRGMRVPRKEYARSRHQRLFEENVGKTGKDAIYELLSERFGSCIYAWGRY

SEQ ID NO: 180926 - protein, 204 aa, Glycine max
  Coding DNA Sequence Number=SeqID_89241
  Homolog annotation: Hit_ID=Q84VH5; Match level="QueryCoverage=95%, HitCoverage=32%, E-value=4e-97, Identity=83%"; Hit description =Envelope-like protein
MDLIKAAGLLKTVTKLGDCYESLVREFIVNIPSDITNRKSDEYQKVFVRGKCVRFSPAVINKYLGRPTEGVVDIDVSEHQIAKEITAKQVQHWPKKGKLSAGKLSVKYAILHRIGTANWVPTNHTSTVATESFAVKLPIAFPTVLCGIMLSQHPNILNNIDSVKKRESALSLHYKLFEGTHVSDIVSTSGKAAASVLCPRCFDC

SEQ ID NO: 180927 - protein, 191 aa, Glycine max
  Coding DNA Sequence Number=SeqID_89242
  Homolog annotation: Hit_ID=Q6UUU1; Match level="QueryCoverage=32%, HitCoverage=48%, E-value=6e-14, Identity=63%"; Hit description =Putative uncharacterized protein
LPGINKDTRIYLFCEVIFRHSCPSCSATDGVVRNGKKHRRTSALASVAAAQLLGRAIGAGLFAITPAGERGMCCKAIKLGQLNIKLIDTVDLEGGPVGKPVVPAALMNRPTRGERRFAYWALAECILAYYVGTDEGVSEVLHVAGEKGCTGYIPLPRSLTRYARSFDCGERKWLTNGAGDFLEDAEDTNRE

SEQ ID NO: 180928 - protein, 220 aa, Glycine max
  Coding DNA Sequence Number=SeqID_89243
  Subcellular localization annotation: CTP_CleavageSite=41; ConfidenceScore=5.42e-01
MAEPSKKRKGSSSTAAAAAHRRHGPSEASTTPIHPSLSSPRSSTLFSSDDQRLQYLSQFSSRIILDPKYLDVEFFNDETFDCYQVFQNSGLANFMSLKLPHYPKLVKVFYCNLKIQDGIISSEVHVTSFGYRKDQNGQWLKKDALPPQDERTPSPPPQRDDSALMNEVLFELWGLRSYVGERFDSLDTRFAGMDIRLTQLEEDVGYIRQSFDLPPPPPPS

SEQ ID NO: 180929 - protein, 134 aa, Glycine max
  Coding DNA Sequence Number=SeqID_89244
MASKKVVEWSMSSDIGDHRLHDSAYLQPSKEGVKCLPYDLNLFSGYKNGSICISNLLNTNLDLIMQQRNVVNGIVATYPSVVGRCEGSQVRLPRKENAWSRHQRLFKENVGKTRTYGLRTLIVKGLGVVFTHGE

SEQ ID NO: 180930 - protein, 62 aa, Glycine max
  Coding DNA Sequence Number=SeqID_89245
MTMTETVCTDNRLGISIRHLTSRVTITKGGVVDKSGAFAPTYPPFVMRNSDLRSSCFCDVRD

SEQ ID NO: 180931 - protein, 173 aa, Glycine max
  Coding DNA Sequence Number=SeqID_89246
  Gene Ontology: Mol. function=hydroxypyruvate isomerase activity
  Homolog annotation: Hit_ID=A6UKX8; Match level="QueryCoverage=62%, HitCoverage=41%, E-value=1e-35, Identity=70%"; Hit description =Hydroxypyruvate isomerase
MPKFAANLSMLYTEHPFMERFAAAAADGFAAVEYVSPYEEAAETIAAELKRCNLTQALFNLPPGNWAAGERGIASLPDRVSEFETSVETAIRYAKVLGCRKINCLAGINRPVSIRKFWKTRLSAISATLRNVWRIPELPLSSSPSIPATYPAISSPTPIRPSGSWTVSGIPTC

SEQ ID NO: 180932 - protein, 81 aa, Glycine max
  Coding DNA Sequence Number=SeqID_89247
  Gene Ontology: Cellular component=cell outer membrane; Biological process=membrane organization and biogenesis
  Homolog annotation: Hit_ID=A4W6G0; Match level="QueryCoverage=86%, HitCoverage=8%, E-value=1e-25, Identity=81%"; Hit description =Organic solvent tolerance protein precursor
MPVFMELSKPRMKKRIPTLLATMIGAALYSQHALADDLMSQCMLGVPSYNRPLVSGDANSLPVTINSDSAKGNYPNDAVFT

SEQ ID NO: 180933 - protein, 67 aa, Glycine max
  Coding DNA Sequence Number=SeqID_89248
MSDSGALYIEMLEIEQRKLTRNSNSHNSSLGCPIKAQNISRRSKLNNGGSSEIQMVIIFTRMYNSRT

SEQ ID NO: 180934 - protein, 245 aa, Glycine max
  Coding DNA Sequence Number=SeqID_89249
MGLFVVVGQNIVLAGLGKVFENSFTIRNIRYENDVVKVQVVRTYMPHAEAVGTFVAWLTHLVREVTNEVVVGPDKPPSKSIGEPNRLTSVAIDGPLGELVKKSYVVYTKPMELAWDGAKFGLPNATNGFFVTHADLWMMFMNDWSTSIGFSPVYGFLEPQSIRCTKDTCEECQKYIETWVKESHREIYLGPYFNQAHWQLLVLCPGENIIVWFCSVRRKPDVHIKFAVNKYFATLFNLALVITWR

SEQ ID NO: 180935 - protein, 54 aa, Glycine max
  Coding DNA Sequence Number=SeqID_89250
MKNLVHKVMQSYPARALGRRLQEDWARDPREGHRVLMSLRLSSSFSSQGDELSY

SEQ ID NO: 180936 - protein, 79 aa, Glycine max
  Coding DNA Sequence Number=SeqID_89251
MSVKNLVGRLGVHDKTDHTLHSLQGTFKLSVFTPKPYTLKSPSRPLPHDSGINETLGLIRILVMDLKRANKAALTLVNF

SEQ ID NO: 180937 - protein, 80 aa, Glycine max
  Coding DNA Sequence Number=SeqID_89252
MDSQTIYLTNIAKIITNKAPRYHKEKECEKMKPKVHKGSLGAIANGGSRKLLVEVLILGKNGVKMASPLPFYVFTIVMLA

SEQ ID NO: 180938 - protein, 220 aa, Glycine max
  Coding DNA Sequence Number=SeqID_89253
MGLYKATSKDWDLGTADVGYTSKSYHSTAPGPYDWPPAGQPHATYRVASSSCEQRWTLGMVVVVEVAVVYLLLAAADSPTPAVGKNRIMITGEDVTDKQCHPDMCQGGHASAHDLHPSSCHTSCKVLSWNAQQLAYGLFIKSQSLAPPLTELAMLPPSSRTNVNEFKIFKIESRTLQDSRGKLISRIKNQDSRDQDFKNQDSRDQDSRIKRRLNQDKYEK

SEQ ID NO: 180939 - protein, 82 aa, Glycine max
  Coding DNA Sequence Number=SeqID_89254
MDDISACYIYKTKIGHKKVCVVEAMPSKVILMMPKNQELSKVSSKDSRIKFQVSSFKNQESRIIKIKIQDSRFKNQEKTQSR

SEQ ID NO: 180940 - protein, 200 aa, Glycine max
  Coding DNA Sequence Number=SeqID_89255
  Homolog annotation: Hit_ID=UPI00016621D1; Match level="QueryCoverage =97%, HitCoverage=40%, E-value=2e-19, Identity=34%"; Hit description =UPI00016621D1 related cluster
TLTFRGLHALAFRGLHVLAFRGLHTLAFRGLHALTFRGLHALTFRGLHVLAIRGLQALTIRGLHVLTIRGLHALTIRGLHVLAIRGLHTLTFRGLQVLAFRGLHALAFRGVHVPTFRGLNVLAIRGLHALTFRGLYVLAIRRLHALTFRGLHVLVIRGLNALTFIGLYVLTFRGLHTLTFKRLHVLPIRRVYVLTFRGLH

SEQ ID NO: 180941 - protein, 150 aa, Glycine max
  Coding DNA Sequence Number=SeqID_89256
  Homolog annotation: Hit_ID=Q6UUU1; Match level="QueryCoverage=40%, HitCoverage=40%, E-value=9e-19, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFRSKLDCMHRTPRSGPTACAFIRLTIRLESNRKRHAKAPTGQQPL

SEQ ID NO: 180942 - protein, 50 aa, Glycine max
  Coding DNA Sequence Number=SeqID_89257
MTINSWGSGLDGGGRTNSTLGNHGSSELDGRTNKSRLSIRGAPNSMVEDA

SEQ ID NO: 180943 - protein, 86 aa, Glycine max
  Coding DNA Sequence Number=SeqID_89258
VLQWLLFLSAVPPVPATDGVVRNGKSTAGHQRWQAAQLLGRAIGAGLFAITPAGERGMCCKAIKLGNARVFPEFDLEDRTINPQMS

SEQ ID NO: 180944 - protein, 248 aa, Glycine max
  Coding DNA Sequence Number=SeqID_89259
  Gene Ontology: Mol. function=transcription factor activity; Cellular component=intracellular; Biological process=regulation of transcription, DNA-dependent
  Homolog annotation: Hit_ID=Q5PM46; Match level="QueryCoverage=93%, HitCoverage=98%, E-value=5e-79, Identity=64%"; Hit description=Uxu operon transcriptional regulator
  Pfam annotation: Domain name=FCD; Domain location=104-214; Score =95.6; E_value=1.5e-25; Accession=PF07729.3; Description=FCD domain
  Pfam annotation: Domain name=GntR; Domain location=19-82; Score=92.0; E_value=1.8e-24; Accession=PF00392.12; Description=Bacterial regulatory proteins, gntR fam
  Pfam module annotation: Pfam domain module=FCD::GntR; Domain location= 104-214::19-82
MSEPAEKSVMKPQASAQRPYQEVGEMLRNMITQKQYAIGERLPPERELAMLLNVTRTLVREALIMLELEGLIEVRRGAGIYVINDTPAPRAAAQTACNAAGPFEMLQARQLLESNIAEFAALQATREDIIKMRQALALEERELASGAANDSENGDRNFHLAIAEATHNSMLLHRHLINTNYRKKWLDDHKKILAALIKKDARAAKQAMWQHLENVKQLLLEFSDVDDIDFDGYLFESWPLYATNGSDN

SEQ ID NO: 180945 - protein, 17 aa, Glycine max
  Coding DNA Sequence Number=SeqID_89260
MADQQTTKSKAKGSKIP

SEQ ID NO: 180946 - protein, 67 aa, Glycine max
  Coding DNA Sequence Number=SeqID_89261
MGECSIFEQDILAKKREGERTSIISICKISLNLTIPWMLDNILIDPTLTTTTITVNIASVLHEFSFN

SEQ ID NO: 180947 - protein, 482 aa, Glycine max
  Coding DNA Sequence Number=SeqID_89262
ANPVAVVFGLEAERHGQRSTEVHVVVLAERHVEVRGRYRGDHAGVAAVATGIGAPLPYWPWPRNLAPKLMALTSPWTRVPSSRRMEAGWKAAALASAAASAPATPTASRVSRAMVEAVCIVVLSPVSGDGALSAPAPAGSWDPSERAGFPSRHTTPTVATESGRTLGYWHVRLAPVPQEGGPALGHARAPLAGLGRPVHRPDPPAGLVGDPAGRQRAAPVHRPVPARGLVTPAGQSGVPADLQPARRTGAGPVAPAAAVPGRRCGVQSGGHLHHGQPGPDHHRCQRCGVSAHRRLSGPVPGRPAGRGDPAGPVPGVRARPGLPADRRLGGAAGGVRPYRPQLRHGGLVGAHRWLPVRPAVRRVRARRDRTPPAQAARLLNPWWCRPLAGVTLTRSFVDQSSTARRYRIRAWPEPVRALLPALLPALLPALLPVLPVLPALLPASLPASLPASLPASLPASLPASVLPSPIKLINTVDLEGGP

SEQ ID NO: 180948 - protein, 179 aa, Glycine max
  Coding DNA Sequence Number=SeqID_89263
  Homolog annotation: Hit_ID=Q6UUU1; Match level="QueryCoverage=65%, HitCoverage=97%, E-value=3e-37, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRCYGRVWSHSTPDTQFRVGSSLQAGTVCTNPPFSPTAAPYP

SEQ ID NO: 180949 - protein, 74 aa, Glycine max
  Coding DNA Sequence Number=SeqID_89264
MSVKNLVGRLGVHDKTSYTLASQSGSQCFARMLQPYGINIDLKEHSNLVTPKAYTPKSPSRPLPPDSGPTQKIF

SEQ ID NO: 180950 - protein, 21 aa, Glycine max
  Coding DNA Sequence Number=SeqID_89265
MGLISRFISDPPGCKENIRPA

SEQ ID NO: 180951 - protein, 44 aa, Glycine max
  Coding DNA Sequence Number=SeqID_89266
MGSLITNNCFRYSKPAEQIRPDKICNNFSIINQAYRYRRPRGGA

SEQ ID NO: 180952 - protein, 93 aa, Glycine max
  Coding DNA Sequence Number=SeqID_89267
  Subcellular localization annotation: CTP_CleavageSite=24; ConfidenceScore=5.03e-01
MGSSQAPSLKKQKRRRKKRFYQVKVKSLGTTSLKGLGQLMGQLQQQAFHKAYGKIWDLAMAEVSTVAIASLTQYYDQPVEMLHLWGLPAITHG

SEQ ID NO: 180953 - protein, 17 aa, Glycine max
  Coding DNA Sequence Number=SeqID_89268
MDKSLKVGEDEKREKER

SEQ ID NO: 180954 - protein, 84 aa, Glycine max
  Coding DNA Sequence Number=SeqID_89269
  Homolog annotation: Hit_ID=Q0T0E6; Match level="QueryCoverage=77%, HitCoverage=50%, E-value=7e-30, Identity=93%"; Hit description =Putative uncharacterized protein
MSFVRLPGGAALHPTYTPGNHSSRPAIAHWLKQPTRVQYGPYHVNPYLALLRVEFTVPRTVTSRAVRSYRTLSPLPDPACAGHR

SEQ ID NO: 180955 - protein, 199 aa, Glycine max
  Coding DNA Sequence Number=SeqID_89270
STAVAAALELVDPPGCRNSIPYQNSHAVPWRYTPPNKEEEEATDISSLSAKVTNITGLSGVTRSGRVFAPPDLLIQPTNVKGKATVVEEQDDKMPLTSNEDTPVKGLPEKRDGLWQEGAQQNPGHDLAVGITHELGTSSGSASKGLINNITANNYLAFAEEEIPAKGRGHNKALHILVKCMDHVVAKRDAQKHFGEITV

SEQ ID NO: 180956 - protein, 295 aa, Glycine max
  Coding DNA Sequence Number=SeqID_89271
  Gene Ontology: Mol. function=unspecific monooxygenase activity
  Homolog annotation: Hit_ID=Q5CEG7; Match level="QueryCoverage=35%, HitCoverage=99%, E-value=4e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPWLCRIPLVRTSSELTVRRPGKRPRRARSQSVPRPARDDPLSPRKQLEQSTDSRRVRDWDPRAQPSEPILFPRGCSPWRPDAVMSTTGRGRHSVLRIFKGRRGRTGHHATCGALPAAGPYLRLSRFQGGQAVKQKR

SEQ ID NO: 180957 - protein, 62 aa, Glycine max
  Coding DNA Sequence Number=SeqID_89272
MRAPMFMSMRETRPKISLALSTVRSEVCDVGARLEYERTLHTWAIEFLQPGGSTSSRAAATA

SEQ ID NO: 180958 - protein, 75 aa, Glycine max
  Coding DNA Sequence Number=SeqID_89273
  Subcellular localization annotation: CTP_CleavageSite=37; ConfidenceScore=5.40e-01
MQTLQLFCTRVGINSSFSFLIMVRPVFFGTVATFPSRASEGEAHGCAFQRRKDARSRHQRLFVENVRKTEGNRSK

SEQ ID NO: 180959 - protein, 174 aa, Glycine max
  Coding DNA Sequence Number=SeqID_89274
VYGIKMVIDQSLLFELTHLSSDGVPFEGTLDDEWKFDFSIFDACQLVCTNQADMTGRLLAGSLAFECRIMHYLIVRILLPRSSNLAQISEEELIIMWVFLIGRQIDWAHLVRYRMHKALRSNAPLPYPHLITLFLHHFNVPLDSDPFVKVKRSFSIGANVVSSFGYHKERDGSW

SEQ ID NO: 180960 - protein, 58 aa, Glycine max
  Coding DNA Sequence Number=SeqID_89275
MATARWALKHPVYGIVTLRLGIYPDRPNVSKTTFLNEKLYTVPEFQQTLLTTTKQVPT

SEQ ID NO: 180961 - protein, 164 aa, Glycine max
  Coding DNA Sequence Number=SeqID_89276
MSVAPSFLLLGGAYLHGTVWLFLYGNGIGLTTLGCRGVWGAASLVKCITKGLGFLRPSSSADCMHICCSSPPSSLTSSRPWSIILIGLLLLNMLPCYVRFGPARPTRLDDINSSPSMIGKRVALGLYHFGKRGCWILQGDITAIWLAKRDGKRSSYIIGIRVNS

SEQ ID NO: 180962 - protein, 149 aa, Glycine max
  Coding DNA Sequence Number=SeqID_89277
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=75%, E-value=3e-24, Identity=68%"; Hit description=LacZ protein
  Subcellular localization annotation: CTP_CleavageSite=94; ConfidenceScore=5.03e-01
MAAIQITSLVSMTCWACLSLPLVMGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 180963 - protein, 354 aa, Glycine max
  Coding DNA Sequence Number=SeqID_89278
  Gene Ontology: Mol. function=motor activity; Cellular component=cell projection
  Homolog annotation: Hit_ID=UPI00016621D1; Match level="QueryCoverage =75%, HitCoverage=46%, E-value=2e-17, Identity=29%"; Hit description =UPI00016621D1 related cluster
MPSPLEDYTSSPSEDYTSSPLPSEDYTSSPSEGYMPSPSEDYMLSPLEDYMSSQSEGYMPSPSEDYTSSPSEDYTSSPSEGCMPLPSEGYTPSPSEECMGLHALAFVRLHAVTIRGLHVLSFRGLHALAFRGLHALAIRGLHVLAFRGLHALAIRGLHVLAFKGLHALTFRGIHVLTFRGLPAPAFRGLHILAIRGLGVLAYRGLHALAFRGLHALSFRWLLVVSFRGLHALAFRGLRVLAFRRLHALTCRGLHAFTFRGLDILAFRGLDVLAFRGLHALAFRGLHVLTFRGLHALAFRGLHVLTFRGLHALAFKGRHILNFRVLHALVFRGLCVLTFCGLHIHTLREFKVLCP

SEQ ID NO: 180964 - protein, 305 aa, Glycine max
  Coding DNA Sequence Number=SeqID_89279
  Subcellular localization annotation: CTP_CleavageSite=37; ConfidenceScore=5.19e-01
MAEPSKKRKGSSSTAAAAHRHHRPSEASTAPIHPSLSSTLFSSDDQRLRYLSQFSSRIILEPKFLDVEFFNDETFDCYQVFQNSGLVDFMSLKLPHYPELVKVFYCNLKIQDGIISSEVHGHHCDDWKFDYSSHDARRMVCNDQAEMTAQASKEDLILMWAFLTGHQIDWAHLVRYQMHKALRANAPLPYPQLITLFLRHFQISLDDEPFIQVKRSFAIGVGAVTSFGYRKDRNGQWLKKDALPPQDERTPSPPPQHEDSALLNEVLSKLRGLRSYVGERFDSLDTRFAGMDICLTQVEEDVSFI

SEQ ID NO: 180965 - protein, 263 aa, Glycine max
  Coding DNA Sequence Number=SeqID_89280
  Gene Ontology: Mol. function=aspartic-type endopeptidase activity; Biological process=proteolysis
  Homolog annotation: Hit_ID=A7PT07; Match level="QueryCoverage=99%, HitCoverage=17%, E-value=1e-54, Identity=41%"; Hit description =Chromosome chr8 scaffold_29, whole genome shotgun sequence
MVTRSTSKLINVINEDSDQNSDNITELGSVSEKNINPINSKHWKTPSKLYYQRPAAFDLLLEERGENNFKIFSANNIYEWNIDAQMEYNITNTLQHMTMVAMAYQTSHECSKETIIDILVAGFSGQLKGCAVKTDLNEKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSANGDIPYENLSYGQLISYVQKVALKIC

SEQ ID NO: 180966 - protein, 41 aa, Glycine max
  Coding DNA Sequence Number=SeqID_89281
MWKFFIVLRRSSPFFIRSSFVLRSSTVRPFFGPCEVLGTHH

SEQ ID NO: 180967 - protein, 85 aa, Glycine max
  Coding DNA Sequence Number=SeqID_89282
MDTSVPYTGAIRGTVHKPQANLGADQKFSLEKTPEVHTCTFEKKTHPTRSSWKMPKDNCDSRVHLMLIAHENILRIPFKSNDSLR

SEQ ID NO: 180968 - protein, 128 aa, Glycine max
  Coding DNA Sequence Number=SeqID_89283
MRHVKHEGHRTKCDYLMWQWGVIIGPNLGPWAQKSTLRFMRTLGPSFAALAQSSWSLLLMDLVTGPFLGRIASGYIALQMRTAWRTKWMVELEYPETQSSVGFYSKNPFASSMVLPFEGFFGSFDRWK

SEQ ID NO: 180969 - protein, 208 aa, Glycine max
  Coding DNA Sequence Number=SeqID_89284
  Homolog annotation: Hit_ID=A5AG41; Match level="QueryCoverage=50%, HitCoverage=9%, E-value=4e-08, Identity=33%"; Hit description =Putative uncharacterized protein
  Pfam annotation: Domain name=zf-CCHC; Domain location=160-177; Score =13.0; E_value=0.016; Accession=PF00098.14; Description=Zinc knuckle
MKTVKITVDGTNDQGTPKWIEVKSHVQSGGYECGYYVTHWMWNISLNEELHDYYEGRHRSHLRPHSHRREKERKPQEANINLPYFHWKDNVEANLDWKIRVEQQLKRKSTSKSYGSHSYPKKDQGQGILRVTPSKPKDDKGKTIEKQPLKASMQEKTSSMKCFKYLGKGHITSQCPTKKTMIMRGQDIYSSQDEATISPSSSESEEAK

SEQ ID NO: 180970 - protein, 90 aa, Glycine max
  Coding DNA Sequence Number=SeqID_89285
  Gene Ontology: Mol. function=zinc ion binding; Cellular component =nucleus; Biological process=nucleotide-excision repair, DNA damage removal
  Homolog annotation: Hit_ID=A7P203; Match level="QueryCoverage=98%, HitCoverage=21%, E-value=2e-27, Identity=66%"; Hit description =Chromosome chr19 scaffold_4, whole genome shotgun sequence
  Pfam annotation: Domain name=PNK3P; Domain location=2-89; Score=29.3; E_value=6.7e-12; Accession=PF08645.2; Description=Polynucleotide kinase 3 phosphatase
MNIKSHVFIACGVGSKSGKVNKKEDDPFRKPKPGMWHLMEQHFNSGIAIDMDKSFFVGDAAGRESDHSVADIKFAEAIGLKFYVPEEYFA

SEQ ID NO: 180971 - protein, 459 aa, Glycine max
  Coding DNA Sequence Number=SeqID_89286
  Gene Ontology: Mol. function=protein heterodimerization activity; Cellular component=soluble fraction; Biological process=regulation of GTPase activity
  Homolog annotation: Hit_ID=A7P201; Match level="QueryCoverage=99%, HitCoverage=100%, E-value=0.0, Identity=71%"; Hit description =Chromosome chr19 scaffold_4, whole genome shotgun sequence
MARRSYKTELGCIACEELGELGAGKPHWLVETPQLLCAIDTHSLILANRSTILLLSWSSDSSAAPPPLKIRPDLSPIDAESISALEWLAFRDHRVIVAGTSSGNVLFYSLRGELIHRQMIYPSRVLKLRVRGTKKDLIQDTSSEEFCLIMSGVIAHFDGSDIQNMLQKWFEESHSRFWDQNPKSHDSEDFGNTDVKIPYQLWNIGKYGTCAEAAITGIMPPPLMEQQQSSQRYYCAVAVGEDAVISAYRLSENKGRSLVGAILSKVVPATFSTISSFSKLIWRSEQSSPKKSDQKPQPFARASPLTCLKDHPRKGEKLTLSPSGTLAAITDSLGRILLLDTQALVVVRLWKGYRDASCLFMEMLVNKDIASSSSSYSEPLKSDYCLCLAIHAPRKGIIEIWQMRTGPRLRTISCAKGSKMLQPSYRFGASMSSPYVPLEVFLLNGDSGQISVLNRTLDS

SEQ ID NO: 180972 - protein, 82 aa, Glycine max
  Coding DNA Sequence Number=SeqID_89287
MARMEREEWSERSAARGSNFSKKPVEKASQRSHEEASRGSLLMKLLEKATCSCLGKNAAQPSLTVGSSRNLVLNFTRQLSMI

SEQ ID NO: 180973 - protein, 204 aa, Glycine max
  Coding DNA Sequence Number=SeqID_89288
  Gene Ontology: Mol. function=zinc ion binding; Cellular component =nucleus
  Homolog annotation: Hit_ID=A7P203; Match level="QueryCoverage=52%, HitCoverage=26%, E-value=5e-17, Identity=42%"; Hit description =Chromosome chr19 scaffold_4, whole genome shotgun sequence
  Pfam annotation: Domain name=zf-PARP; Domain location=55-131; Score =51.2; E_value=3.7e-12; Accession=PF00645.9; Description=Poly(ADP -ribose) polymerase and DNA-Ligase Zn-finger region
  Subcellular localization annotation: CTP_CleavageSite=53; ConfidenceScore=5.34e-01
MLRIPNFIAVNVRHRLRNFPNPIPFLLSVSVAASLPPLRNRSPSQMAARESMMADYAKSGKSSCRACSQKIEAKALRLASVSKGNGPYDIVKWHHLRCFPLSSHSHSSPESIRGFSSLKSSDQEALKKLFAENNKSEEKVNEAVEDVRNELQETGERGSKRLRIIILSKAVRSLEAFKSSDQEALKKLFAENNKSEEKVITQLD

SEQ ID NO: 180974 - protein, 413 aa, Glycine max
  Coding DNA Sequence Number=SeqID_89289
  Homolog annotation: Hit_ID=Q2HW90; Match level="QueryCoverage=43%, HitCoverage=41%, E-value=9e-18, Identity=31%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEEILGCPLGGRKPYLSSGCLPSLSRNCNCGQGFSKRGMANQGDWVPFMDVLALLIFGVVLFPNVDGLVDLAAIDAFLAYHHSKESPVVAVLADLFDTFDRRKGKNESFSHVEDTQTFAGRNEGDLGAQNSKTIQRIHKAWETPLRKDQELRGIRNGIIGGYHEWLKVHIRGLDWLAKLKVVSEENFEAPEEDEEVQALKSELGKAKLANEKFKLAATHVRKECAGLREENAITARALEQETKRARKEEYGRNKFRGALWGSNSELKLRREERDQSRAHSMVLKEELVACSRSKRSLSQRLCETETNMLAIIAKYIKLIDTVDLEGGP

SEQ ID NO: 180975 - protein, 76 aa, Glycine max
  Coding DNA Sequence Number=SeqID_89290
MAAEWRRKRERRRHFKEKMSLEEAHHHRRPWIRAWRKKEMNEGRGREEHEILCSKRALKSEPTNPRSIPRFSTKYA

SEQ ID NO: 180976 - protein, 302 aa, Glycine max
  Coding DNA Sequence Number=SeqID_89291
  Homolog annotation: Hit_ID=Q6WAY6; Match level="QueryCoverage=67%, HitCoverage=37%, E-value=1e-12, Identity=27%"; Hit description =Putative uncharacterized protein
MGTNQNGKRFYQVKVKSLDVTSLKELGRLMGPLQRKAFRKVYGKILDLTAAEVFTEAPRIPRPILWPIVEVFHVWGLPNGGSAINWFPRWKEGKEGVLFSCGDYPNVPLIGTRGCINYNPALAIRQLGYPMRGAPTEGSLSPFLVKDLGAQGLKVIQRIHKAWRSPLRKDKELRGIRNGVIRGYHGWLRIHTRGLDWLSKLKVIDEENFEAPKEDEEVRALKLELGKARLAKEKFKSAATHIRKECTELQEENAATAKALEQETKRARKEEYGQEKFRGELWGSNNELKLQKRKEIGHGCMA

SEQ ID NO: 180977 - protein, 100 aa, Glycine max
  Coding DNA Sequence Number=SeqID_89292
MPNQPQRPLQNHPQNPFLHIPDRVEIPTPMQTPTQGGTFQKENPRSSPRYQCRMPTCYHLSLATKWMWLGGEHSGRMEVLRAEADRGCVDFQAVHIGNIA

SEQ ID NO: 180978 - protein, 93 aa, Glycine max
  Coding DNA Sequence Number=SeqID_89293
MMTLCKSRRRYQREIIEISVGNLDTSRRIAQSVSLGLERKCTTHVSNTMQGFLTIQTISPNEKFVFMENKVKAPVEAFRTYRLKLDTGHHLDL

SEQ ID NO: 180979 - protein, 49 aa, Glycine max
  Coding DNA Sequence Number=SeqID_89294
MKLASTDLRSNPLQRGGDDAILPRKGPVTRAMSKRLQEDWARAAEEALG

SEQ ID NO: 180980 - protein, 105 aa, Glycine max
  Coding DNA Sequence Number=SeqID_89295
VDPWVLVPITLRGLHALTFGGLHVLAFRGLHVIALRWLHAFAFAFRGLHALAFRGLHTLPFKGQHVLAFRGLQALRLQRATRPRLQRTTRPRLQRTTRPHLQRST

SEQ ID NO: 180981 - protein, 267 aa, Glycine max
  Coding DNA Sequence Number=SeqID_89296
  Gene Ontology: Mol. function=phosphoserine transaminase activity; Cellular component=cytoplasm; Biological process=amino acid biosynthetic process
  Homolog annotation: Hit_ID=A4W8S7; Match level="QueryCoverage=100%, HitCoverage=73%, E-value=1e-146, Identity=93%"; Hit description =Phosphoserine aminotransferase
  Pfam annotation: Domain name=Aminotran_5; Domain location=4-267; Score=79.0; E_value=1.5e-20; Accession=PF00266.10; Description =Aminotransferase class-V
MAQVFNFSSGPAMLPADVLKQAQQELCDWNGLGTSVMEISHRGKEFIQVAEEAEKDFRDLLNIPSNYKVLFCHGGGRGQFAGVPLNILGDKTTADYVDAGYWAASAVKEAHKYCTPNVIDAKVTVDGLRAVKPMSEWQLSDNAAYLHYCPNETIDGIAIDETPNFASDVVVAADFSSTILSAPIDVSRYGVIYAGAQKNIGPAGLTIVIVREDLLGKAHTSCPSILDYTVLNDNDSMFNTPPTFAWYLSGLVFKWLKQNGGVAQMDK

SEQ ID NO: 180982 - protein, 212 aa, Glycine max
  Coding DNA Sequence Number=SeqID_89297
  Homolog annotation: Hit_ID=Q6UUU1; Match level="QueryCoverage=28%, HitCoverage=40%, E-value=2e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLGIRCMGYCSGACKKYSNERTHAIYVGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 180983 - protein, 35 aa, Glycine max
  Coding DNA Sequence Number=SeqID_89298
MTGDASKFTHISLKKSRHVTYGDNNKGRILGVGKI

SEQ ID NO: 180984 - protein, 66 aa, Glycine max
  Coding DNA Sequence Number=SeqID_89299
MCFPDLEVAATPEEEPRSSKASSSFPIAGHSHIEPVEDPIMAEEPRRVTLEDYSSSTVPQFFTSIA

SEQ ID NO: 180985 - protein, 165 aa, Glycine max
  Coding DNA Sequence Number=SeqID_89300
  Homolog annotation: Hit_ID=Q6UUU1; Match level="QueryCoverage=64%, HitCoverage=95%, E-value=1e-22, Identity=47%"; Hit description =Putative uncharacterized protein
LIKDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVLPFGLPVSFRCYGRVCLIPRLTLSS

SEQ ID NO: 180986 - protein, 397 aa, Glycine max
  Coding DNA Sequence Number=SeqID_89301
AKEKFKLAATHIRKECAGLREENAITARALEQETKRARKEEYGRNKFRGALWGSNSELKLRREERDQSRAHSMVLKEELVACSRSKRSLSQRLCETETNMLAIIAKYQEELGLATAHEHRIADEYAQVYAEKEARGRVIDSLHQEAIIWMDRFALTLNGSQELPRLLANAKAMADTYSAPEEIHGLLGYCQHMIDFNGPRKNTITKRAARDPYRTRSKSRTMGDQEETQEQMKADMSALKEQMASMMEAMLRRGRDTLGHDGSPHLGYNRAAYPYGLPPNYSPPVLQEDAGHIASPVHEREPPQQPDEVHKDPQDYARRDVEFYPPIPEGPAPGTLPQPNIAVPPIVLSMEGPPPATEERRKLDLLEERLRAVEGFGDYPFADMTDLCLVPDVVIPR

SEQ ID NO: 180987 - protein, 120 aa, Glycine max
  Coding DNA Sequence Number=SeqID_89302
MGQDPFVLLRIAMMLPLERRKWDKELTSFDEGNTDVAIMKEFYANLYDPEDKSPKQVRVRGHLVKFDVDTLNTFLKTPVIIEEGETLSAYSRFALLRLDPQELAAKLCIPGRGFELNADS

SEQ ID NO: 180988 - protein, 216 aa, Glycine max
  Coding DNA Sequence Number=SeqID_89303
MRGQDIYSSQDEATTSPSSSESEEAKGGESSEEIYPQEEGQPLMVKEECKEVSVSSKRLAKKERHFEIKTNIKEISLLRKPPHFLLCKKTLVSIATSLRFEFIPQVKELLDEGLVRKRLNPCALLVPKIGIIRHQIPKIGGVITVLGGATLFCKITRAPNIFMICVHRDSLGRNNQHENTEKGVPMNPKRIKVIPEWPAPPSVLRKKAQRFKNLGI

SEQ ID NO: 180989 - protein, 180 aa, Glycine max
  Coding DNA Sequence Number=SeqID_89304
  Homolog annotation: Hit_ID=Q6WAY3; Match level="QueryCoverage=80%, HitCoverage=5%, E-value=2e-07, Identity=29%"; Hit description =Gag/pol polyprotein
  Pfam annotation: Domain name=G-patch; Domain location=2-43; Score =26.4; E_value=0.00011; Accession=PF01585.14; Description=G-patch domain
MMVARVMLGYGYEPEMGLGKNNGGRTSLVSTRGNRGKFGLGYKPMQADIRKSVAKRKSRGQSSQLGQQVEGVLPCYISRSFIGAGLGHEGQVIAICEDDSPSRSDLVLSCPPGFRLGNWRVEERPGIYATSIISDDESLEGTNTWDPTTDFKQEAGQMESEEDEDVGLPLELEKIVAQED

SEQ ID NO: 180990 - protein, 119 aa, Glycine max
  Coding DNA Sequence Number=SeqID_89305
IYGGAHESGCCIPLEDTAKEVNYMGNQHGPGFNTGGFVGYQQGAHFNQNQGKWRTTKLKETLAQFMQVSMSNHKSTEFAIKNLEIQVRQLAKHIAENSFGGFGANTEKNPKEECKAIIT

SEQ ID NO: 180991 - protein, 129 aa, Glycine max
  Coding DNA Sequence Number=SeqID_89306
  Homolog annotation: Hit_ID=UPI00016621D1; Match level="QueryCoverage =83%, HitCoverage=39%, E-value=1e-10, Identity=38%"; Hit description =UPI00016621D1 related cluster
MTGPLDESISCFLIRLNPWVHVLTFRGLHVLTFRGIHILTFKGLHVLTFRGLHVLTFRGLHALAFRGLDVLAVKGLDVLAFRGLDVLTFRGLHVLHFRGLHVLAYRGLRALTFSGLHICALREFKVLCP

SEQ ID NO: 180992 - protein, 132 aa, Glycine max
  Coding DNA Sequence Number=SeqID_89307
  Homolog annotation: Hit_ID=O52175; Match level="QueryCoverage=62%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHPLAAATGIDLES

SEQ ID NO: 180993 - protein, 49 aa, Glycine max
  Coding DNA Sequence Number=SeqID_89308
NSLKDEDAGFQDKDSAPKNETKVEELEQSKEISTTPPKDLPREWRTQKV

SEQ ID NO: 180994 - protein, 200 aa, Glycine max
  Coding DNA Sequence Number=SeqID_89309
  Gene Ontology: Mol. function=DNA binding; Cellular component =cytoplasm; Biological process=regulation of transcription, DNA -dependent
  Homolog annotation: Hit_ID=A9P928; Match level="QueryCoverage=79%, HitCoverage=66%, E-value=2e-36, Identity=47%"; Hit description =Putative uncharacterized protein
MFMINKQGHQNEESNLGLEMMILKRGEDYIEVLCGATNKKYGDYVGRLKINNEGQYFITCECCPECPLVNVTLEAFEKHALREGSGRWKRNIWVHCEDEDKVPLWKTPLIKYYTHQANVANRKDSAMRKQNFHRDEFLRCTRCGKERRFHLKSRPDIKNYHDASNNKCWNCSLWPYQNWYLVLQNTLYAGKRYWGLTMCQ

SEQ ID NO: 180995 - protein, 201 aa, Glycine max
  Coding DNA Sequence Number=SeqID_89310
  Homolog annotation: Hit_ID=Q2HST2; Match level="QueryCoverage=49%, HitCoverage=17%, E-value=2e-08, Identity=36%"; Hit description =Peptidase aspartic, active site
  Pfam annotation: Domain name=G-patch; Domain location=105-158; Score =18.7; E_value=0.001; Accession=PF01585.14; Description=G-patch domain
MDHIVAKVLIDNGSSLNVMPKSTLEKLPFNASHLKPSSMVVRAFDGTRREDEEDILVSCPSSMPYVEAAEESLETAFQSFEVVSISSVDSLFGQPCLSDAAVMMARVMLGNGYEPGMGLGKNNGGITSLINTQGNRGNEGSPPCHISRSFISAGLGDEGQVFAICEDDVPSTSDLVRPCPPDFQLGNWRVEERPGIYATSI

SEQ ID NO: 180996 - protein, 93 aa, Glycine max
  Coding DNA Sequence Number=SeqID_89311
MSTTGRGRHSVLRIFKGRRGRTGHHATCGALPAAGPYLRLSPPPGSAPTTAPPGLAPWVLQRPPRPPTHRGLVLAPTAGYRSRALAPSIFGAS

SEQ ID NO: 180997 - protein, 119 aa, Glycine max
  Coding DNA Sequence Number=SeqID_89312
  Subcellular localization annotation: CTP_CleavageSite=52; ConfidenceScore=5.04e-01
MEAIKEQMATMIKAMMSMKKIMEANDKWPLLSAVAKVNPMLPSGLKQMNRPTSNMLTSSLGSDMPLKGKQLVVYPFENTLESPQFPPQPQPLHFCGGKSPSCYGRKGKDGSSKGKAQGH

SEQ ID NO: 180998 - protein, 137 aa, Glycine max
  Coding DNA Sequence Number=SeqID_89313
  Homolog annotation: Hit_ID=Q6UUU1; Match level="QueryCoverage=68%, HitCoverage=56%, E-value=4e-19, Identity=57%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQTIKIPGVSPAAPRALSCSCLSVNGVIP

SEQ ID NO: 180999 - protein, 145 aa, Glycine max
  Coding DNA Sequence Number=SeqID_89314
MIDTSKPYTGAMRGTVHEPQVNIGVDQKGLHVLANRGLHALTLRGLCVLTFRGLHVLTFRGLHALAIRGLRPHLQRATHPRHSEDSVLTFRGTTRPRHQRTTRPRLQRVHVLTIRGLHALTSRGLHVLALRGLPDLALGTSKTQR

SEQ ID NO: 181000 - protein, 137 aa, Glycine max
  Coding DNA Sequence Number=SeqID_89315
  Gene Ontology: Mol. function=motor activity; Cellular component=cell projection
  Homolog annotation: Hit_ID=UPI00016621D1; Match level="QueryCoverage =84%, HitCoverage=39%, E-value=4e-14, Identity=42%"; Hit description =UPI00016621D1 related cluster
MIGPLDESISCFLIRVDPWVHALAFRGLHILTFRGLHVLTFRGLHVLTFRGLHVLTFKGLHVLTFRGLHVLTFRGLHVLTFRGVHVLTFRGLDVLAFRGLHVLHFRGLHVLAFRGLRALAFSGLHIRTLREFKVLYP

SEQ ID NO: 181001 - protein, 96 aa, Glycine max
  Coding DNA Sequence Number=SeqID_89316
MDFMGETFVVEWTIFVGWAPDWEEFRCWLNNCTNAGNMAEVMAWASPSFFLAPPILDLLLLVLVETNTGNVSTIMVIISLSIMGGATWAAKSLHLY

SEQ ID NO: 181002 - protein, 57 aa, Glycine max
  Coding DNA Sequence Number=SeqID_89317
QNRGEACHLARPGELSSPRRAQLAQASKVASSRSNSLLEEGSGRPKWARLLLAPHFY

SEQ ID NO: 181003 - protein, 70 aa, Glycine max
  Coding DNA Sequence Number=SeqID_89318
MLGPLVSNKGLEVDMAKIDEVHPGLQQSCIGLVQPLLEGCGVCLSSTMSSGGGLLGAEKEAYHNSHNSST

SEQ ID NO: 181004 - protein, 252 aa, Glycine max
  Coding DNA Sequence Number=SeqID_89319
MVIEQSLFHNLTQLSSDGVPFEGTMNDDWKFDFSAYDARQLVCTNHADMNGRLFAGSLAFESRILHYLIVRILLPRSSNLAQVSEEDLVIMWAFHTECQLDWAHLVRYRMHKALRLNAPLPYPHLVTLFLRHFQIPLDSEPYVPIKRSFLIGAAVIASFGYRKEHDGSWVKKGTQPADDEGNLPVEDNSSLLRRLLDKFDGLQTFVGDKFDTMELQVDMRFDAMDSRITKVEEDVSFIRTCFDPPPPPPSSS

SEQ ID NO: 181005 - protein, 116 aa, Glycine max
  Coding DNA Sequence Number=SeqID_89320
MATSKYLTAPGAFDSSPSVSIHHMAKGQRELKLWILSRGVHGMPMNCEVEDVYPECQQKVVGAHHFGCKGASFGLKVANPFMKFSRDIVCLVYAESLEGLLDDSLEVPSVFWCWPA

SEQ ID NO: 181006 - protein, 31 aa, Glycine max
  Coding DNA Sequence Number=SeqID_89321
MEVSPMPGNVIMDSMTVHGLYTKQETVTSQS

SEQ ID NO: 181007 - protein, 166 aa, Glycine max
  Coding DNA Sequence Number=SeqID_89322
MIMRSQDIYSSQDEATTSPSSSESEEAKGEESSEEIYPQEEGQPLMVKEECKEVSVSSKRLVKKESHFEIKTNIKETSPLRQPPHLFLCKKTLVSTATPLGLEVIPQVKELLDEGLVRKSLNPCALLVPKIGVEGRNPKYEEPRDLRSNPFQGGGDDAILPPKGIG

SEQ ID NO: 181008 - protein, 45 aa, Glycine max
  Coding DNA Sequence Number=SeqID_89323
MPHQGEDESRTSSPPQEAIYKSLKVGEDEWKEKERRSTKFYASNE

SEQ ID NO: 181009 - protein, 163 aa, Glycine max
  Coding DNA Sequence Number=SeqID_89324
MGDQEETQEQMKADMSALKEQMASMMEAMLGMRQLMEKNAATAVAVSSAAEADPTLLATAHHLPSNIVGRGRDTLGHDGNPHLGYNRVAYPYGLPPNYSPPVLQDDAGHIASPILEREPPQQPNEVHKDPKDYARRDVEFYPPIPEGPAPSTLPQTSIMTQPI

SEQ ID NO: 181010 - protein, 56 aa, Glycine max
  Coding DNA Sequence Number=SeqID_89325
MESGFLLKSSGDMQARRRIRFFFVGREAIKFDGVGKCRGSTGRDINRSNDVPLERN

SEQ ID NO: 181011 - protein, 77 aa, Glycine max
  Coding DNA Sequence Number=SeqID_89326
MGPKLRRAFVVKKGFSGGALVLTNMDGEELPSPGQDHLELPSGVETKHEQQKPIKVHRDGCEWGWGHDRPIVAPSLR

SEQ ID NO: 181012 - protein, 163 aa, Glycine max
  Coding DNA Sequence Number=SeqID_89327
  Homolog annotation: Hit_ID=Q6WAY4; Match level="QueryCoverage=49%, HitCoverage=14%, E-value=7e-08, Identity=38%"; Hit description =Putative uncharacterized protein
MGSSQAPWLKKRFYQVNIKSLGVASLKELGQLMGQLQRQAFRKAYGKIWDLTLAEIFTEAAASLAQYYDQPLRCFTFGDFQLTPTVEEFEEILGCPLGGRKPNWIGESKSKMGWLEYQGNVWKQRREPLQVKTNSPVHGRPGALDLRSGPLSKYGWVGGPGSD

SEQ ID NO: 181013 - protein, 127 aa, Glycine max; identical to SEQ ID NO: 113154
  Coding DNA Sequence Number=SeqID_89328

SEQ ID NO: 181014 - protein, 56 aa, Glycine max
  Coding DNA Sequence Number=SeqID_89329
MEISSFHQFSDESLSEVLDRFHRLLMKMPTHGTVNRRDDQAMDTGGGNGTPRRHGG

SEQ ID NO: 181015 - protein, 143 aa, Glycine max
  Coding DNA Sequence Number=SeqID_89330
  Homolog annotation: Hit_ID=Q6UUU1; Match level="QueryCoverage=74%, HitCoverage=90%, E-value=5e-31, Identity=58%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRGFPLAAPSCALLFLPFGLPGVIPAVMA

SEQ ID NO: 181016 - protein, 154 aa, Glycine max
  Coding DNA Sequence Number=SeqID_89331
  Homolog annotation: Hit_ID=A5B4R8; Match level="QueryCoverage=73%, HitCoverage=8%, E-value=1e-11, Identity=29%"; Hit description =Putative uncharacterized protein
  Pfam annotation: Domain name=zf-CCHC; Domain location=4-21; Score =24.1; E_value=0.00034; Accession=PF00098.14; Description=Zinc knuckle
MSNIQCYYCGENGHMQVRCKQMKEDLKKLRDMNKDGTNSQANVVKSVEDEDDMVLAKNDEIAKTKWVMDSAASKHICRDQEMFDTLKTDGEFSHFKLGNGGKMKVEGIGSMRMKFHDVLKRNHDSKVKKKVKFSNVVEVLGDTSVRGGVCSLSN

SEQ ID NO: 181017 - protein, 135 aa, Glycine max
  Coding DNA Sequence Number=SeqID_89332
  Homolog annotation: Hit_ID=A5AWV0; Match level="QueryCoverage=62%, HitCoverage=5%, E-value=3e-09, Identity=38%"; Hit description =Putative uncharacterized protein
MKNWMQNSKRDVYLGVYLNGAHWQMVVILPKENLIVWFCSLHNRPDNYLKGIINSALKGLDDTPQPKSKVGARWIIVKCNRQKGSTECGYYVMHWMSTIILGSFKNNWEITIGIRDIKALCILWAKYYLKVRNET

SEQ ID NO: 181018 - protein, 60 aa, Glycine max
  Coding DNA Sequence Number=SeqID_89333
MGLSPPIPLKIIEATRSNTMKTMIMRGQDIYSSQDEATTSPSSSESEEAKVEESSEEIYP

SEQ ID NO: 181019 - protein, 268 aa, Glycine max
  Coding DNA Sequence Number=SeqID_89334
MNILTAHDQGWEQELSPYNQYEKERTPNLESVFEEFMAYHASSKANQNSMKNHEIHFGTSYSIENFQGEPELQPYYQNEVERGSNLDKLLMQFKETTKSTQRALQSVEIQVEAQEENPVKKHESREKDEEQAHQQWEKYSTVENNPESILQINNLPHQRIDKKRRQGEHEETLSAILEMFWIVLPFYMKFTEFLAKRRNCKEDVFYVTPFAKCKPCTKRIFVHALICKSQALSAQPLHLRLIWSAKLAKVELSQLKFDLNSAKLQPDR

SEQ ID NO: 181020 - protein, 132 aa, Glycine max
  Coding DNA Sequence Number=SeqID_89335
  Homolog annotation: Hit_ID=A3NYJ0; Match level="QueryCoverage=98%, HitCoverage=27%, E-value=1e-30, Identity=48%"; Hit description =Metallo-beta-lactamase family protein
MVNQYPDLPGKDELGMGVKVFLGEMNWDLKSPYPAIGRKIEVDFGKGKFVLDYKDNKTMSFSGTEAFKGISDTVEYTATEIAKNIFMVYWHEPKTGENVTHIQDYNKNIIYTNIAGKNGSFDHFKVPFKILK

SEQ ID NO: 181021 - protein, 200 aa, Glycine max
  Coding DNA Sequence Number=SeqID_89336
MGSTRRPLPSYYAHWGWISPGPLPGGGDHNSDLPLPKCQLVYAILTRMNVHVAQLIADTIYLFAALITSLCQSFEVPVTPSKVIRPPITWAFIEKYCTPRQAQDAPPPPHQADPAGSLGMGSIYSTWFAKAANHRGQGQGFAPFACPTPEQFGVEVAWPGDWPEAQVGEAPAGSPSDAEEARIDEEMTELLGFLGGRGAT

SEQ ID NO: 181022 - protein, 162 aa, Glycine max
  Coding DNA Sequence Number=SeqID_89337
  Subcellular localization annotation: CTP_CleavageSite=43; ConfidenceScore=5.11e-01
MMHTPDSTLRCNVVRTNNQIPGNSLTMNMGKSKCSKTMDQLKRLSIPSKMLRFFNHACHPRLGPFDKVSALYPPMNIHYIRGMNVAQSKCQRPWKVSALRPPTNIHNIPTYERGPKQVPKTLEGQCTSPPTNIHNMHMPMHFQHQSTFHFHVILNINIISSQ

SEQ ID NO: 181023 - protein, 170 aa, Glycine max
  Coding DNA Sequence Number=SeqID_89338
MTQELVARGDTLRLSAPRHSVTPSVIDEQRPIWSSAPFPEMSSFSDGDFSSLTSYQETTGGGPDDTRRYLYGYPHPFCHPEAAGPMTSRDQVWSFCTLVSSRGGGPDDTRRYLTVIRTLLSSRGGGPDDTRRYLTVIRTLLSSRGGGPDDKQRPSLVILHPCIIQRRRAR

SEQ ID NO: 181024 - protein, 201 aa, Glycine max
  Coding DNA Sequence Number=SeqID_89339
MSALKEQMAFMMDAMLGIRQLMENNMATTAVVSSAAEADPTLPTITHHPLPNVGYNRVAYPYGLPPNYMPPVMRDEAGHVPSPILEREPPRQSDEVHEDRREYAQGDIDFYPPVPVEGPAPNTLPQPNLPAQPIFLSTEGPPPAAEERRKLDLIEERLRAVEGFGDYPFANMADLWLVPDVVIPPKFKVPNFDKYKGRLVL

SEQ ID NO: 181025 - protein, 165 aa, Glycine max
  Coding DNA Sequence Number=SeqID_89340
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MQLARQGTKAGTGPPLEVDGIDKLDSGIRNKGPDGRKMYLEVRKTIEGEKEIAKRPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 181026 - protein, 53 aa, Glycine max
  Coding DNA Sequence Number=SeqID_89341
THLLLEVASPLSFPFSIPLPFIFQEAKESIDEEDPRPTSSNGACIKVHNQNPD

SEQ ID NO: 181027 - protein, 254 aa, Glycine max
  Coding DNA Sequence Number=SeqID_89342
  Gene Ontology: Mol. function=unfolded protein binding; Cellular component=cytoplasm; Biological process=cellular protein metabolic process
  Homolog annotation: Hit_ID=Q6UUU1; Match level="QueryCoverage=26%, HitCoverage=51%, E-value=3e-11, Identity=53%"; Hit description =Putative uncharacterized protein
  Subcellular localization annotation: CTP_CleavageSite=42; ConfidenceScore=5.15e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLNSIDSPASASQTAGITGTSHHAQLIFAFLVETGFHHVGSSLSIPSTSRGGPVPAFVPFSEVGKPVVPAALMNRPTRGERRFAYWALAECILAYYVGTDEGVSEVLHVAGEKRAAPDIFRFLAHWTRYARSFDCGERKWLTNGGGDFLEDARKILNRE

SEQ ID NO: 181028 - protein, 68 aa, Glycine max
  Coding DNA Sequence Number=SeqID_89343
MLFIGCIAHCILSLRGLHSLTLRGLHALTFRGLRVLIFSVLHIHTLREFKVLCPQMLNRDLHSRLRGQ

SEQ ID NO: 181029 - protein, 151 aa, Glycine max
  Coding DNA Sequence Number=SeqID_89344
  Homolog annotation: Hit_ID=Q6UUU1; Match level="QueryCoverage=39%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGGFPPGGSLVRSPVFLPFGLPVVIPLLWPLLSSFPALDTQVP

SEQ ID NO: 181030 - protein, 84 aa, Glycine max
  Coding DNA Sequence Number=SeqID_89345
MSNHKSTESALKNLEVQEECKAVMTRSKRFVKAEDEDSVVHKKKTVDKKGTDGKKNEERGESNQEKEEQIMVKKKELKDQEKGK

SEQ ID NO: 181031 - protein, 28 aa, Glycine max
  Coding DNA Sequence Number=SeqID_89346
MEKNEETTIEEKRKIKEKMRDKVSSTRE

SEQ ID NO: 181032 - protein, 210 aa, Glycine max
  Coding DNA Sequence Number=SeqID_89347
MWMDFQKASTFDYDGSDNVEHRDVDQVLCLVRKYQFDDACVYFTNDANNTYNLKKMTEDQMLAHVTQFHEARQKRKAEEEEIVVVTMKDVASIQAEAFAKVVDETIVCGVIIDLTNTGVMNETPKASNATIAYEVEHNVIEPASKQSITSNEATSRDKGEPDVVIVYSTNSGPTPLNYAQPTTATRDQVQDMIGQRLDIHGNSVEVTSSS

SEQ ID NO: 181033 - protein, 40 aa, Glycine max
  Coding DNA Sequence Number=SeqID_89348
MDKSLKVREDEWKEKERRSTKFCASNEGGTFEEIDPWKIF

SEQ ID NO: 181034 - protein, 54 aa, Glycine max
  Coding DNA Sequence Number=SeqID_89349
MSWNFTDSLTMGVKFLEAVERRLYDIKQWSPDEIRRLSFIDFGEGSIMGSTLIP

SEQ ID NO: 181035 - protein, 173 aa, Glycine max
  Coding DNA Sequence Number=SeqID_89350
MAPKKLSTKRSRRDATGEGSSAASEFDSHCFQSAKHQQRFEAIKGWSFHRERRVQLMEDEYPDFQGEIARRHWPRLVTPMAKFDPEIEDQQCEFSQRRSQENGFDEEAIAQLLCIPGQDFTRTAAKRRVRIMRTSMTTLTQIWMTLLLNNVLPSDHNSDLPLPKCQLVYVILT

SEQ ID NO: 181036 - protein, 152 aa, Glycine max
  Coding DNA Sequence Number=SeqID_89351
MISVNPNSRSQVAGGDTQVVIGTKRFLLILTREVRWQAEIPYETASPMTCGDTQVVICTNQLLLISTREFRWLAEIPQVVIHTNALLLILTREVRCQAEIPQVVIRTRTVLLPRPVRSQAAYGDALYGNPHTFRRQQCLHLKNFNIFFPCAS

SEQ ID NO: 181037 - protein, 73 aa, Glycine max
  Coding DNA Sequence Number=SeqID_89352
MEGDIDLILDLTPKEEKRIEGLKRLNNSLLDIILVKKETFHWLPLASKVMPFIGGLPLLRKEGFMGSSSRVLE

SEQ ID NO: 181038 - protein, 108 aa, Glycine max
  Coding DNA Sequence Number=SeqID_89353
MRLHCYQASQRPSMTTDRPPLLMAHIDPGIGPNISMCVQSCSSPRQAGARPGELKLSAEAMSSPRLSGFLTMKLFGGPGKPEASLGELGSRKTKEKTLLPLFLVFSHS

SEQ ID NO: 181039 - protein, 162 aa, Glycine max
  Coding DNA Sequence Number=SeqID_89354
  Gene Ontology: Mol. function=oxidoreductase activity, acting on the CH-OH group of donors, NAD or NADP as acceptor; Cellular component =endoplasmic reticulum membrane; Biological process=isoprenoid biosynthetic process
  Homolog annotation: Hit_ID=A7P8T6; Match level="QueryCoverage=52%, HitCoverage=14%, E-value=2e-33, Identity=82%"; Hit description =Chromosome chr3 scaffold_8, whole genome shotgun sequence
  Pfam annotation: Domain name=HMG-CoA_red; Domain location=13-160; Score=-179.5; E_value=9.1e-12; Accession=PF00368.9; Description =Hydroxymethylglutaryl-coenzyme A reductase
  Pfam annotation: Domain name=Ribosomal_L21p; Domain location=7-77; Score=50.5; E_value=6e-12; Accession=PF00829.12; Description =Ribosomal prokaryotic L21 protein
  Pfam module annotation: Pfam domain module=HMG-CoA_red::Ribosomal _L21p; Domain location=13-160::7-77
MTPTCNFKVSYTKIALHKVLLVGTDTSCYIGKPIVTNVVVYATLKEKGLEPKVIVFKYKRKKHYRKNIGHRQKPTAVNWIEGRGKLVVCEAIIKEELVQKVLKTNVSALVQLNMLKNLVGSVVSDAIGGFNAHASNIVSAIFIATGQDPAQKVESSCNALKF

SEQ ID NO: 181040 - protein, 62 aa, Glycine max
  Coding DNA Sequence Number=SeqID_89355
MGYIAPEWLRNAPITAKVDKYNFGAKECTVLPVGVAIIAITSKHSNNASVPAINALQFTYLN

SEQ ID NO: 181041 - protein, 175 aa, Glycine max
  Coding DNA Sequence Number=SeqID_89356
  Homolog annotation: Hit_ID=Q6UUU1; Match level="QueryCoverage=61%, HitCoverage=95%, E-value=4e-21, Identity=47%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLFGLPVSFRCYGPRLVSFPRPDTQFRVGSSAPKLGLYARTPPFSPTAAPYS

SEQ ID NO: 181042 - protein, 64 aa, Glycine max
  Coding DNA Sequence Number=SeqID_89357
MESGPQSEPFDVEMGDRLEDMIRDLGQESFQQAHAPMYDTLQSDSKKPLYPGCNNLLTLLSATL

SEQ ID NO: 181043 - protein, 58 aa, Glycine max
  Coding DNA Sequence Number=SeqID_89358
MKAACFGGLWFHVLRLYNSSLASGNRLPRLCNRLPEMKSLEIPLLLTCSGYETHCVAP

SEQ ID NO: 181044 - protein, 120 aa, Glycine max
  Coding DNA Sequence Number=SeqID_89359
  Homolog annotation: Hit_ID=Q16EB2; Match level="QueryCoverage=90%, HitCoverage=21%, E-value=1e-09, Identity=40%"; Hit description =Putative uncharacterized protein
MRYLFGGAHKCAPYISGAALGINPRPASPVYGAHKCAPYISGAAPGINPRPASPVYGAHKCAPYISGAAPGINPRPASPVYGAHKCAPYTSGAALGINPRPASPVYVRINAHPTYLALRR

SEQ ID NO: 181045 - protein, 212 aa, Glycine max
  Coding DNA Sequence Number=SeqID_89360
MTEGCGEGFALQTFPSGKPLVEILPPGQLRGFCPLLAWLGSAVLGYGPVLSFGLVGPLLPPVISFVARILPTLACAPLAKSVPRWWIIMQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAGIL

SEQ ID NO: 181046 - protein, 85 aa, Glycine max
  Coding DNA Sequence Number=SeqID_89361
  Subcellular localization annotation: CTP_CleavageSite=44; ConfidenceScore=5.05e-01
MAGNRQQATDAPPSPLEFTSAHPQKGNGRTHLVAHDPRKLNKMSTSSEGHPLYSRTAGQTLTYIMTSRSTSLEPKSQLIINLDPG

SEQ ID NO: 181047 - protein, 69 aa, Glycine max
  Coding DNA Sequence Number=SeqID_89362
MEVEEPWLGLWLPLNYRVDMGSSLAYDNGIWGFVVDLGMAFVDNWAVGKEEVCYWLSNDIVGLVGNLAV

SEQ ID NO: 181048 - protein, 46 aa, Glycine max
  Coding DNA Sequence Number=SeqID_89363
MGLFPLIQKPFSYPGGKLPGNHITNETSKRVGLRLKRNNTRKTSLP

SEQ ID NO: 181049 - protein, 89 aa, Glycine max
  Coding DNA Sequence Number=SeqID_89364
MLVAGAWSLTDALVDPPVVICLSQRLSHACNSRANTCNKPRLLEGMHLLDKRSTQALPVALMIHDNSSDRTAFVPATHHSNFCPINFRW

SEQ ID NO: 181050 - protein, 405 aa, Glycine max
  Coding DNA Sequence Number=SeqID_89365
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=37%, E-value=0.0, Identity=100%"; Hit description=DNA -directed RNA polymerase subunit beta
  Pfam annotation: Domain name=RNA_pol_Rpb2_3; Domain location=42-111; Score=135.4; E_value=1.6e-37; Accession=PF04565.7; Description=RNA polymerase Rpb2, domain 3
  Pfam annotation: Domain name=RNA_pol_Rpb2_6; Domain location=191-405; Score=-3.6; E_value=1.5e-13; Accession=PF00562.19; Description=RNA polymerase Rpb2, domain 6
  Pfam module annotation: Pfam domain module=RNA_pol_Rpb2_3::RNA_pol _Rpb2_6; Domain location=42-111::191-405
MVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGSIESPFYEISERSKRIRMLYLSPSRDEYYMVATGNSLALNRDIQEEQTVPARYRQEFLTIAWEQVHLRSIFPFQYFSIGASLIPFIEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILV

SEQ ID NO: 181051 - protein, 736 aa, Glycine max
  Coding DNA Sequence Number=SeqID_89366
  Gene Ontology: Mol. function=ribonucleoside-diphosphate reductase activity; Cellular component=ribonucleoside-diphosphate reductase complex; Biological process=DNA replication
  Homolog annotation: Hit_ID=Q6D7X6; Match level="QueryCoverage=100%, HitCoverage=96%, E-value=0.0, Identity=91%"; Hit description =Ribonucleoside-diphosphate reductase 1 alpha chain
  Pfam annotation: Domain name=ATP-cone; Domain location=5-94; Score =84.2; E_value=4.1e-22; Accession=PF03477.7; Description=ATP cone domain
  Pfam annotation: Domain name=Ribonuc_red_lgC; Domain location=222 -736; Score=870.5; E_value=8.4e-259; Accession=PF02867.6; Description= Ribonucleotide reductase, barrel doma
  Pfam annotation: Domain name=Ribonuc_red_lgN; Domain location=141 -220; Score=92.6; E_value=1.2e-24; Accession=PF00317.12; Description =Ribonucleotide reductase, all-alpha d
  Pfam module annotation: Pfam domain module=ATP-cone::Ribonuc_red _lgC::Ribonuc_red_lgN; Domain location=5-94::222-736::141-220
MNQSLLVTKRDGRKERINLDKIHRVIDWAAEGLHNVSVSQVELRSHIQFYDGIKTADIHETIIKAAADLISRDAPDYQYLAARLAIFHLRKKAYGQFEPPKLHAHVTRMVEMGKYDKHLLEDYSAEEFEQMDSFIDHWRDMNFSYAAVKQLEGKYLVQNRVSGEIYESAQFLYMLVSACLFSNYPRETRLDYVKRFYDAISTFKISLPTPIMSGVRTPTRQFSSCVLIECGDSLDSINATSSAIVKYVSQRAGIGINAGRIRALGSPIRGGEAFHTGCIPFYKHFQTAVKSCSQGGVRGGAATLFYPMWHLEVESLLVLKNNRGVEGNRVRHMDYGVQLNRLMYQRLIKGEDITLFSPSDVPGLYDAFFADQDEFERLYTQYEKDDSIRQKRVKAVELFSLMMQERASTGRIYIQNVDHCNTHSPFDPQIAPVRQSNLCLEIALPTKPLEDVNDENGEIALCTLSAFNLGAIDSLDDLEELATLAVRSLDALLDYQDYPIKAAHRGAMGRRTLGIGVIHFAYYLAKNGVRYSDGSANNLTHKTFEAIQYYLLKASNRLAQEQGACPWFKETTYSQGILPIDTYKKDLDAVCSEPLHYDWETLRKEIQETGLRNSTLSALMPSETSSQISNATNGIEPPRGHISIKASKDGILRQVVPEYERLKDNYELLWEMPSNDGYLQLVGLMQKFIDQSISANTNYDPTRFPGGKVPMKQLLKDLLTTYKFGVKTLYYQNTRD

SEQ ID NO: 181052 - protein, 98 aa, Glycine max
  Coding DNA Sequence Number=SeqID_89367
MINQGYITILKVFRLAPLSCRCGKITRRRIAKGFAKHGDKITRRGISQRFRDLQHGFAAQALRNYGTELQTRGAAAIRLSRLASERLQQNRDAGNSAP

SEQ ID NO: 181053 - protein, 65 aa, Glycine max
  Coding DNA Sequence Number=SeqID_89368
CRRASSTEDGSSQICPKFGGGMKAKCLRKKGKYEEGMNEKVKVILWMNALLEPKLLNPRKTMNCW

SEQ ID NO: 181054 - protein, 81 aa, Glycine max
  Coding DNA Sequence Number=SeqID_89369
MAYERGGDFLEDARKILNREAFPPGGSLVRSPVPAFRFTGVIPLYGRVCLIPRLTLSSGSSSLQAGLYARTPVQSDRCAYP

SEQ ID NO: 181055 - protein, 85 aa, Glycine max
  Coding DNA Sequence Number=SeqID_89370
MFVFSPIYGSFCRLATGVSLSETYALSENHALSEALSLLSELRESGGEFDKHLHAQCVINSLREAFVSSRVKRAQLAQRIFTNSH

SEQ ID NO: 181056 - protein, 123 aa, Glycine max
  Coding DNA Sequence Number=SeqID_89371
MAPSRHPLDPDKSNGALGFPALITGLCQSFGVPVAPTKAANHRAHVQTHDCLYQMSLNMQSQGFASFSCPTPDQFGAEVAWPGDWLEAQAGEAPPEAPGDGEEAHEDEEMADLLDFLGGSGAS

SEQ ID NO: 181057 - protein, 78 aa, Glycine max
  Coding DNA Sequence Number=SeqID_89372
MAKVCGMTIICLRMSSAPPPLDDKRVQNDHNLSLRAIDTTMSEWQKGQYDRDCGAADKSKALAPTYPPMRNSDLRSSR

SEQ ID NO: 181058 - protein, 27 aa, Glycine max
  Coding DNA Sequence Number=SeqID_89373
MADGVAENGGCRQIDQSGFLLETYSQK

SEQ ID NO: 181059 - protein, 172 aa, Glycine max
  Coding DNA Sequence Number=SeqID_89374
MGAKYLEAVKQRLHAIKQWSPNEIRAINSWGSELDGGGCMNGNQFMGLQIRFDGGGCTNSARQSICGAPNSMRQAINLCGSGLDGGGCMNDNQFMGLRIRFDGGGCMNNTRLSICVAPDSMVINSCGFGLDGGGRMNGNQFMGLRIRFDGGGCTNNARQSIRVAPDSMVEDA

SEQ ID NO: 181060 - protein, 119 aa, Glycine max
  Coding DNA Sequence Number=SeqID_89375
MTHHRPSKEFEESPRCRWSDSRRQNAHVTDDDLQIVYGLKSGIKMNWVLLIEDIKLKSRQLVDYEFSYVVLASRFINYFNVDVVDFTKASSEIIERHLKKLGIRFVEHEWIMAREPPTT

SEQ ID NO: 181061 - protein, 47 aa, Glycine max
  Coding DNA Sequence Number=SeqID_89376
MPNLKSDAIPPRKGPITRAMSKRLQEDWARAVEEGPRVLMNLRGSIM

SEQ ID NO: 181062 - protein, 45 aa, Glycine max
  Coding DNA Sequence Number=SeqID_89377
MMQSYPARALDRRLQEDWARDAREGPKVLMSLRVDFRLMGYGSII

SEQ ID NO: 181063 - protein, 155 aa, Glycine max
  Coding DNA Sequence Number=SeqID_89378
  Homolog annotation: Hit_ID=A5BQ63; Match level="QueryCoverage=82%, HitCoverage=20%, E-value=2e-16, Identity=37%"; Hit description =Putative uncharacterized protein
  Pfam annotation: Domain name=zf-C2HC_plant; Domain location=30-85; Score=79.7; E_value=9.7e-21; Accession=PF07567.3; Description =Protein of unknown function, DUF1544
MADFFCFLSAVGVGLTRRNPTRATRKNKADPGWKYCHSLVEGDTSTIVCNFCGKITKGGITRAKQHLIGKSGNVAACKKTSPNVVEELKEYMATKKSGTTYSISGSGNMANIRDFEFGEPIGCDGSEEDEFADSCNVAASAKTKCETKKRPMDKF

SEQ ID NO: 181064 - protein, 70 aa, Glycine max
  Coding DNA Sequence Number=SeqID_89379
MSHAVKGNRGKWAPNYEGPFVVKRAFSGGALGQDHLELPSGVETKHEQQNEQQKPIKVHRDGCEWGWGHD

SEQ ID NO: 181065 - protein, 121 aa, Glycine max
  Coding DNA Sequence Number=SeqID_89380
MAAQLIHDRVEMECLEGAWETLKGNTSTLQRDVEWILPTPTPYRLVDPVQVIEVTLSEEDPEEDLEEPPPEPAVDALDFLEGDEDPLPEVDSPEDVMSASEADSTEDSGPGEMAISGGSSS

SEQ ID NO: 181066 - protein, 220 aa, Glycine max
  Coding DNA Sequence Number=SeqID_89381
MEGDSVIHTVAYADDVVRVSVETVIDPEAEVPYATSEIQYVKQAVDTFVAWPTHLVKAILDEVPQSIPHNEDAHVPKPTNVDADDPLRGLIKYSFDIYDNPLEINFDGSFLGIVDASASIFITYSDVSEIIAGDKSLNISVIQLWLMYIHEWSQIFSQGFMYAFLEPQSLVCSKERRSECEQYLLRWLKESDREVYIGPYFHQKPDMHIKATINRLSHTI

SEQ ID NO: 181067 - protein, 61 aa, Glycine max
  Coding DNA Sequence Number=SeqID_89382
MKGNQQRVESPTVATYPSAGGRRVTRGMRVPRKEYARSRHQRLFEENVGKTGKDAIYELFK

SEQ ID NO: 181068 - protein, 152 aa, Glycine max
  Coding DNA Sequence Number=SeqID_89383
AHLDLPGCSNRRRCLLVEATQLAWESWATTTSLFSPINRGMRAEQIRSTLLVSEIHLKLVRKIVSMKKIQAEALPRRFCGRFHEGFPLFFVVLHSFFVILRSSTGLISSSQLRICRSKSPTFVDHPKRSLMVQHLNVSLSFQKQEIVNGPTP

SEQ ID NO: 181069 - protein, 121 aa, Glycine max
  Coding DNA Sequence Number=SeqID_89384
MYPLLFSVKPKEWEKSKEFSDYVVLNSLTSEEGRHKEFRRLVLCSFGKGRRETQKEFRRLVLGEFFLAKGEGNEKMNSTSFQGLENQKTSESFWYKEEEEEVQRDTRLVKDCKNKCSRLNE

SEQ ID NO: 181070 - protein, 134 aa, Glycine max
  Coding DNA Sequence Number=SeqID_89385
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=71%, E-value=9e-25, Identity=68%"; Hit description=LacZ protein
MDKFDILAYSTSTGIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 181071 - protein, 48 aa, Glycine max
  Coding DNA Sequence Number=SeqID_89386
SDIDYSRIEVDLLYKKSISMNFYEMVSRDSANCLDRGISLRNRNLGIL

SEQ ID NO: 181072 - protein, 393 aa, Glycine max
  Coding DNA Sequence Number=SeqID_89387
  Gene Ontology: Mol. function=DNA-directed DNA polymerase activity; Cellular component=cytoplasm; Biological process=DNA replication
  Homolog annotation: Hit_ID=A5FDE2; Match level="QueryCoverage=100%, HitCoverage=38%, E-value=1e-166, Identity=71%"; Hit description=DNA polymerase III, alpha subunit
MVYQEDVIKISQYFGGLTLADGDILRRAMSGKGRSIEKLREVKANFFKSCEDKGHSLELTAEAYRQIESFAGYSFCKAHSASYAVESYQSLYLKVYYPLEFMVSVINNMGGFYRTEVYIHETKMSGGIVCNPCVNTSDFQTTLHGKEIYLGLMHLQGLETRIAHFIVEERARNGNYKSLENFIRRVPVGLETAQILIFIGAFRFTGKQKNELLVEVRMLLVNFKPENRGLMLIEEPVKKYKLPRLKRETFEDAFDEIEILGFTVSCSPFDLLKTGYRGSVFVKDLLQYHKKQVKMLAYLISRKHVPTKKGTMYFGTWIDVNGDYFDTAHFPDSLEKYAFQGGGCYLLLGTVEVDFHFPTITVTKMAKMPFIPDPRYAYDKEMQYDIHKQIRED

SEQ ID NO: 181073 - protein, 49 aa, Glycine max
  Coding DNA Sequence Number=SeqID_89388
MGGTMHEPQANLGIDQKFSPGRRETQKNSGGLSFVLWKREKRDTKRIRR

SEQ ID NO: 181074 - protein, 165 aa, Glycine max
  Coding DNA Sequence Number=SeqID_89389
MPPKCSFTMPLGYIQRCSLAPENLDNSKNTPGSDLIHYGESWNLLRADQRLIFAKSWPRASRYQQGHQDLFILRSDLPSQHRRTSALASVAVTLRVTTTPAALNAPLQGASHSPFRLRNCWEGRSVRASSLLRQLAKGGCAARRLSWVTPGFSQSRRCKTTASEL

SEQ ID NO: 181075 - protein, 134 aa, Glycine max
  Coding DNA Sequence Number=SeqID_89390
  Subcellular localization annotation: CTP_CleavageSite=62; ConfidenceScore=5.18e-01
MIAVHTVNATQILGFVNVTPTIFKMTAQNYTSHVQTIAAHTVNVTLILVFVNVMTIIFKMIVQNYLSNVQIQHVHLKVIVIHQMAFVIVIMDSVVTNIFTFIQKYHKTYSNVQRTVHHMDILFIILRLDQCSEF

SEQ ID NO: 181076 - protein, 63 aa, Glycine max
  Coding DNA Sequence Number=SeqID_89391
PKSKASARWIIVKYFNDPRALEPERLKALRIQWAQFYLRVRDQAYDLRTFYNIFYILYIFYVT

SEQ ID NO: 181077 - protein, 162 aa, Glycine max
  Coding DNA Sequence Number=SeqID_89392
  Gene Ontology: Mol. function=hydrolase activity; Cellular component =cytosol; Biological process=amino acid biosynthetic process
  Homolog annotation: Hit_ID=Q54NW6; Match level="QueryCoverage=90%, HitCoverage=11%, E-value=2e-65, Identity=82%"; Hit description=5 -oxoprolinase
  Pfam annotation: Domain name=Hydant_A_N; Domain location=11-160; Score=126.9; E_value=5.7e-35; Accession=PF05378.4; Description =Hydantoinaseoxoprolinase N-terminal region
MENEIMKKSIKFNIDRGGTFTDIYAEFPFEPYYIVEKLLSVDPDNYSDAPREGIRRILERIQKKSIPKDNVDTTCIKSIRMGTTVGTNALLERKGERVLLVTSEGFKDLLQIGNQARPKIFDLNIVKPDLIYDSVLEVEERVQIINNQHLLSQYNDEELGTI

SEQ ID NO: 181078 - protein, 144 aa, Glycine max
  Coding DNA Sequence Number=SeqID_89393
MKLASTFSLVKLDVILPMKGPVPRAMSRRLQEDWARDARRRPYGSPPPHESKGRFFEPMGQGDDKKLKGQSKKEFKMFKMFKIESRTLQGSRGKLISRIKNQESRIKIQGSSFQESTSRFKTQDSRIKRRLSQDKYEKVFSKTE

SEQ ID NO: 181079 - protein, 207 aa, Glycine max
  Coding DNA Sequence Number=SeqID_89394
  Homolog annotation: Hit_ID=Q2HW90; Match level="QueryCoverage=68%, HitCoverage=25%, E-value=2e-12, Identity=34%"; Hit description =Putative uncharacterized protein
MGSSQKPSLKKRFYQVKIKSLEVTSLRKLGQLMGQLQRQAFRKAYGIRPPKASRKWGGRNTEKIFGAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESKILSSCEGCPNVPLMGTRGCINYNPVLAIRQLGYPMRGAP

SEQ ID NO: 181080 - protein, 194 aa, Glycine max
  Coding DNA Sequence Number=SeqID_89395
  Subcellular localization annotation: CTP_CleavageSite=21; ConfidenceScore=5.24e-01
MAEPSKKRKGVLTSSAVIGTRSHRSSKVHTTQIPPSISSPTLFSLDEQRIWYNSLFSSRSIIDPKFVDLAFFDDEVFDCFQAFQNSGLIQFISMKLPFYPELVKALYSNLEIQEDSLISEVYGIKMVIDQSLLFELTQLSSDGVPFEGTLDDEWKFDFSVSDARRMVCTNQADMTERLLSGSLAFECRIIHYLI

SEQ ID NO: 181081 - protein, 80 aa, Glycine max
  Coding DNA Sequence Number=SeqID_89396
MVFGASVASVKFPKTLGKHIPLNIGEREEKKDENQIQNTSGRGELFQNVQDPLAMHFGYFGQKTRFREEKSSRSASVTLP

SEQ ID NO: 181082 - protein, 59 aa, Glycine max
  Coding DNA Sequence Number=SeqID_89397
MDGSNSHKDSKMTITHKHKHMRIKRSFKVVMGPRTRYGKIWNKWLNPKGIEEQRGISAY

SEQ ID NO: 181083 - protein, 241 aa, Glycine max
  Coding DNA Sequence Number=SeqID_89398
HLLLQDKELRGIRNGVIGGYHGWLRVHTRGLDWLSKLKVINEENFEVPEEDEEVQALKLELGKARLAKEKFKSAATNIRKECTKLRKENAATARALEQETKRARKEEHGRDKFRGALWGSNNELKLRREERDQSWVHGMILKEELATFARSKRSLAQHLEATKQSMLAIIGQYKEELNQPVTHEQNLVEDFAQVYTEKEARGRVIDALHQEATMWMDRFALTLNGSQDVPRLLAKAKAIAE

SEQ ID NO: 181084 - protein, 275 aa, Glycine max
  Coding DNA Sequence Number=SeqID_89399
MLPFDFRCVTETYGLCINIFWFSGMSWNFTNCLMMDAKHLTRTKERSHVIKQRSPDEIRGKFDIPEGTATKKKVMSTVATRWKQFKSSLTTRYVYADKDGEDNHDLSAKYGLDRETWEQFAKSRQTPSWQGIRKKAQEIQKFNDSPHLLSCRGYDLLEKKLLAEKTKARGHQADYTENTAMVVDPPFPIARHVKWKMARTKAYGQMTSTTAKGISEKFGSNTSLAVITPDQLVEIIGNLKQEWRKEVEDENRRTMDIMKKELDAIKIELSQMQTQ

SEQ ID NO: 181085 - protein, 132 aa, Glycine max
  Coding DNA Sequence Number=SeqID_89400
  Gene Ontology: Mol. function=protein serine/threonine kinase activity; Cellular component=cytoplasm; Biological process=protein amino acid phosphorylation
  Homolog annotation: Hit_ID=A7Q573; Match level="QueryCoverage=50%, HitCoverage=14%, E-value=9e-25, Identity=81%"; Hit description =Chromosome undetermined scaffold_52, whole genome shotgun sequence
MPIPRLSNPPNHVHGEQVVVGWPSCLSKVVGEAINGLVPTTADTFHKLNKAVVGVIAGVLAQHPSKRVSFTRDGKFAAICTRRDCMDYINLLYCHTWEIMGNFAVDTLHLADIKWSPGDSAIVLRDSLTFIT

SEQ ID NO: 181086 - protein, 132 aa, Glycine max
  Coding DNA Sequence Number=SeqID_89401
MASSRGGNGRGIGGCNSEWRLLSLAEIAYSGWSFASLTLQRKVEEGPQLLVVFVFAAAVLEEEHMACLDQQHSRKEAQVVVVVEDLPISDLDDSSNLDCICCMKDHNYSVVVGFAVEGVYYKCLQHKFQVAH

SEQ ID NO: 181087 - protein, 59 aa, Glycine max
  Coding DNA Sequence Number=SeqID_89402
MVVPKVPLGVGFQRRTTTVRGGYWWLWVVKKKLGTLGKGFGRKKEKGMVVFQGYTKNKT

SEQ ID NO: 181088 - protein, 118 aa, Glycine max
  Coding DNA Sequence Number=SeqID_89403
  Gene Ontology: Mol. function=aspartic-type endopeptidase activity; Biological process=RNA-dependent DNA replication
  Homolog annotation: Hit_ID=Q6VPE8; Match level="QueryCoverage=53%, HitCoverage=7%, E-value=2e-09, Identity=46%"; Hit description =Putative gag-pol polyprotein
MAGASDGSGDYHQLDGSQCLLLDVMTTQMQRLLNRNNEELYGRIEGLENQLNQNTGRHYGGNRVDNVGPKQNRVEGQNRIEGVKLNVPPFKGRSDPDAYLDWEMKIEHIFSCNDYTEE

SEQ ID NO: 181089 - protein, 78 aa, Glycine max
  Coding DNA Sequence Number=SeqID_89404
MDVIGGREHPSAKYAGGTTIRYKTSTSIEDGEDEFSKDMMQSYPSRALDRRLQEDWARDAREGPKILMSPMVDFGPMD

SEQ ID NO: 181090 - protein, 143 aa, Glycine max
  Coding DNA Sequence Number=SeqID_89405
  Subcellular localization annotation: CTP_CleavageSite=68; ConfidenceScore=5.37e-01
MEKMNMHIITEGTPKVPQLHFSSFFLLFLSFSFFFPTSEPLNPSPSIAIYREKSFWGRRSSPRRAGCLGMKPFHGPGEPDASLGELGSRKIQKRPVCPLPWYLFVFLIKTPSDSLLRTVTDTKYHNSTSKNQNIISNDIPRTK

SEQ ID NO: 181091 - protein, 100 aa, Glycine max
  Coding DNA Sequence Number=SeqID_89406
MSSSTFRRRQCLQSLHAFKRRQCLHLHFEDDNVFSHCMPSKVTMSSSTFQRRQCLQSLHAFKRRQCLHLHFEDDNVFTSKISISFSNVLRRTRRPMFVRF

SEQ ID NO: 181092 - protein, 65 aa, Glycine max
  Coding DNA Sequence Number=SeqID_89407
  Homolog annotation: Hit_ID=A7Q573; Match level="QueryCoverage=60%, HitCoverage=13%, E-value=4e-09, Identity=55%"; Hit description =Chromosome undetermined scaffold_52, whole genome shotgun sequence
MKLDEELKVCPGLLVEVDEPLQLHISVRYEVMEVPINLPFQKPPAEKPNPKQGISKLHVSNFQMP

SEQ ID NO: 181093 - protein, 141 aa, Glycine max
  Coding DNA Sequence Number=SeqID_89408
MSEIEEVQEQMKANMEAIKEKMTTMMEAMMSMRKMMEVNTATVVATSTATEVDPTHPPGFNQVNRPTSDMVGQGGKVLGSAAFLPPMWIASQLTPPNVVHAPDENVDNYAPVPIKSQQPQSDHAHVSQPMGETMKYPEATL

SEQ ID NO: 181094 - protein, 100 aa, Glycine max
  Coding DNA Sequence Number=SeqID_89409
MELMRLHQHEENDKKRRGITLKASSSFIQEESDKEDLTEIEEDDDFSGCSKHMAGDASKIIHISPKDSEYVIYGDNKLRPLDQQAQQVVSNDTKRSLVFD

SEQ ID NO: 181095 - protein, 194 aa, Glycine max
  Coding DNA Sequence Number=SeqID_89410
MDEAAGVDGPGGAGARVADVDGAGGVEKEGTSTGLVLAFLAPLKLTALLDQTIRSNSSSSAESSNQGWKSEPRGVTLSNRRNLTRDKGANVHTHMGYQAVGVRWDTPSLGQCVLSEELPWIGPQPTESRVGGVIQVGIKFFDNRHINASLLEDILAENVICVSVPGFQGMESLGVILSLWPRNCAFSLSGCHLQ

SEQ ID NO: 181096 - protein, 321 aa, Glycine max
  Coding DNA Sequence Number=SeqID_89411
  Gene Ontology: Mol. function=secondary active sulfate transmembrane transporter activity; Cellular component=integral to membrane; Biological process=sulfate transport
  Homolog annotation: Hit_ID=Q0P7I2; Match level="QueryCoverage=25%, HitCoverage=17%, E-value=5e-13, Identity=44%"; Hit description=Sst1 protein
MVEVDFSIALENNDETRSMTAGPNQQMSSPDLLLGGCGGSYCWCEVGSCYDNSANRERGLGKDDKLDWGGVVKNIVEGVNTLHGRYEELCCVLWVHEHFISDGYGFNFHGEVVAKDVGLDPRVSEGLFRGASHNSTPESLEAPPLSPMIKNPKIFWVPAIAPMARQGPTSIMEFKYYASCSCYKHVVISGIAIGRSFALTDNTLHDGNKEMIAFSLIMNLFGSFTSCYLTCASSPHWWRMTTLPRMAHTSSTINPRFLSPSSSHSPRPPPPPSPPPCTSFRQCRSPTGADSLLLLPRVLLVHAGECAAYTDEKTPPPSLTS

SEQ ID NO: 181097 - protein, 68 aa, Glycine max
  Coding DNA Sequence Number=SeqID_89412
MKNVEERLKALRDSSRKTKIGEMVAAQLAQASSARPGEHGCFLQKQPPSGGIFWRAQMGLGAIAPPFY

SEQ ID NO: 181098 - protein, 295 aa, Glycine max
  Coding DNA Sequence Number=SeqID_89413
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=92%, HitCoverage=25%, E-value=1e-155, Identity=100%"; Hit description=DNA- directed RNA polymerase subunit beta
  Pfam annotation: Domain name=RNA_pol_Rpb2_3; Domain location=42-111; Score=135.4; E_value=1.6e-37; Accession=PF04565.7; Description=RNA polymerase Rpb2, domain 3
MVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGSIESPFYEISERSKRIRMLYLSPSRDEYYMVATGNSLALNRDIQEEQTVPARYRQEFLTIAWEQVHLRSIFPFQYFSIGASLIPFIEHNDANRALMSSNMQRQAVPLSQSEKCIVGTGLERQVALDSGVSAIAEHEGNIIYTNTDRIFLFGNGDTLSIPFNYISNVPTKILVCIKNPRFAE

SEQ ID NO: 181099 - protein, 158 aa, Glycine max
  Coding DNA Sequence Number=SeqID_89414
  Homolog annotation: Hit_ID=A5BEV8; Match level="QueryCoverage=49%, HitCoverage=9%, E-value=2e-08, Identity=41%"; Hit description =Putative uncharacterized protein
METISKRFEQLDVCGKVHLKSKLREIAYHDMNSMFPPPKKMKTKGAPKKPLTKQQKLTKRDTSYWEYVDALHFVQNIALLGMGEESWSLVRNHLHKELISWSEEYINLVGGIERFEELKHSLLVDGLSMVTMDKWMNITDMGYVIASQYNVIIISLSR

SEQ ID NO: 181100 - protein, 37 aa, Glycine max
  Coding DNA Sequence Number=SeqID_89415
MTNDSSKMTSKFAKLDNTPMPVYMEDETLDQTRKRSK

SEQ ID NO: 181101 - protein, 48 aa, Glycine max
  Coding DNA Sequence Number=SeqID_89416
MRLFRSLGRKMLTSLGKVQSQPEDADVSREGADDDVSHCMLSGFESYG

SEQ ID NO: 181102 - protein, 105 aa, Glycine max
  Coding DNA Sequence Number=SeqID_89417
SGDMRGYLMVIHNFGQPGANEPVDAWKLTLSSKPFVVLTRESGDMRGYLMVIHNFRQPGANEPVDERGLTSSSAPFVDLTREVRVSLWLPAPFVNQGQTSPMTQG

SEQ ID NO: 181103 - protein, 214 aa, Glycine max
  Coding DNA Sequence Number=SeqID_89418
LKNELGKAKLAKEKFKLAATHIWKECAGLREENATTARALEQETKRARKEEYGRNKFRGALWGSNNELKLRREERDQSRAHSMVLKEELVACSSSKRSLSQRLCETKTNMLAIITKYQEELGLATAHEHRVADEYAQVYAEKEARGRVIDSLHQEATMWMDRFALTLNGSQELPRLLAKAKAMADTYSAPEEIHGLLGYCQHMIDLMTHIIRNR

SEQ ID NO: 181104 - protein, 263 aa, Glycine max
  Coding DNA Sequence Number=SeqID_89419
WLPEFYANLYVPKDKEPKQVRVRGHLIKFYADSLNTFLETLVVVEQRGILPSYSKFARLRLDPQELAARLCLPGRGFVLNVEGLSWKLLRKDLTTLAQTWSVLSYSNLAPTSHTSNLNLDRDKLVYGLVIKMNMNLGSLIFGQISLIAQSNSSRLGFPALITALCMARGVTSDSLTFESLGLAIHLAYIKKNCWNLDDLLFTFPGTQKSRARRSEAPSPSAAPAPPTSAPSTSALPSPPATPVLLGPSAQTLEPLISLLQSLH

SEQ ID NO: 181105 - protein, 94 aa, Glycine max
  Coding DNA Sequence Number=SeqID_89420
MATKMKRCPFEALGSMALITSMPHIQNGQDAAKMFNGIGGALTLSVKYQGLPSSPSSIKQQCASSLRHLNSMYGKSPCGLTLNMDAKVAKALTI

SEQ ID NO: 181106 - protein, 124 aa, Glycine max
  Coding DNA Sequence Number=SeqID_89421
MFAHSIKGCRPLGRTSRLFWFFRRFPQINVGGDSARIPFVEHASRESRVALPPKDYYLKVVFVATYPSAGGRRVTRGMRVPRKEYAQSRHQRLFEENVGKTGKDAIYELLSERFGSCIYARGRY

SEQ ID NO: 181107 - protein, 103 aa, Glycine max
  Coding DNA Sequence Number=SeqID_89422
  Homolog annotation: Hit_ID=A6FJQ2; Match level="QueryCoverage=36%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARLGRIDGDPVLRETRIWATWEYVSSVGGGQQGMVGLCAHCGCGKLVVHHRPTAT

SEQ ID NO: 181108 - protein, 18 aa, Glycine max
  Coding DNA Sequence Number=SeqID_89423
NHVLKDVGTQRSDRMWHW

SEQ ID NO: 181109 - protein, 58 aa, Glycine max
  Coding DNA Sequence Number=SeqID_89424
MEYDSLSRCLGGEMVDTRDSKSRAKERGVKPNDSLLEQIATTISSGKSHLFLNNVFVI

SEQ ID NO: 181110 - protein, 158 aa, Glycine max
  Coding DNA Sequence Number=SeqID_89425
LPSPLRGLHVLALRGLHVLTIRGLHALPLRGLHVLALRGYTPSPWVLVTLTVERTTRPRLRGLHVLTIRGLHALTSRGLHVLALRGLHALTLGTSYPHRQRTTRPRLERTTRPHHQRAARPHFQRTISPRLERATRPHLWVLVTFHLQRTTTSLAFQR

SEQ ID NO: 181111 - protein, 77 aa, Glycine max
  Coding DNA Sequence Number=SeqID_89426
  Subcellular localization annotation: CTP_CleavageSite=40; ConfidenceScore=5.27e-01
MVMTPTTKNHQRTTTRSRRRPPTSTIIAFGGTLNHNQMTRAVATQEPDRRRGSLIGLMTTLIFGDSGLPLDDRPEGA

SEQ ID NO: 181112 - protein, 707 aa, Glycine max
  Coding DNA Sequence Number=SeqID_89427
  Gene Ontology: Mol. function=transporter activity; Cellular component= outer membrane-bounded periplasmic space; Biological process=transport
  Homolog annotation: Hit_ID=A4W737; Match level="QueryCoverage=46%, HitCoverage=100%, E-value=1e-165, Identity=85%"; Hit description =Extracellular solute-binding protein, family 1 precursor
  Pfam annotation: Domain name=SBP_bac_1; Domain location=387-647; Score=32.4; E_value=1.6e-06; Accession=PF01547.16; Description =Bacterial extracellular solute-binding protein
GHRPARLAVLPELRPVEIRRRAVARRPRAAQVYGDRPVRHRLAERGVRLRRIADAAAGGLGAERLLSGLGLAALRAAADPLVFAQRARLLVGLLEYVDQPRRRDRAADQRLRRPALGLAGGDADPGRRQHGVGHLAHAAADGHAAGRRPAVGRPVAPRSAGAAPGTAKPADGAVADVAHHDAEEPDDLAARRLLRAGLPDPHRVERLGQSLADGKPRRQPAQRQRHGDAVRGRRPARRAVRRLGLGFAVRRAARADDFAVHARADGFRRRAVAGAGASLRAAGGLFLYGGLFCLRPTDADWPRRRGMRAQRRSGLHHRFSRPVRLPGGRAGGLAAVADHRRLRLVRHVQFAVDRRRSYGFIADAAADGERYHLYREKDKTMKKTLVTTLIASGIALATLSGAAHAKGRLVVYCSATNEMCEAETKAFGEKYDVKTSFIRNGSGSTLAKVDAEKKNPHADVWYGGTLDPQSQAGDATIPRSGEAERHYSSAVYVGILGFGVNTQHLKEKNLPVPKCWKDLTKPEYKGEIQIADPQSSGTAYTALATFAQLWGDDQAFDYLKQLNANVSQYTKSGIAPARNAARGETAIGIGFLHDYSLEKEQGAPLELISPCEGTGYEIGGVSILKGARNLDNAKLFVDWVLSKEAQELAWQKGKSYQILTNTTAATSPNSLKLDDLKLINYDMDKYGSTEVRKALINKWVSEVKMGK

SEQ ID NO: 181113 - protein, 184 aa, Glycine max
  Coding DNA Sequence Number=SeqID_89428
  Homolog annotation: Hit_ID=A0ST23; Match level="QueryCoverage=13%, HitCoverage=51%, E-value=5e-07, Identity=100%"; Hit description =Putative reverse transcriptase
  Subcellular localization annotation: CTP_CleavageSite=42; ConfidenceScore=5.16e-01
WTSYVPINVSFSPKVGPGLPAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKGCTGASAEYVIQDIFRFLAH

SEQ ID NO: 181114 - protein, 70 aa, Glycine max
  Coding DNA Sequence Number=SeqID_89429
PLMVRTCSPLKARTCSPLEVRACSPLVVRTYSPLNGEGDRYKYPRVHPYEKARDRLIERAGHPKSTRFGH

SEQ ID NO: 181115 - protein, 154 aa, Glycine max
  Coding DNA Sequence Number=SeqID_89430
  Pfam annotation: Domain name=Transposase_23; Domain location=3-73; Score=4.5; E_value=0.00038; Accession=PF03017.5; Description =TNP1ENSPM transposase
PETGDSDKCGLYIEENSSHLVALGRVYEGSTSVHNIPLLHGQVKVGVEEVKDAEAPIPVPTDEVILVGQALNTFLDWPTHLVKPLSEQPLQVMWDATVFGVFNQNFSLYIKHEDLSKIAHGESYMKSWMQSSKCDVYLGAYLNGPDSYLKGIIN

SEQ ID NO: 181116 - protein, 62 aa, Glycine max
  Coding DNA Sequence Number=SeqID_89431
MPTDAMIKINLPAFREMLVGLGSSSSMDSFASRKMNGSGMKKEEREQMPFQGEDESRRSSLP

SEQ ID NO: 181117 - protein, 366 aa, Glycine max
  Coding DNA Sequence Number=SeqID_89432
  Pfam annotation: Domain name=Transposase_23; Domain location=51-121; Score=-4.1; E_value=0.0034; Accession=PF03017.5; Description =TNP1ENSPM transposase
MASFSQMQSKFQSQMQLQELAPPPEPEVGPSGARVSTKESCVAPSGNDPGTGDSDKCRLYIEENPSCLVALGRLYEGSTTVHNIPLLHGQVNVGVEEVKDAEALVPVPTDDVTLVGQALNTFLAWPTHLEAVSPAKPPESPDDEVDDPLYLMTLAIPQLFLKPLQVMWDATIFGVFNQNFPLYIKHEDLSNIAHGGQCLNISVIQLWILHWQMVVIPPKENLVVWFCSLHNRPNNYLEGIINIALKGLDDTPQPKSKAAARWIVVKEPVIATSGKGEPAIATGGKDEPASANGVIGHVGGKEESVANANGDTPPVPVGTARPDGDTGHVGLAHSDGEIGHVGLTHSAGETGHSREALGVTGWVTGL

SEQ ID NO: 181118 - protein, 246 aa, Glycine max
  Coding DNA Sequence Number=SeqID_89433
  Homolog annotation: Hit_ID=Q6UUU1; Match level="QueryCoverage=28%, HitCoverage=46%, E-value=1e-18, Identity=71%"; Hit description =Putative uncharacterized protein
VPPVQLLTGWCVTAKAPPDISAGKCSGHAARRVPFAIQAAQLLGRAIGAGLFAITPAGERGMCCKAIKLGNARVFPVTTLGWKIQDQAATSGRLPGEKAGGCHFSFLFHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 181119 - protein, 57 aa, Glycine max
  Coding DNA Sequence Number=SeqID_89434
LKGAALRWKAKYLYWEILVKLDAKFNETSENEGLIRISPFMQGIGVWYFSPQHRTQK

SEQ ID NO: 181120 - protein, 194 aa, Glycine max
  Coding DNA Sequence Number=SeqID_89435
SQSSLPTVNPTPDPAAPAEPQAPDPDLSLPLLDDNARRAELNERGGVLHFGDLSDQQKRQSARRTTGVSSNNNEARPRNGAGKEKWACGSPSLDYLGYLGFGKLVKKTNAPPSVESERSLNSRKDGSQNIAIVTVSGLRETGLDAYRTKIVSIYAQTIHIGGKLEASIVPRGTLECYDGVFQFVLTSPFDHSVM

SEQ ID NO: 181121 - protein, 130 aa, Glycine max
  Coding DNA Sequence Number=SeqID_89436
MLPFDFWHVMELHGLSNDGYQVTRSGQTRVASQQTDGPRMKLGHQKRADDHNLSPRIIEHNRLWMTKGCRMTIICLCVPLDTFVSEWRKGERNDHNLSPPVIGHDRLWMTKGRRMAIICLCVPSDTFVSK

SEQ ID NO: 181122 - protein, 104 aa, Glycine max
  Coding DNA Sequence Number=SeqID_89437
MVLEVQTQEHRSIEQTDQWLAPTFRIYTRFSSNFSQHQLDLAPYASEPDNAQWNAPGLLHDKHTLRSSRILREMEVDEPWLGLWLPLNYQVDMGASQPRILELG

SEQ ID NO: 181123 - protein, 248 aa, Glycine max
  Coding DNA Sequence Number=SeqID_89438
  Gene Ontology: Mol. function=hydrogen ion transporting ATP synthase activity, rotational mechanism; Cellular component=proton -transporting two-sector ATPase complex; Biological process =mitochondrial electron transport, NADH to ubiquinone
  Homolog annotation: Hit_ID=Q7HDI4; Match level="QueryCoverage=100%, HitCoverage=57%, E-value=1e-122, Identity=83%"; Hit description=ATP synthase subunit beta
  Pfam annotation: Domain name=ATP-synt_ab; Domain location=43-248; Score=228.0; E_value=2.1e-65; Accession=PF00006.16; Description=ATP synthase alphabeta family, nucleotide-binding domain
AVAMSATEGLMRGMEVIDTGAALSVPVGGATLGRIFNVLGEPIDNLGPLLIVVEEKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAK

SEQ ID NO: 181124 - protein, 72 aa, Glycine max
  Coding DNA Sequence Number=SeqID_89439
MSALKEQMASMMDAMLGMKQLMESNTATAAAVSSAVEADPTLPTTAHHPIPNMVGRERSTPGHISNPYPRYN

SEQ ID NO: 181125 - protein, 113 aa, Glycine max
  Coding DNA Sequence Number=SeqID_89440
  Homolog annotation: Hit_ID=Q1J7G7; Match level="QueryCoverage=29%, HitCoverage=60%, E-value=8e-07, Identity=66%"; Hit description =Transposase
MPQNVLYDALGYINGVGTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTL

SEQ ID NO: 181126 - protein, 174 aa, Glycine max
  Coding DNA Sequence Number=SeqID_89441
DHARKTPSGPEEFQQGPGVLALITGLYRFYGVSFTPNKVIRPPINRAFITKYCAPRQAQGEAPRQPGDSQQLAADSSPPPLESTSTHLQGLEHCLRYMVDQQAPNHRDRYEQLPAKKSRKGTIEKDCNVAPQANTGWSFLRQRQTQLRDDEFPHFLGGGGAIQKDVISGISCAQ

SEQ ID NO: 181127 - protein, 219 aa, Glycine max
  Coding DNA Sequence Number=SeqID_89442
  Gene Ontology: Cellular component=integral to membrane
  Homolog annotation: Hit_ID=A6ZVW6; Match level="QueryCoverage=78%, HitCoverage=85%, E-value=2e-11, Identity=24%"; Hit description =Conserved protein
NPCGVYPDLSSFTGSGVYPDLSSFIGSGVYPDLSSLTGSGVYPDLSSLTGSGVYPDLSSFIGSGVYPDLSSFTGSGVIQISVTCIKRSAPTQTYQGNPCGVYPDLSSFTGSGVYPDLSSFIGSGVYPDLSSLTGSGVYPDLSSFIGSGVYPDLSSFTGSGVYHDLSSFTGSGVIQTFVACIKRSAPFLVEPIIRLIKVILVASILTYLPSLEVASSKYP

SEQ ID NO: 181128 - protein, 131 aa, Glycine max
  Coding DNA Sequence Number=SeqID_89443
MMRIMKLAKYRLKAQVEKDKAPEWRRMKAQVEKDEGPEAETLSRLLIVAEGPSNPCGVYPDLSSFTGSDVYPDLSSFTGSGVYPDLSSFTGSGVYPDLSSFTGSGVYHDLSSFTGSGVIQTFVACIKRSAP

SEQ ID NO: 181129 - protein, 309 aa, Glycine max
  Coding DNA Sequence Number=SeqID_89444
  Homolog annotation: Hit_ID=Q2HW90; Match level="QueryCoverage=39%, HitCoverage=24%, E-value=2e-08, Identity=31%"; Hit description =Putative uncharacterized protein
MARVAKVVKISTQELGRVKQNRNGVVGIPRKCLEEKAKALANEGGWTSFIYVLALLVFRIILFPNVDGLVDLAVINAFLAYHHSKESPIVVVLVDAYDTFDRRCEKSSTRIVCCTPTFYVWLVSHIFRHESIPICPLQGHHMCAKKGKANWEELLAVKAMPKCFRVWKAWNAMERKDEELRGSSNGVIDDYHKWLKARTQGITWLSKLKISSGEEAEVPEEREEVQALKVKLERTRVVKEKFKMTAIRVWKDCKELRDVNMVATEALERETKRARKEEWGQNKFRGALWAATVNSSFEGIKGTSRGWKV

SEQ ID NO: 181130 - protein, 87 aa, Glycine max
  Coding DNA Sequence Number=SeqID_89445
MGLEIYPKAHENPRAFPWISCPIYLESSIQCPCGIGLHRSLHLGKDLTSNPEVLHTLGSFPQHLKVRSENPFPGHLPLKEHGFSPTQ

SEQ ID NO: 181131 - protein, 298 aa, Glycine max
  Coding DNA Sequence Number=SeqID_89446
  Gene Ontology: Mol. function=nucleoside-triphosphatase activity; Cellular component=chloroplast
  Homolog annotation: Hit_ID=Q2PMM5; Match level="QueryCoverage=98%, HitCoverage=19%, E-value=3e-94, Identity=85%"; Hit description =Protein ycf2
  Pfam annotation: Domain name=AAA; Domain location=102-298; Score= -19.7; E_value=0.001; Accession=PF00004.20; Description=ATPase family associated with various cellular activities (AAA)
MIELRKLLDRYPTSELNSFWLKNLFLVALEQLGDSLEEIRSFAFGGNMLWGGGPTYGKDVYSLLIIRQLLIHKPCGGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLGGIL

SEQ ID NO: 181132 - protein, 76 aa, Glycine max
  Coding DNA Sequence Number=SeqID_89447
MKEREELVWVGLQRFLSGGGQQRWWWRKIPFTSLMILPFEGVSADFDRWVWKRIEKDEDWALFEAIWLRNERDTKI

SEQ ID NO: 181133 - protein, 87 aa, Glycine max
  Coding DNA Sequence Number=SeqID_89448
MELQRLNQNEETNKRKRSIALKASSSMQEEEEEESDDEEDFSLFVKKFHKFVKNRRMERSHNFNNGKRSQEVSPTFKCCWIKWLQNN

SEQ ID NO: 181134 - protein, 72 aa, Glycine max
  Coding DNA Sequence Number=SeqID_89449
MLTQGFRKFYGSITEATEAAEAPKTIFQKRGGACRPVASSLSNPTSKMFRMDLDLNCYLHPYLDKFTPYLFW

SEQ ID NO: 181135 - protein, 89 aa, Glycine max
  Coding DNA Sequence Number=SeqID_89450
  Gene Ontology: Mol. function=phosphoprotein phosphatase activity; Biological process=intracellular signaling cascade
  Homolog annotation: Hit_ID=A5B5G3; Match level="QueryCoverage=84%, HitCoverage=5%, E-value=6e-15, Identity=54%"; Hit description =Putative uncharacterized protein
  Pfam annotation: Domain name=DUF1723; Domain location=36-85; Score =60.3; E_value=6.4e-15; Accession=PF08330.1; Description=Protein of unknown function (DUF1723)
DVIQSYAQAMSSLDPRIEPLLVQVGFSDVVKLRQVKIDNGLVIALVGRWRPESNTFHLLVNECTITLEDVALQLGLHIDGRPVTDPTYY

SEQ ID NO: 181136 - protein, 215 aa, Glycine max
  Coding DNA Sequence Number=SeqID_89451
  Gene Ontology: Mol. function=transcription regulator activity; Cellular component=nucleus; Biological process=regulation of transcription
  Homolog annotation: Hit_ID=A7QJJ0; Match level="QueryCoverage=98%, HitCoverage=87%, E-value=2e-39, Identity=45%"; Hit description =Chromosome chr8 scaffold_106, whole genome shotgun sequence
  Pfam annotation: Domain name=HLH; Domain location=62-114; Score=46.8; E_value=7.5e-11; Accession=PF00010.17; Description=Helix-loop-helix DNA-binding domain
MVALFSPTVFSTKGWLLEEEPLSYDVSSKNSFPYQFYSLQTQIEVEIERSTAPSPDDPAMVKKLSHNASERDRRKKVNNLVSSLRLLLPVEDQTKKMSIPATVSRVLKYIPELQHQVQALNKKKEELLCRISKNLKGDSVNKESQRRISHHNSDFVVSTSRLNDCEAVVHISFYEAHKVPLSEILHCLENNGLLLLNASSSETFGGRFFYILHFQ

SEQ ID NO: 181137 - protein, 94 aa, Glycine max
  Coding DNA Sequence Number=SeqID_89452
MMIDNGQAASPTIWRQLSKYQLILLGKIPEVSWWNDLPLGSLIRACGGILLHLLLPIIPYAIQKHIVLKMGVGMVMKGKGLVEGSINAGVVGGG

SEQ ID NO: 181138 - protein, 424 aa, Glycine max
  Coding DNA Sequence Number=SeqID_89453
  Gene Ontology: Mol. function=protein disulfide oxidoreductase activity; Biological process=cell redox homeostasis
  Homolog annotation: Hit_ID=A2Q2Z6; Match level="QueryCoverage=99%, HitCoverage=99%, E-value=1e-133, Identity=60%"; Hit description =Thioredoxin fold
  Pfam annotation: Domain name=Gemini_AL2; Domain location=31-144; Score=-58.4; E_value=0.069; Accession=PF01440.7; Description =Geminivirus AL2 protein
  Pfam annotation: Domain name=Glutaredoxin; Domain location=280-346; Score=59.0; E_value=1.6e-14; Accession=PF00462.15; Description =Glutaredoxin
  Pfam annotation: Domain name=SH3BGR; Domain location=279-365; Score= -15.8; E_value=0.028; Accession=PF04908.6; Description=SH3-binding, glutamic acid-rich protein
  Pfam module annotation: Pfam domain module=Gemini_AL2::Glutaredoxin::S H3BGR; Domain location=31-144::280-346::279-365
  Subcellular localization annotation: CTP_CleavageSite=81; ConfidenceScore=5.72e-01
MGCSASRTITIVANNNNQLEDPSSASLASSFSSSSASHKSINSTSSPAAAPVRRRALSLPMPLVHHPPIKKGDTHHLVSLTSTTYGSLLLIDQKDPNLTQKNQPRLTKTSNQTDPAHSLSPDSVINTWELMDGLDEEEEEEEEEIANAKKKPPYTSILDKPSSCRYTAFDGSARKKLLDSFESLKTSQTAMEKENSSSSPAPTKKPLWQHLSEEALLAKLDPSVAWSYRRALSSRNLGRNTLSRDVRSMGSSPLIFHSSSFSFGKNNSLCRLSGTEDRIVLYCTSLRGIRKTYEDCCSVRMILRGFRVAVDERDISMDSSYRKELKDALGGKAVTLPQVFIRGRYVGNAEQMKHLNESGELARLLEGFPTQDPGFVCDNCGDARFVPCPNCNGSRKVFEHEEGGLRRCPDCNENGLIRCPGCCP

SEQ ID NO: 181139 - protein, 108 aa, Glycine max
  Coding DNA Sequence Number=SeqID_89454
MVPPDAAKGSIGSAPMLQRKGKIHDPRPHPFKNQIHVEKMILGSMLPPIDVFFIATPTPCGLIGIFVRKRTIPAIDVVVASIYLIWMPDWTKEMDIEAAMLWCLLKHS

SEQ ID NO: 181140 - protein, 227 aa, Glycine max
  Coding DNA Sequence Number=SeqID_89455
  Homolog annotation: Hit_ID=Q2HW59; Match level="QueryCoverage=98%, HitCoverage=97%, E-value=1e-100, Identity=74%"; Hit description =Cellular retinaldehyde-binding/triple function, C-terminal
MGGSSEDFSVVVLASDLGVDARPFLEHDQQQQEEENWHDCSQYLSPDEDFSDLDQLQFLRLQGSDKNSNRILRIVGNAFKWCAATVVSAERLKSTVQKEDNSPGITILSWIYEELPADFKDRLQTVYFIHPGFRSRLVIATLGRIFLSGGLYWKIKYVSRLQYLWDDIKKGEIEIPDFVKSHDDILENRPLTDYGIEPDPFHLTGIPSTTYSFGKYEERWAGRNYVS

SEQ ID NO: 181141 - protein, 70 aa, Glycine max
  Coding DNA Sequence Number=SeqID_89456
MTPPDREELTPRGPVGSRPEETPRREYAAVRVDQTALHAESDVAEGLPVDEEVEIEFAVPDVLCCRLNAL

SEQ ID NO: 181142 - protein, 230 aa, Glycine max
  Coding DNA Sequence Number=SeqID_89457
  Homolog annotation: Hit_ID=A5BVB3; Match level="QueryCoverage=68%, HitCoverage=6%, E-value=4e-11, Identity=26%"; Hit description =Putative uncharacterized protein
MTGYSTTCMNPLLLKDISNEVKDEGNQPISHVNKLVRLQRNFLWGGSSEQNKIAWIRWDMESRWSSEGQYRIHMVEGFEDGIPTSSSGTAVEQINIMEGWEWQFQWSRPLFDSEIEMTVAFIQEVEGYKIRSNIDDQWVWATESSGSYSARNAYRVIREGISEGEQDGQFKELWKLKVPSKVATFAWRSTDESASHLFFHCSKILPIWNAGEQMKMMVVSTDLDYLEAQK

SEQ ID NO: 181143 - protein, 578 aa, Glycine max
  Coding DNA Sequence Number=SeqID_89458
  Gene Ontology: Mol. function=phosphatidylinositol phosphate kinase activity; Cellular component=plasma membrane; Biological process =phosphatidylinositol metabolic process
  Homolog annotation: Hit_ID=Q2HW52; Match level="QueryCoverage=100%, HitCoverage=74%, E-value=0.0, Identity=76%"; Hit description =Phosphatidylinositol-4-phosphate 5-kinase
  Pfam annotation: Domain name=MORN; Domain location=16-38; Score=28.7; E_value=2.2e-05; Accession=PF02493.11; Description=MORN repeat
  Pfam annotation: Domain name=PIP5K; Domain location=274-574; Score =445.9; E_value=5.4e-131; Accession=PF01504.9; Description =Phosphatidylinositol-4-phosphate 5-Kinase
  Pfam module annotation: Pfam domain module=MORN::PIP5K; Domain location=16-38::274-574
MWGKGSFVWTNNGKVFEGFWEDGLPKGKGTFKWHDGSFYEGNFSKDGKDQNGTYHPCESSEGEGHSEWDPQQLYNELNGYSVCPGEKVQVMPSHKRLAIWRSTKTGESAKNRRMSVDGRVSVGLERPSDRLQIWDGGESDARTPTMGSDLDEDLMALRVDDGSESLTQLQPLKAPKKSKRQGETICKGHKNYELMLNLQLGIRHSVARPAPTASLDLKPSAFDPKEKVWTRFPPEGSKYTPPHPSCDFKWKDYCPVVFRTLRKLFKVDPADYMLSICGNDALRELSSPGKSGSFFYLTHDDRYMIKTMKKAEVKVLLRMLPAYYNNFRDQQNTLLTKYYGLHCVKLNGPIQKKVRFIIMGNLFCSEYITHRRYDLKGSSLGRFSDKPETEISETTILKDLDLNFIFRLEKSRFEEFCRQVDKDCELLEQEGIMDYSLLLGIYFKDISPDGEIIPLQSHTPTGDSENEGTPHTSSEDTDQSHYDPSSIILGMNMPAKVERTIRRSGCELQLVGEPIGEFYNGVLTFGIIDILQDYDISKKLEHAYKSIQYDPTSISAVDPIQYSRRFRDFIFRIFTEDS

SEQ ID NO: 181144 - protein, 390 aa, Glycine max
  Coding DNA Sequence Number=SeqID_89459
  Gene Ontology: Mol. function=L-isoleucine transmembrane transporter activity; Cellular component=integral to membrane; Biological process=amino acid transport
  Homolog annotation: Hit_ID=A7QJI3; Match level="QueryCoverage=99%, HitCoverage=76%, E-value=1e-114, Identity=53%"; Hit description =Chromosome chr8 scaffold_106, whole genome shotgun sequence
  Pfam annotation: Domain name=Aa_trans; Domain location=154-390; Score= -101.0; E_value=0.016; Accession=PF01490.9; Description=Transmembrane amino acid transporter protein
MAKNEYKERDSEFFMNKINENEEEQDIEAIGYHSDINDQCGSDNEGNRRTEPDSSSSQIWPQSYREATDSYSISAAPNLESIIRAPSVIYSSFIGGGGFGGAGFGSKSYLEHDERTSFLSGEELANQGITRRQSTWWEKASIQMQIPEELPVGYGCSLTQTIFNGINVMAGVGLLSTPYTVKQAGWAADLMKHCFESREGIISYPDIGQAAFGRYGRLIVSSYCVEFIILEGDNLTRLFPGTSLHWGSFQLDSKHLFGILTALVILPTVWLRDLRIISYLSAGGVVATALITICVFLVGTTDSVGFHLTGPLVKWSGMPFAFGIYGFCFAGHSVFPNIYQSMADKREFTKAVIASVAVMGYLMFGEGTLSQITLNLPPDAFASKVALWTI

SEQ ID NO: 181145 - protein, 1018 aa, Glycine max
  Coding DNA Sequence Number=SeqID_89460
  Gene Ontology: Mol. function=DNA topoisomerase (ATP-hydrolyzing) activity; Cellular component=mitochondrion; Biological process=DNA topological change
  Homolog annotation: Hit_ID=Q5YLB4; Match level="QueryCoverage=45%, HitCoverage=66%, E-value=0.0, Identity=70%"; Hit description=DNA gyrase subunit B, chloroplast/mitochondrial precursor
  Pfam annotation: Domain name=DNA_gyraseB; Domain location=798-968; Score=255.2; E_value=1.4e-73; Accession=PF00204.16; Description=DNA gyrase B
  Pfam annotation: Domain name=HATPase_c; Domain location=617-747; Score=88.4; E_value=2.3e-23; Accession=PF02518.17; Description =Histidine kinase-, DNA gyrase B-, and HSP90-like ATPase
  Pfam annotation: Domain name=Myosin_HC-like; Domain location=177-518; Score=612.0; E_value=5.5e-181; Accession=PF07058.2; Description =Myosin II heavy chain-like
  Pfam module annotation: Pfam domain module=DNA_gyraseB::HATPase _c::Myosin_HC-like; Domain location=798-968::617-747::177-518
MASTHIGNAGDADAKALKGRPKKPSDDFISLFHGSDPKDRELGDALAEIKSLRNSERLKEKGVEELTDELIKVDEKLKAAEALLESKNLEIKKINEEKRAALAAQFAAEATLRRVHAAQKDDEMPPIEAIIAPLEAELKLARMEDDNRALGRLTKSKEAALLEAERTVQIALAKASLVDDLQNKNQELMKQIEICQENKILDKMLRQKVAEVEKLTQTVRELEEAVLAGGAAANAVRDYQRKVQEMNDERKILEREVARAKVTANRVATVVANEWKDANDKVMPGEMQQLRDKLAIAERTAKAEAQMKEKYQLRFKVLEERVKTSNGNSKFTVSDGRNIATGPSRRQSFGGAESLSASSSNGYQSRKTSISRPGSLRSNSANVLLKHAKLSSRSFDGGSRNLERERPTSDANGLDNMPRNSNIQTITSETITTHEESANGTPVKKSKSENEDYVSGMLYDMLQKEVISLRKACHEKDLTLKDKDDAIEMLAKKVDTLSKAMEVEARKMRREVASMEKEVAAMRISKEHDHRARRASAPRGAVNSQSIPSRTSFPLRKFWAPCSVPNAVTPRAFMSSISTTEAFHNSESPTAYSSDQIQVLEGLDPVRKRPGMYIGSTGPRGLHHLVYEILDNAVDEAQAGFASKIDVVLLADDSVSITDNGRGVLHAGGKFGGANSGYSVSGGLHGVGLSVVNALSELLEITVWRDGMEYMQTYSRGKPVSILKCLVLPDERKDLRGTRVRFWPDKEVFTTAIQFDHNTIAGRIRELAFLNPKLTITFRKEDNDPEKVQYNEYFYAGGLVEYVKWLNTDKKALHDVLSFRKETDGITVDIAFQWSEDAYSDTILGYANSIRTIDGGTHIDAMKASITRTLNSLGKKSKVIKEKDITLSGEHVREGLTCVVSVKVPNPEFEGQTKTRLGNPEVRKVVDQSIQEYLTEYLELHPDVLDSVLSKALNAFKAALAAKRARELVRQKSVLRSSSLPGKLADCSSTDPEECEIFIVEGDSAGGSAKQGRDRRFQ

SEQ ID NO: 181146 - protein, 173 aa, Glycine max
  Coding DNA Sequence Number=SeqID_89461
  Gene Ontology: Mol. function=DNA topoisomerase (ATP-hydrolyzing) activity; Cellular component=mitochondrion; Biological process=DNA topological change
  Homolog annotation: Hit_ID=Q5YLB4; Match level="QueryCoverage=78%, HitCoverage=18%, E-value=1e-66, Identity=90%"; Hit description=DNA gyrase subunit B, chloroplast/mitochondrial precursor
  Pfam annotation: Domain name=Toprim; Domain location=39-114; Score =21.2; E_value=0.0014; Accession=PF01751.13; Description=Toprim domain
MEVVDCMDFSLVKRDRGRPERILENIVKRVLMAILPLRGKILNIERRDEAAMYKNEEIQNLILGLGLGVKGEDFKKDALRYHKIIILTDADVDGAHIRTLLLTFFFRYQRALFDEGCIYVGVPPLYKVVRGKQVHYCYDDADLKKLQRSFPPNASYNMQRFKGMMRSYFSCMH

SEQ ID NO: 181147 - protein, 61 aa, Glycine max
  Coding DNA Sequence Number=SeqID_89462
MENNEEQTDRCFGGIRKLSDEEIQRWEKHNNSSRNSGIPTGTVPFKALQLGKDSLWGRGWG

SEQ ID NO: 181148 - protein, 142 aa, Glycine max
  Coding DNA Sequence Number=SeqID_89463
MAQSGIYKRGEGLDRSFNGEWEDSHSGIFQQQGFHGNNRANLEGASGYRNQRSKKEPLHFKFPNEKDRALVEEGGDTKDIDLDDLPYGTWMKSSPMRANMETGIRNEVKIGIFRRRIYYLDKGSITRKEKETKQAIPLMMVK

SEQ ID NO: 181149 - protein, 154 aa, Glycine max
  Coding DNA Sequence Number=SeqID_89464
  Homolog annotation: Hit_ID=A5B9K6; Match level="QueryCoverage=60%, HitCoverage=10%, E-value=4e-17, Identity=44%"; Hit description =Putative uncharacterized protein
  Subcellular localization annotation: CTP_CleavageSite=33; ConfidenceScore=5.01e-01
MLEGGSSIDGSTLATGKGSTKGSSSSFGKALTKANRDDCWCSYCRKPGHTKETCFRLHGKEKDLVTGRTIGIAKEQGELYYLQHEDNKECTRQKVLTSTHRTSSEPWSSSQIWLQHRHLGHPLFSVLKSLFPFLFTKMSVESFHCDVCEFVKHH

SEQ ID NO: 181150 - protein, 385 aa, Glycine max
  Coding DNA Sequence Number=SeqID_89465
  Homolog annotation: Hit_ID=Q2HSZ5; Match level="QueryCoverage=25%, HitCoverage=32%, E-value=8e-37, Identity=77%"; Hit description=UBA -like
METTPKRSPKMDLAPLNDEVCKGILLERENWNVHQPKQVPTFLKPTFGSFKQYFEDNSEILVKLGNITRKREERKSLQKRTSSEAQQKSPRNIVGSLLPEMKARNVSGRAVKRRNSGMLKWCLACKRRSPAGKVAGEFPRVAPVTRKEVGKGGNCWKEGHQAKKVKEICQKKRKYRGIMSENRLSKRPYEDDPTANLVTPGPYGLIFASFLPFFFDIPVSTRFRVFSFLFSDKSFIYLAGLQLLLSSWKRSILPGMCGILAGSLYRLNVFYIRKAKLYLYVHTMVVSIARVAICYMRFGGPAMQIGLRILVAEPLPELCKSHENCYLFELHDSGTSWVAESSMKAIAAALYAIDLCRITSVALLVRHSTTTKISDVLQKKMAFRV

SEQ ID NO: 181151 - protein, 471 aa, Glycine max
  Coding DNA Sequence Number=SeqID_89466
  Gene Ontology: Mol. function=transporter activity; Cellular component= integral to membrane; Biological process=auxin mediated signaling pathway
  Homolog annotation: Hit_ID=A2Q4I5; Match level="QueryCoverage=97%, HitCoverage=79%, E-value=0.0, Identity=84%"; Hit description=Auxin Efflux Carrier
  Pfam annotation: Domain name=Mem_trans; Domain location=1-471; Score =377.6; E_value=2e-110; Accession=PF03547.9; Description=Membrane transport protein
MGIPLLKGMYGDDSGTLMVQIVVLQCIIWYTLMLFLFEYRGARLLIVEQFPDTAGSIISFKVDSDIISLDGKEPLQTEAEVGDDGKLHVTVRKSASSRSEIFSRRSHGGLNSVSLTPRPSNLTNAEIYSLQSSRNPTPRGSSFNHTDFYSIVNGGGGRNNNVSVSPRQSNFGGFDEESGGGMRVNGGYPGPANAGIFSPVAKKKGGESGGGGGGGGKDLHMFVWSSSASPVSEGGIHAFRGGGDYGSDQLPVCGVAHQKDYDEFGHDEFSFGNRTIANGVDKEGPVLSKLGSSSTAELHPKAQGESKPTSMPPTSVMTRLILIMVWRKLIRNPNTYSSLFGLTWSLISFKWNVVMPAIVAKSISILSDAGLGMAMFSLGLFMALQPKIIACGNSVASFAMAVRFLTGPAVMAVASIVVGLRGVLLHIAIVQAALPQGIVPFVFAKEYNVHPDILSTGFVFLYSSFAFAILS

SEQ ID NO: 181152 - protein, 184 aa, Glycine max
  Coding DNA Sequence Number=SeqID_89467
MGLHRRDELLRLWLLSELRHKVLHHDGTGDGAGNSGGDGEALLLAIDLNGPVAGLRAEDDASAGAEEVRLEPRQARPVFFCGKGFRSPPRTSLRVRVEAVPRCLFWRSMSRRLFEDIFLLCRGELLCVWNWCEEKKMQDDVKEREVAVVGVERERESEAIVVSSSLILRILLFFLGLFFSFPVN

SEQ ID NO: 181153 - protein, 342 aa, Glycine max
  Coding DNA Sequence Number=SeqID_89468
  Gene Ontology: Mol. function=hydroxymethylglutaryl-CoA lyase activity; Cellular component=mitochondrial inner membrane; Biological process=metabolic process
  Homolog annotation: Hit_ID=A2Q4I7; Match level="QueryCoverage=85%, HitCoverage=77%, E-value=1e-120, Identity=76%"; Hit description =Pyruvate carboxyltransferase
  Pfam annotation: Domain name=HMGL-like; Domain location=68-322; Score= 189.1; E_value=1.1e-53; Accession=PF00682.10; Description=HMGL-like
MAKRLIPLFNRVLVEKIVPPSKITTGILLPEKSTKISFLENLWLTIYEMLQLLTSIPDYVKIVEVGARDGLQNEKAIIPTNVKVELIKLLVSSGLSVVEATSFVSPKWVPQLADAKDVLAAIQNVEGARFPVLTPNLKGFEAAVAAGAKEVAVFPAASESFSKANLNSSIEDNLARCHDIASAARSLSIPVRGYNFQFILVHLYRNIAPAKVAYVAKSLYEMGCSEISLGDTIGVGTPGTVISMLEAVLDVVPTDMLAVHFHDTYVDSSVSGLGGCPYAKGATGNVATEDVVYMLNGLGVKTNVDLGKLMLAGDFICKHLGRASGSKAATALSKVTSHASKL

SEQ ID NO: 181154 - protein, 115 aa, Glycine max
  Coding DNA Sequence Number=SeqID_89469
  Gene Ontology: Mol. function=receptor activity
  Homolog annotation: Hit_ID=Q9FQ21; Match level="QueryCoverage=66%, HitCoverage=16%, E-value=3e-32, Identity=89%"; Hit description =Putative Hs1pro-1-like receptor
  Pfam annotation: Domain name=Hs1pro-1_C; Domain location=1-115; Score= -64.6; E_value=1.2e-09; Accession=PF07014.3; Description=Hs1pro-1 protein C-terminus
  Subcellular localization annotation: CTP_CleavageSite=36; ConfidenceScore=5.44e-01
MQSSPEPSRRWRRIATTSWKGSRSFSRGLKNQLSVKSSNGETTSFCFKSKELIELTKMCRDLRHKVLEILEVEVDPKRGPRIQEAAMKLYISKSAFEKVHLLQTMHFRIFSLDKI

SEQ ID NO: 181155 - protein, 85 aa, Glycine max
  Coding DNA Sequence Number=SeqID_89470
  Homolog annotation: Hit_ID=A7QX73; Match level="QueryCoverage=90%, HitCoverage=19%, E-value=4e-07, Identity=32%"; Hit description =Chromosome chr6 scaffold_214, whole genome shotgun sequence
MKVEGIGSVRMKLHDGVIRTFSYVRFVPFVVVNMISMGEMTSQGYKYVALKRNHDNKVKKKARFSNVVEVLGDISVGGEVCSLSN

SEQ ID NO: 181156 - protein, 99 aa, Glycine max
  Coding DNA Sequence Number=SeqID_89471
MIGWLKKGNEEWLEKEGSPIRDAQALDIFNRKLRDSVCLSFQLLTPFIGLRLSAEFALSTPLGFLVGLLHTKRELAAKQGSTLGRSCTLSELSKSSTFL

SEQ ID NO: 181157 - protein, 185 aa, Glycine max
  Coding DNA Sequence Number=SeqID_89472
  Gene Ontology: Mol. function=protein binding; Cellular component =intrinsic to membrane; Biological process=defense response
  Homolog annotation: Hit_ID=A2Q4E5; Match level="QueryCoverage=90%, HitCoverage=18%, E-value=8e-36, Identity=46%"; Hit description =Disease resistance protein
  Pfam annotation: Domain name=LRR_1; Domain location=114-136; Score =7.0; E_value=16; Accession=PF00560.24; Description=Leucine Rich Repeat
  Pfam annotation: Domain name=LRR_1; Domain location=12-34; Score=9.1; E_value=6.3; Accession=PF00560.24; Description=Leucine Rich Repeat
  Pfam annotation: Domain name=LRR_1; Domain location=138-161; Score =1.0; E_value=2e+02; Accession=PF00560.24; Description=Leucine Rich Repeat
  Pfam annotation: Domain name=LRR_1; Domain location=90-112; Score =9.7; E_value=4.8; Accession=PF00560.24; Description=Leucine Rich Repeat
  Pfam module annotation: Pfam domain module=LRR_1::LRR_1::LRR_1::LRR _1; Domain location=114-136::12-34::138-161::90-112
MESIFGGVKFPALKTLYVVDCHSLKSLPLDVTNFPELETLVVQDCVNLDLDLWKEHHEEQNPKLRLKFVAFVGLPQLVALPQWLQETANSLQSLAIKNCDNLEMLPEWLSTLTNLKVLHILACPELISLPDNIHHLTALERLRIAYCPELRRKYQPHVGEFWSKISHIKEVLIEEPEKLEEEEDE

SEQ ID NO: 181158 - protein, 342 aa, Glycine max
  Coding DNA Sequence Number=SeqID_89473
  Gene Ontology: Mol. function=molecular_function; Cellular component =membrane; Biological process=auxin mediated signaling pathway
  Homolog annotation: Hit_ID=A7PTC6; Match level="QueryCoverage=96%, HitCoverage=95%, E-value=1e-132, Identity=64%"; Hit description =Chromosome chr8 scaffold_29, whole genome shotgun sequence
  Pfam annotation: Domain name=DUF6; Domain location=161-282; Score =28.9; E_value=1.9e-05; Accession=PF00892.11; Description=Integral membrane protein DUF6
  Pfam annotation: Domain name=DUF6; Domain location=25-158; Score =54.9; E_value=2.8e-13; Accession=PF00892.11; Description=Integral membrane protein DUF6
  Pfam module annotation: Pfam domain module=DUF6::DUF6; Domain location=161-282::25-158
MEGDGYCGSFFQRCKPYIAMVSLQFGFAGMNIITKVSLNRGMSHYVLVVYRHAFATAAIAPFAIVLERKVRPKMTFLMFMQIFVLGLLGPVIDQNLYYAGLKFTSPTYSCAISNILPAMTFVMAAIFRMEKLDMRKVRCQAKVIGTIVTVAGAMLMTLYKGQAVTLRKYPAQLSLTALVCALGTLQSIAVTFVMEHKPSVWTIGWDMNLLAAAYAGIISSGITYYVQGIVMQKKGPVFVTAFSPLMMIIVAIMGAFILAEKIYLGGVVGAILIVMGLYSVLWGKHKENKEKEAETTMEVMKCCSENGRLETVVEDAETNNDIEMQKGEASRELRVVISAPKA

SEQ ID NO: 181159 - protein, 84 aa, Glycine max
  Coding DNA Sequence Number=SeqID_89474
MAYNEIFREIRKQMFPQKICISPHSVVPLLLALTKIVTRCNEISHAVVSATTVTAEWRRCEVRQRLGKLIREWCDSDGARYMTA

SEQ ID NO: 181160 - protein, 707 aa, Glycine max
  Coding DNA Sequence Number=SeqID_89475
  Gene Ontology: Mol. function=transferase activity, transferring glycosyl groups; Cellular component=cytoplasm; Biological process =carbohydrate metabolic process
  Homolog annotation: Hit_ID=A7PTD8; Match level="QueryCoverage=91%, HitCoverage=64%, E-value=0.0, Identity=75%"; Hit description =Chromosome chr8 scaffold_29, whole genome shotgun sequence
  Pfam annotation: Domain name=Glyco_hydro_77; Domain location=14-664; Score=460.8; E_value=1.7e-135; Accession=PF02446.8; Description=4 -alpha-glucanotransferase
MQHADAVRTGTLETSLSSPSSSLFLEVLTLKVQQQAAARNTGKKAKRKNEKLKISLSVFALHPLYLRVQALSKNIPEEIKKEIEKAKQQLDGKDVDYEATMATKLSIAKKVFAQEKDLILNSSSFKEFFSENEGWLKPYAAFCFLRDFFETSDRTQWGCFAHYSEDKLEKLVSKDSLHYEIICFHYYVQYHLHLQLSEAAEYARKKGVILKGDLPIGVDRNSVDTWVYPNLFRMNTSTGAPPDYFDKNGQNWGFPTYNWEEMSKDNYGWWRARLTQMAKYFTAYRIDHILGFFRIWELPDHAATGLVGKFRPSIPLSQEELEREGIWDFNRLSYPYIKRELLQEKFGDAWTFVATTFLKEIDKNFYEEKDKDPIKWGLGMVDFKEDCNTEKKIASKLKTCAESSLLLESVDKLQRNLFDLSQNIVLIRDPEDPRKFYPRFNLEDTISFQDLDDHSKNVLKRLYHDYYFCRQENLWRQNALKTLPVLLNSSDMLACGEDLGLIPSCVHPVMQELGLVGLRIQRMPNEPDLEFGIPSKYSYMTVCAPSCHDCSTLRAWWEEDEERRLRFFKNVMESDGLPPDQCVPEVAHFVIRQHFEAPSMWAIFPLQDLLALKEEYTTRPATEETINDPTNPKHYWRFRVHVTLESLIKDNDLQTTIKDLVSWSGRSLPKEDDSEIEASPVSVLSAAEALSEKQKFASTTEKPVLVK

SEQ ID NO: 181161 - protein, 223 aa, Glycine max
  Coding DNA Sequence Number=SeqID_89476
  Subcellular localization annotation: CTP_CleavageSite=28; ConfidenceScore=5.59e-01
MILVRPLASSSPRLASSSPGPLNDFKVKESARLGEPVTSGVSLSSLGRVAIVPSAFFSINRREGEVERGFQGSEVERIEKREKEEKTKPRRYRITTLTNPYIVSCSVFFVRPSHSSRPLPGDPEYARFISVADDHEHGGLLGTVGLGPESSLPFWGEAAEDTPEAGEAEDTPEEEAGAKDAPVEAVEVGVSGATEADIDIDYVADVIAAQGTWDPWPTPDQDD

SEQ ID NO: 181162 - protein, 125 aa, Glycine max
  Coding DNA Sequence Number=SeqID_89477
  Gene Ontology: Mol. function=transcription elongation regulator activity; Biological process=nucleobase, nucleoside, nucleotide and nucleic acid metabolic process
  Homolog annotation: Hit_ID=Q2HUT6; Match level="QueryCoverage=68%, HitCoverage=6%, E-value=3e-13, Identity=43%"; Hit description=SH2 motif; Alcohol dehydrogenase, zinc-containing; Resolvase, RNase H- like fold; Nucleic ...
  Homolog annotation: Hit description=acid-binding, OB-fold, subgroup
MGIRTNILVECLVHMVVDEDVVVAEDSGYGGRWGSNNTKDSDDGLSNFPGAKVQNSPGREAFPGGWGGGGSGGGGASNSDNGGWEQASGGAGPSDGEQGSSGWGSATKKAASGNGWGSGNSGGGW

SEQ ID NO: 181163 - protein, 718 aa, Glycine max
  Coding DNA Sequence Number=SeqID_89478
  Gene Ontology: Mol. function=alpha-N-arabinofuranosidase activity; Cellular component=extracellular region; Biological process=L -arabinose metabolic process
  Homolog annotation: Hit_ID=Q1HGK8; Match level="QueryCoverage=97%, HitCoverage=90%, E-value=0.0, Identity=58%"; Hit description=Alpha-L- arabinofuranosidase
  Pfam annotation: Domain name=Alpha-L-AF_C; Domain location=443-616; Score=119.5; E_value=1e-32; Accession=PF06964.3; Description=Alpha-L- arabinofuranosidase C-terminus
  Pfam annotation: Domain name=CBM_4_9; Domain location=66-222; Score= -15.1; E_value=0.057; Accession=PF02018.8; Description=Carbohydrate binding domain
  Pfam module annotation: Pfam domain module=Alpha-L-AF_C::CBM_4_9; Domain location=443-616::66-222
MAYCSLKVLFGVVLYAFAFQHCYADANSTLIVNAASNNATARQIPNTFLGVFVEEINHAGAGGLWAELVINRGFEAGGPNNALNVYNWSIIGDESSISVSISRTSCFERNKAALQMEVYCGAHKPCPYGVGISNPGYWGMQGKRYKVVYHVKSERKFDFQLSFTGVDVIKVASSRRHVYGDGKWKRVETIVEAKTTNHYSSLQITTTREGSYLLDQVSVMPLDTYMGHGFRNDLFQMVADLKPKFLRFPGNYLRNRFQWKDTIGPWEERPGHLGDVWNYWSDDGIGFFEYLLLAEDLGALPIWVFNAGFGLNDEIDTSSIESYVQDALDGIEFARGSPTSQWGSVRAAMGHPTPFDLRYVAVGNENCWQTYFNYQGNYLKFYEAIKAAYPDIQIISNCDASRKPLNHPADLFDFHTYPSSNDMFSLFTKFDNTSRSGPKAFVSEYAVKSDAANGNLLAAVAEAAFLIGLEKNSDIVEMVSYAPLFLNINDKRWIPDAIVFDSYQVYGTPSYWVQKLFIESSGATFIDSTLSTTSSNKLAASVIIWQDSSDKKNYLRIKAVNFGAAAESLDIDLSGLDSNVQQYGSTITVLTSTNVMDENSFLEPKKRPGHFGDVWSYWTDEGFGYFEGLQLAEDIGARPLWVFNNGTFTFVAICHEALDGIEFARDEATSRWGSLRASMGHPKPFDLKNVAIGNEDCGKTNYQGMLSRFLLSFFKYLH

SEQ ID NO: 181164 - protein, 441 aa, Glycine max
  Coding DNA Sequence Number=SeqID_89479
  Gene Ontology: Mol. function=metal ion binding; Cellular component =plasma membrane; Biological process=cytokinin metabolic process
  Homolog annotation: Hit_ID=A7PM08; Match level="QueryCoverage=88%, HitCoverage=73%, E-value=1e-122, Identity=59%"; Hit description =Chromosome chr14 scaffold_21, whole genome shotgun sequence
  Pfam annotation: Domain name=Copine; Domain location=57-217; Score =257.5; E_value=2.8e-74; Accession=PF07002.7; Description=Copine
MAACSSCFDKCLLNYAKLNSMKTKIRPPCLESSNLIVGVDFTKSNEWTGKNSFNRRSLHHIGRGLNPYEQAISIIGKSLAAFDEDNLIPCFGFGDDMAKRISMISWQHQHTIKMSSVSIRVKDFADGFEDVLSRYREIVPHLRLAGPTSFAPIIEMAMSIVEQSGGQYHVLVIIADGQVTKNVDTKHGRLSPQEQKTVDTIVAVSKFPLSIILVGVGDGLWDMMKEFDDNIPARAFDNFQFVNFTEIMSKSIPPSRKEAAFALAALMEIPSQYMAAIELNLLGSRQANAPQRHALPPPTYSSRAARFEPSIPPQHGNSHPFATAPSAPSSTYDNQRDIHGTSCLKNLLSNEASMLVDVSDKTECVNLECHLLHNFGVSSVRHKLCPICLSNAKDMAFGCGHQQQSGDSDYVSDDHDSSEGMVLAMMGDSIVQAKCKPGWLS

SEQ ID NO: 181165 - protein, 76 aa, Glycine max
  Coding DNA Sequence Number=SeqID_89480
  Gene Ontology: Mol. function=endonuclease activity
  Homolog annotation: Hit_ID=Q2HUP4; Match level="QueryCoverage=98%, HitCoverage=35%, E-value=5e-21, Identity=53%"; Hit description =Endonuclease/exonuclease/phosphatase
  Subcellular localization annotation: CTP_CleavageSite=51; ConfidenceScore=5.22e-01
MDQLRNNVNARSLPGSNALYSSSTVSKEQGPLHRRPDVVKSTLTGKSMEIVDVMVRRKINFMCLQETKWIGEKRKN

SEQ ID NO: 181166 - protein, 49 aa, Glycine max
  Coding DNA Sequence Number=SeqID_89481
MAWKGFTFSGLAIFAFSGFCVVVVKARVVATKKTRILAPLKIYVYMCKF

SEQ ID NO: 181167 - protein, 55 aa, Glycine max
  Coding DNA Sequence Number=SeqID_89482
MGLRRKRMKNGGTLSELRCRMAFDKGGGRGRGYGKIMGGCKSRNEGENENSSIRI

SEQ ID NO: 181168 - protein, 383 aa, Glycine max
  Coding DNA Sequence Number=SeqID_89483
  Gene Ontology: Mol. function=P-P-bond-hydrolysis-driven protein transmembrane transporter activity; Cellular component=chloroplast outer membrane; Biological process=intracellular protein transport
  Homolog annotation: Hit_ID=Q41009; Match level="QueryCoverage=98%, HitCoverage=100%, E-value=3e-88, Identity=83%"; Hit description =Translocase of chloroplast 34
  Pfam annotation: Domain name=AIG1; Domain location=37-214; Score =124.2; E_value=3.8e-34; Accession=PF04548.7; Description=AIG1 family
  Pfam annotation: Domain name=MMR_HSR1; Domain location=37-132; Score =26.5; E_value=4e-06; Accession=PF01926.14; Description=GTPase of unknown function
  Pfam module annotation: Pfam domain module=AIG1::MMR_HSR1; Domain location=37-214::37-132
MASQIREWSGINTFAPATQTKLLELLGNLKQENVNSLTILVMGKGGVGKSSTVNSIIGERVVSISPFQSEGPRPVMVSRSRAGFTLNIIDTPGLIEGGFLLNKTIDVLLYVDRLDVYRVDNLDKLVAKAITDSFGKGIWNKAIVTLTHAQFSPPDGLPYDEFFSQRSESLLKVLRSGARIKKEAFQGPAAMQHYIVKVLLLITLTGNSVKQPEAANLDSIGEFCVAGVSAANSIHSQNLWSLLPLLIKMRLNSSPGEEHLRFQQTHSSIAASIPVVLVENSGRCNKNDSDEKVLPNGTAWIPNLVQTITEIALNKSESIHVDKNLIEGPNPNQRGKLWIPLVFALQYFLIMKPIKGLIEKDIANERKPTWERRDAAFRKRDLY

SEQ ID NO: 181169 - protein, 82 aa, Glycine max
  Coding DNA Sequence Number=SeqID_89484
MGVSIKESEAQAPVNTLGHIDLLFRNYGFGGVCWTPGHDKGLSLSGLVVDLGSLKSLSGNVSYLQKFEGLEILLQRKSGKFF

SEQ ID NO: 181170 - protein, 113 aa, Glycine max
  Coding DNA Sequence Number=SeqID_89485
HKADNQVSSTAHVCLLKSFLRITLDVHDNLGQETKVQQRLTMSEAISALVKEFSNRRTDHLGRKRRGRRFLVRVTKAALDSGDKDGTLGFADQMQKPLKNKQGGSRYHIEETR

SEQ ID NO: 181171 - protein, 38 aa, Glycine max
  Coding DNA Sequence Number=SeqID_89486
MDLSEENLDLPIAFRKSLEHNGTWELVPLPLGKKPIGC

SEQ ID NO: 181172 - protein, 745 aa, Glycine max
  Coding DNA Sequence Number=SeqID_89487
  Homolog annotation: Hit_ID=Q2HVW1; Match level="QueryCoverage=10%, HitCoverage=33%, E-value=7e-09, Identity=35%"; Hit description =Putative uncharacterized protein
MERETENEREREIERDTETERESKRKGVKEEERESVRERGRSSARDLKRNQYGRVRYRLSKESRGRRCQVMVERNFTREDDNHRVIDNKHQEDPWIEVGGRRKAWRQTKTEQGAGSRRQREIYVYPTSGKHRPQSWRSKKDITSFYFSHFPDSEWENVWEVFVPKSKNKQGHKYGFVRFKGVEEEGRLERQLDNNIYIEGMKMFVNKPKFQRGGKRDIQNPAGDGNGVRKKLMIPMEPNQPRPNSMPSTSLKSYAEVVKCNPAMKEKEIVVPLLGKNSLEPPAASVTLHTSKENNKWLDQAWVGRIKNRGMFERVVEEVQEVVGEEVKVSYWGDDMIILYDMDEVKAGKINLREQTNGETPLYSIQKWMPAMKPEFRLIWIHIWGVPLEVWDAEQFAILLSTYGELIELDEETADRSRLDVARVLLRTKEKPFFSKSMVVTVNGTEHQLVLKEDMPRLKGKWQRRPETEILPPSPFTTAVEDSDDVMTASTPDGASSNCFRDRRRRRWTRAINLWRTESEAHSEDDVSLHRSEVPSAVGLLPLPARHVDYNSPLHSPLHGHGMLERRDSSLGQQQMLLEEKAGEGPNEVDSGKGADLWVLQHDPKDINPVSYPLVKPNSNLSNKETFELNNPVQKKENNEVLQELGLITNGPTSKGEETVLNLKVYSRRKDGVGRNFLAHINSNSVSKAKRDDNKPYSLDLAENDTINKNDDMAGGVQVAEVDPIQHQHCQPYSLQQFQQSSFRK

SEQ ID NO: 181173 - protein, 282 aa, Glycine max
  Coding DNA Sequence Number=SeqID_89488
  Homolog annotation: Hit_ID=A5AD69; Match level="QueryCoverage=47%, HitCoverage=13%, E-value=8e-11, Identity=32%"; Hit description =Putative uncharacterized protein
  Subcellular localization annotation: CTP_CleavageSite=30; ConfidenceScore=5.58e-01
MKVFKCPKNQASTTGGETIPATRTPTSVTSVPMNQDVSSTSLPMTNFSKQITKKLNDKIILMWKQQIQPTITMLGFNNFVTSPQIPPRYLFDADHDLDHLNPQFSLCSMLTRVLGSLHSYQVWDKIHAYFHHQTQTKARQLQSELRHTYLENQLVLEYLGKIKMIVDVLFQLVMLQPIVSTWTPFLKNCVFKKHVNLNHGNSSQSITDDDSGSNSSSNTNMTYANQYSSDSRVSGGRNNQGGGGYKRGGGRSGGRSGGRGGRSSVQCQVCFKYNHNALTCYN

SEQ ID NO: 181174 - protein, 133 aa, Glycine max
  Coding DNA Sequence Number=SeqID_89489
  Gene Ontology: Mol. function=protein binding; Cellular component =cytoskeleton; Biological process=phagocytosis
  Homolog annotation: Hit_ID=A7Q9Z2; Match level="QueryCoverage=76%, HitCoverage=31%, E-value=4e-34, Identity=67%"; Hit description =Chromosome chr8 scaffold_68, whole genome shotgun sequence
  Pfam annotation: Domain name=ELMO_CED12; Domain location=61-132; Score=0.7; E_value=0.00028; Accession=PF04727.4; Description=ELMOCED- 12 family
  Subcellular localization annotation: CTP_CleavageSite=22; ConfidenceScore=5.16e-01
MEKANLVLGSGSILGRLLSFPSAALNMQNNRMFPPSLSPLQEERLRNLRQRLEVPFDGSKAEHQDALKQLWKLAYPDRELPSLKSDLWKEMGWQGSDPSTDFRGGGFISLENLIFFAMKYPKLPDCYIIFHCD

SEQ ID NO: 181175 - protein, 89 aa, Glycine max
  Coding DNA Sequence Number=SeqID_89490
MSNVRINVKRKRVIRARMKITNDDLSVGTTASARRHLGWRCNDVGERTRARVGVQGDREVPLALAGCRKELATSEVFDPVCPTLLGCFS

SEQ ID NO: 181176 - protein, 622 aa, Glycine max
  Coding DNA Sequence Number=SeqID_89491
  Gene Ontology: Mol. function=transketolase activity; Cellular component=chloroplast thylakoid membrane; Biological process=pentose- phosphate shunt, oxidative branch
  Homolog annotation: Hit_ID=O20250; Match level="QueryCoverage=67%, HitCoverage=71%, E-value=1e-110, Identity=46%"; Hit description =Transketolase, chloroplast precursor
  Pfam annotation: Domain name=Transket_pyr; Domain location=368-542; Score=122.1; E_value=1.6e-33; Accession=PF02779.15; Description =Transketolase, pyrimidine binding dom
  Pfam annotation: Domain name=Transketolase_N; Domain location=142 -403; Score=109.4; E_value=1.1e-29; Accession=PF00456.12; Description= Transketolase, thiamine diphosphate b
  Pfam module annotation: Pfam domain module=Transket_pyr::Transketolase _N; Domain location=368-542::142-403
  Subcellular localization annotation: CTP_CleavageSite=16; ConfidenceScore=5.01e-01
MVLLSESIPAPPTPVSSDSAKDHVTMNPVNTTFDVKCLSGRRFFYASIQNYLQLWPSKDIPSPPDKPMIMVNYKGEDKQFAAKEMSSMVLTKMRKTNILDALAGISLPLDQGIFTRVPLVMRLQNHPLPTPELVLEFNGTTSSTDAIEKANSGHPGLPMGCATMDHILYDEVMNYYSNNPTCFNHFILSTRHVCMLQFILLHLASCDNVLEEDLKEFRQWGTRVPGHPMNFEPFRIEVTTGPPGQGIANVVGLALALYDDNHISIGGDPEIIFTANVDQCFEALRWHVIRVKNENTGYVEIHATIKEAKVIKHKSTLIKVTTTVGFSSPSKANSYSVQASALELKVIITGKFPSGWAKALPTYTPENPTDVTRNLSKENLNALLKVLPGLLGGSANLASSLMTLLKSYGDFQKNNIKERNVRFGVREHGMGAIYHGIALHSTRFIPYYATFFIVIDYMRAAIRIYALCEAKVIYVLTHDSIRLGEDGPLCQPIEHLASFMAMSNTLMLCPVDGNETVGSYKVVVVNRKTPSILALFSQKLTQLLGTSNEEVEKRGHIISDNSLVNGDRFCALLPRGARVKYLLNVGYFINGNDVLGEQHIAQYFSQVVATHGVEQHYMGKWD

SEQ ID NO: 181177 - protein, 359 aa, Glycine max
  Coding DNA Sequence Number=SeqID_89492
  Gene Ontology: Mol. function=drug transporter activity; Cellular component=membrane; Biological process=multidrug transport
  Homolog annotation: Hit_ID=A7Q9Z0; Match level="QueryCoverage=93%, HitCoverage=77%, E-value=1e-118, Identity=56%"; Hit description =Chromosome chr8 scaffold_68, whole genome shotgun sequence
  Pfam annotation: Domain name=MatE; Domain location=1-113; Score=8.7; E_value=0.00066; Accession=PF01554.9; Description=MatE
  Pfam annotation: Domain name=MatE; Domain location=173-295; Score =30.8; E_value=5e-06; Accession=PF01554.9; Description=MatE
  Pfam module annotation: Pfam domain module=MatE::MatE; Domain location=1-113::173-295
MASALSTLCGQAYGAKEYDMMGVYLQRSWIVLFLTAICLLPLLIFTSPILTILGQDESIGQVAGTISLWSIPILFAYIVSNNCQTFLQSQSKNVIISFLAALSIIIHVSLSWLFTMQFKYGIPGAMISTILAYWIPNIGQLIFITCGWCPETWKGFSVLAFKDLWPVAKLSISSGAMLCLEFWYSTILILLTGNMKNAEVQIDALSICININGWEMMIAFGFMAAAREKVAYLFTSNEDVATAVGDLSPLLAVSLLLNSIQPVLSGVAVGAGWQSTVAYVNIGCYYLIGIPVGIVLGNIIHLQVKGIWIGMLFGTLIQTIVLTIITYKTNWDEQVIIARSRINKWSKVESDHETTTSDN

SEQ ID NO: 181178 - protein, 268 aa, Glycine max
  Coding DNA Sequence Number=SeqID_89493
MEEAQIWAKKVELPAFMGTNPIGWIARVEKFFENLVKQRLTLGKERWNYLALIEVELPSFDRSIEGGTNLKGSNFECDSDPLQFLKSENKSKEGLVIKNHTLCDGEETKNDETKLGREKKKIEKVMGEEVDPSIKREKHRENGVANVGYEDNFLDNPITDLIKKEVEAGDSTKPHCFQDSDFHKKIVMVKQKPFIKVVGTTMVLESWNVNLLGKPLALNFVASMTDNLAMELRQNECTEPINLIKLYGVHPCHSHHRSHQTSVCMQGQ

SEQ ID NO: 181179 - protein, 625 aa, Glycine max
  Coding DNA Sequence Number=SeqID_89494
  Gene Ontology: Mol. function=methylcrotonoyl-CoA carboxylase activity; Cellular component=mitochondrial matrix; Biological process=leucine catabolic process
  Homolog annotation: Hit_ID=A7P9K7; Match level="QueryCoverage=90%, HitCoverage=81%, E-value=1e-156, Identity=79%"; Hit description =Chromosome chr3 scaffold_8, whole genome shotgun sequence
  Pfam annotation: Domain name=Carboxyl_trans; Domain location=1-566; Score=491.5; E_value=1e-144; Accession=PF01039.13; Description =Carboxyl transferase domain
MGHYLYEEPLPSGGVVTGIGPVHGRLCMFVANDPTVKGGTYYPITVKKHLRAQEIAAQCKLPCIYLVDSGGAFLPKQAEVFPDRENFGRIFYNQAVMSAQGIPQIALVLGSCTAGGAYIPAMADESVMVKGNGTIFLAGPPLVKAATGEEVSAEDLGGATVHCKTSGVSDYFAQDELHALALGRNIIKNLHMAGKDVLANGLQNINYEYKEPLYDVNELRSIAPTDLKQQFDIRSVIDRIVDGSEFDEFKKLYGTVRTYPLYFFICLTIILISMGCYGMTFFLSAPTLVTGFARIFGQPVGIIGNNGILFNESALKGAHFIELCTQRNIPLVFLQNITGFMKYNNVEFRKYRGIGDTVVKGPSILKPVAIDGIAISKPLDQSCLVLNILVDGHHVFLTVVLFFIKWCMSVGIQVGSRSEANGIAKSGAKMVMAVSCAKVPKVTIMVGGSFGAGNYAMCGRAYSPNFLFLWPNARISVMGGAQAAGVLAQIEKGNKKRQGIQWSKEEEDKFKGKVVEAYEREASPYYSTARLWDDGIIDPADTRKVIGLSISASLNRDIQNTKYAMVFSRWSQHPPLQKFSQGACSSNTNPLYPSELPLPNPSSHLQVVFKSMYDPCALTMVLPKH

SEQ ID NO: 181180 - protein, 42 aa, Glycine max
  Coding DNA Sequence Number=SeqID_89495
MEINKNILGAQIWIRRGKTMAKNENGTTVITERGPIVSELNP

SEQ ID NO: 181181 - protein, 133 aa, Glycine max
  Coding DNA Sequence Number=SeqID_89496
  Gene Ontology: Mol. function=transferase activity, transferring glycosyl groups; Cellular component=integral to membrane; Biological process=protein amino acid glycosylation
  Homolog annotation: Hit_ID=Q9ST51; Match level="QueryCoverage=90%, HitCoverage=23%, E-value=6e-60, Identity=93%"; Hit description=Fuct c3 protein
MSLCTRRGYNIVMTTSLSSDVPVGYFSWAEYDIMAPVQPKTEAALAAAFISNCGARNMRLQALEALEKSNIKIDSYGGCHRNRDGRVDKVEALKHYKFSLAFENSNEEDYVTEKFFQSLVADVRGLQEHLHPI

SEQ ID NO: 181182 - protein, 90 aa, Glycine max
  Coding DNA Sequence Number=SeqID_89497
MTLLLSNILPSDRNANLPLRKYQLGLCRPDMGIAPTKTPSEPEEVQQGPGVSSSGYGPLSVLQGARIAPARHPVDPKKSNRVLELSSSNH

SEQ ID NO: 181183 - protein, 206 aa, Glycine max
  Coding DNA Sequence Number=SeqID_89498
  Homolog annotation: Hit_ID=A5ADW6; Match level="QueryCoverage=54%, HitCoverage=4%, E-value=4e-08, Identity=32%"; Hit description =Putative uncharacterized protein
HSITGESVHSVIGDFEHPDLEHYNFEHSDSEHSDFAHSENMAQPPPRERTLREMAAPDFTYESLCIQYPDEDAPYVLKTGLIHLLPKFHGLAGSGKGLVVLPSPRSITSWDDLKRVFLEKFFPASRTTAIRKDISGLSNMERSMIDAASGGALGDMTPAEAKNLIEKMAPSASSETKKLEGKLDALVNLVTQLALNQKSVPVARVC

SEQ ID NO: 181184 - protein, 110 aa, Glycine max
  Coding DNA Sequence Number=SeqID_89499
MAPKKLSTKRSRRDAHGESSSASLEFDSHRLPGEDSTQALDTSSDSHGQWIPFGTDALSQFLGHPLILEEDQRCEFSQRRDQASGFDEEAIAQLLCIPGQDFAWTAAGRQ

SEQ ID NO: 181185 - protein, 160 aa, Glycine max
  Coding DNA Sequence Number=SeqID_89500
MQRRSTAGDLIPIDLEINATCRRRNVERIRKFLQDLEAATTPEEEPQSSEASSSFLILGQSHTDLIEDPIMAEEPRRVTLEDYSCSTVPQFFTSIAQPEVQAQTITYPPSLIQLIQKNLFHGLPNEDPYAHLATYIEICNTIRLAAGEAKRWLHSFKETV

SEQ ID NO: 181186 - protein, 246 aa, Glycine max
  Coding DNA Sequence Number=SeqID_89501
  Gene Ontology: Mol. function=helicase activity; Biological process =viral genome replication
  Homolog annotation: Hit_ID=Q9LTU4; Match level="QueryCoverage=98%, HitCoverage=16%, E-value=1e-57, Identity=44%"; Hit description =Helicase-like protein
MVESEKLSYIRNNQKKFRVDKFCSLQHSLDDGSTKGLNKGKRVILPSTFVDSPCYMDQLYFYGMAICSHVGFPNLFITLTCNPSWPEIHRLLNPLNLKATDRPDIICKVFKLKYGQMLMDQTKNQMLGKFIAYMYTIEFQKRGLPHVHLLLFLHPDNKYPSSDEIDRIISIEIPSQQDDPEMHSLVKNHMVHGPCGISRTESPCMKEGKCSHFYPKMFQPHTILDADGYPVYRRRNNGHTIEKMVL

SEQ ID NO: 181187 - protein, 51 aa, Glycine max
  Coding DNA Sequence Number=SeqID_89502
MGRATYAARSLHRSECDRECRNLPFGGRATRDSQDACSTKGIRAESPPTFI

SEQ ID NO: 181188 - protein, 114 aa, Glycine max
  Coding DNA Sequence Number=SeqID_89503
MCSWVKKDAPAQAAEDRSPSPPPQRDDSSSLMQIVLDRLDGLYIFVGERFDSLDSRIDAIDARIVIIKKGEIVEAMSSKIILMMTKNHELRKFERFKNQDLRFKNQVSGINIQE

SEQ ID NO: 181189 - protein, 73 aa, Glycine max
  Coding DNA Sequence Number=SeqID_89504
MSLTEFYANLYSSEGLSAKQARVRGHLVKIDANSLNTFLETPGCWQRVRLCPHTPDTAGCLQILGRLRLPYAY

SEQ ID NO: 181190 - protein, 87 aa, Glycine max
  Coding DNA Sequence Number=SeqID_89505
  Subcellular localization annotation: CTP_CleavageSite=76; ConfidenceScore=5.66e-01
MPHLLAKKVRKASIATRSTNPSTFGKRTPPKINSARLSMNGAHSLLPAKILAFASKYFLGIPTTPFSTCFLWSNSCADDVPSFSSIF

SEQ ID NO: 181191 - protein, 222 aa, Glycine max
  Coding DNA Sequence Number=SeqID_89506
  Homolog annotation: Hit_ID=Q2HW90; Match level="QueryCoverage=80%, HitCoverage=36%, E-value=1e-24, Identity=36%"; Hit description =Putative uncharacterized protein
MEDAPVSPASPSRRRVGCEKAIASLVQYYDQSLRCFTFRDFQLTPTVEEFEEILGCPLGGRKPYLFLGFYPSLARISKIVKISTQELDRGKQVENGVVGVPRKCLEAKARVLASQGEWAPFMDILALLIFGVVLFPNVDWLVDRAAIDAFLAFYDYKESPVVAILADLYDTFDRRCEKNSARIVCCTPALYVWLVSHFFRQEMRHVCPLEGHRSCTEKKKEN

SEQ ID NO: 181192 - protein, 215 aa, Glycine max
  Coding DNA Sequence Number=SeqID_89507
METLQMVRKAWEIVREKDKELRGGNNGPICGFRKWLRAHVQGLDWLPSMRTTKREEVEAPEEDEEVQALRTELEQAQTVKERFKSAALKIRKENAELRDINTATTKALEQETKRAHREEHGRNKFRRALWGSNNELKLRREERDQSRVDNFILKDELKACSRSKRSLSQRLCETETNMLAIINKYQEELNLATAHEHRVADEYAQVYVEKEARGR

SEQ ID NO: 181193 - protein, 94 aa, Glycine max
  Coding DNA Sequence Number=SeqID_89508
MNALGGATLFCKITRAPNIFMICVHRDSLGRNNQHENTEKGVPMNPKRIKVIPEWPAPPSVLRKKVQFQEPRDLRSNPFQGGGNDTILPRKGIG

SEQ ID NO: 181194 - protein, 96 aa, Glycine max
  Coding DNA Sequence Number=SeqID_89509
LILKDELRICLRSKRSLSQQLCKTNTNMLAIISKYQEELNLAIAHEHKVADEYARVYAEKGARGRNFPDCWPRPKQWRTPTPPPRRSTDFLAIVSI

SEQ ID NO: 181195 - protein, 83 aa, Glycine max
  Coding DNA Sequence Number=SeqID_89510
MDNHSGISGRQRDSKVSMTDLVSAEDDVNLRVSTGLSAAIDERRKMTIICLCVPSDTTVSEWQKGVRNDHNLSPHVIGPAASG

SEQ ID NO: 181196 - protein, 179 aa, Glycine max
  Coding DNA Sequence Number=SeqID_89511
NDPEKGDSDRCDLYIEADPTCLVAMGRVYEGSTIVHNTPLLPGQVKMQILQFLSGAGTSHLPCLADTLVKSLSDQVVVSSAKPPPKPDPEVDDSLYLMTLTIPELFLRPYQVRWDATVFGVFNPNFPLYIKHEDLSEIAHGGQCLSISVLQLWILHLTETCMRVGNSDIYGFLKPQFIQ

SEQ ID NO: 181197 - protein, 120 aa, Glycine max
  Coding DNA Sequence Number=SeqID_89512
MGDLEEVQEQMKADMSVLKEQMASMMDVMLGMKQLMESNATTAAAVSSAAEANPTLPTAAHHPIPNVVGRERSTPGHVSNPHPGYNRGTYPYGLPPNYTPPAVHDDVGHIPPLILEGEPP

SEQ ID NO: 181198 - protein, 129 aa, Glycine max
  Coding DNA Sequence Number=SeqID_89513
  Homolog annotation: Hit_ID=Q84VH5; Match level="QueryCoverage=62%, HitCoverage=11%, E-value=3e-27, Identity=80%"; Hit description =Envelope-like protein
MKRESPLSLHYKLFEGTHVPDIVSTSGKAAASGAVSKDALIAELKDTCKVLEATIKATTEKKMELERLIKRLSESGIDDGEAAEEEAAEEEEEAAEEEVEAAKEEEEAAEEEEDAAEDTESDDDSEATP

SEQ ID NO: 181199 - protein, 150 aa, Glycine max
  Coding DNA Sequence Number=SeqID_89514
MSRNLTDYAIIPSLAFGMSRNFMDCTLTLLFNSRHVAELHGLPNNGCQVPRSGQMLHSMLQSLHRGHAIIMQSLQGLGLPSIMSIDEFDVQEEEISIDQIPEPSPVPIRDDSMPFATASELEQPIPQDSPAAQVLDLNEHAREQSQEQDI

SEQ ID NO: 181200 - protein, 106 aa, Glycine max
  Coding DNA Sequence Number=SeqID_89515
  Subcellular localization annotation: CTP_CleavageSite=48; ConfidenceScore=5.63e-01
PMTTPPASPPLPHLPPPPPPAIVASEFPSTLKRTRKATRLRSLATRPPGAERSVVHIDPATGKDDSPHKKKLRIYLGIIAHDKVDVTYNTWKEVPATQKDLIWEDI

SEQ ID NO: 181201 - protein, 232 aa, Glycine max
  Coding DNA Sequence Number=SeqID_89516
MQNALSQFLGDPLVLEEGQECEFSQRRNRADGFDEEAIAQLLCIPGQDFARTAAGRRVRIMRTSMPPTRHPLDLDKSNRALGFPALITGLCQSFGVPVTPSKVIRPPITRAFIEKYCMPRQAQGDAPQAANAPPPPHQADPAGSLGMERYLQHLVQIHECLYQLSLSQQGQGFAPFACPTPDQFRVEVAWPGDWPKALTEEAPAGAPDDAEEARIDEVMTDLFGFLGGSGAT

SEQ ID NO: 181202 - protein, 202 aa, Glycine max
  Coding DNA Sequence Number=SeqID_89517
MRKFSRIFPYVINRLQMLLVCCVQSTILLVVSHYILDKDNLLKLSKLKLIGWLHLMNGSSAISLNGSNASRGGLLRNWAVVIVAVLAAVSLCGGGSGGVLFPLAISGGGRRGPLSVWRRGVLGNGSQGGPPVGLVAAESLRRRRNEGLRGAGGVAGAAEARNEEPHQAKKKKVWVWNKFVVIINVREWVATISNLRVIQKWL

SEQ ID NO: 181203 - protein, 75 aa, Glycine max
  Coding DNA Sequence Number=SeqID_89518
MSGHACGGGHGSGVKWSRKGRVILACNGSEVSVGGWRHSWRWWEKGRRIKGEHLNITSYTKQKWSALKNFQLSNV

SEQ ID NO: 181204 - protein, 185 aa, Glycine max
  Coding DNA Sequence Number=SeqID_89519
  Subcellular localization annotation: CTP_CleavageSite=73; ConfidenceScore=5.22e-01
MPISPCRCIEIAPTRRPVGPKKSNRALGFPALVTGLFQSYRVPVPPARNRTHKDTQWTRRSPTGPWGFQLWLRASVVLQGARSPRQGHVIIGKDRACKTPSGLEEVQQGLGVVKALITGLCQFYGVPVTSSKGIRPPTNRAFIKKYCASRQAQGETPQHPGDGRHRATDTPPSPLEFTSAHPQKG

SEQ ID NO: 181205 - protein, 148 aa, Glycine max
  Coding DNA Sequence Number=SeqID_89520
KVGVEEVRDADASIPVLTQQVQLVGQTLNTFVTWPTHLVKRLSEQGAMGSDKPTDRPDHDVNDPLYLMTLTIPQLFLNPLQVMWNATVFGLFNDDFPLYIKHGDLSKITHNSQCLNISIIQLWILHMTKTSMRAGNSDVYGFLEPKSI

SEQ ID NO: 181206 - protein, 36 aa, Glycine max
  Coding DNA Sequence Number=SeqID_89521
RKGAQRLEDCNMREARRSTFVKYTTWVLAMLCGWTL

SEQ ID NO: 181207 - protein, 100 aa, Glycine max
  Coding DNA Sequence Number=SeqID_89522
MFSKKEEMMRIMKLAKYRLKAQVEKDEGPSGEGQSPRVEKDEGPEAETLSRLLIVTEGNPRGVYPDLSSFTGSGVYPDLSSFTGSGVIQISVTCIKRSAP

SEQ ID NO: 181208 - protein, 64 aa, Glycine max
  Coding DNA Sequence Number=SeqID_89523
MPFYAKFLKDMLTKKNWYIHSDRIAVEDIEEDVDIPLILGHLFMSTTSCMVDMGKKILQMGIED

SEQ ID NO: 181209 - protein, 116 aa, Glycine max
  Coding DNA Sequence Number=SeqID_89524
MAPKKLSAKKSRRDAAAEGTSVAPEFDSHRFRSAEHQQRFEEEIARRHWTSLETPMAKFDPDIVMEFDANAWHTEEGVRDMRSWVRGQWIPFDVDALSQFLGDPLVLEEGQECEFS

SEQ ID NO: 181210 - protein, 166 aa, Glycine max
  Coding DNA Sequence Number=SeqID_89525
  Pfam annotation: Domain name=DUF1723; Domain location=1-44; Score =29.7; E_value=1e-05; Accession=PF08330.1; Description=Protein of unknown function (DUF1723)
MSAFVERWHKETSSFHLPIEEVTITLDDVVSLLHLSVVGACHSFKLLHVDDAIEMLVELLEFSAVECWIYEHFASVGSAVPAEDYDERRPSACRWTSGKALPISTYWRRPDKLILDAMCWIPYSDHRLFREFDVISLFSGHILLRLHSLLKKLMIDGCSLVNTLNL

SEQ ID NO: 181211 - protein, 78 aa, Glycine max
  Coding DNA Sequence Number=SeqID_89526
  Subcellular localization annotation: CTP_CleavageSite=19; ConfidenceScore=5.17e-01
MSLPSAIHVSSTFVSGAPRMSLPSPVRQFSILHFYSEPHECHCLALFMCPPPSSLEPRECHVLALFANFPFSTFFGAP

SEQ ID NO: 181212 - protein, 120 aa, Glycine max
  Coding DNA Sequence Number=SeqID_89527
MLSSLELEINCEKTRSLWWETMRWVNRVGSYSIDPKNHFLQFTQWNSKDSTNKRWEFMWLALSFSIWYHRNAKIFKNQPFTPEKVMDDALFHTWSWIKCVEKDFQMHFNFWSTNLKDVLS

SEQ ID NO: 181213 - protein, 73 aa, Glycine max
  Coding DNA Sequence Number=SeqID_89528
MMTKVMNKKLKRSKNNSSESRTSQEFKNQEEFKTQEEGLQSRIKIQDSRSQESKSRFKTQDSRMKKRLNQDKY

SEQ ID NO: 181214 - protein, 234 aa, Glycine max
  Coding DNA Sequence Number=SeqID_89529
  Gene Ontology: Mol. function=structural constituent of ribosome; Cellular component=ribonucleoprotein complex; Biological process =translation
  Homolog annotation: Hit_ID=Q7WKR7; Match level="QueryCoverage=26%, HitCoverage=93%, E-value=6e-24, Identity=93%"; Hit description=50S ribosomal protein L35
  Pfam annotation: Domain name=Ribosomal_L35p; Domain location=177-231; Score=82.5; E_value=1.3e-21; Accession=PF01632.10; Description =Ribosomal protein L35
MPAWPAPNWSVIAPWTRPPRRCCCRRCGDWRDPGGRCIAPCGWRGPSPTLTGRIRCRPAMWPRRCSIDGRGYDGGSSAPGLGRPPRCVVLFPLVRPWLCCHVVRRRVPARQNQGNHHIIKGFPGSRLLFCRRCGEGRAKCPGGSRMAQAGIHGPGGIRVIPPKYFSSTPAVPPRSGKSAAKRFQVRGSGSIKRGQAFKRHILTKKTTKNKRQLRGSAAVHETNVASVKAMMPFA

SEQ ID NO: 181215 - protein, 169 aa, Glycine max
  Coding DNA Sequence Number=SeqID_89530
KLASKRSRKDKTAEGTSSAPEYDSHRFRSVVHQQRFEAIKGWSFLREPRVQLRDDEYTDFQEEIGRRRWASLVTPMAKFDPEIALEFYANAWPTEEGIRDMRSWVRGQWIPFDADAIGQLLGYPLVLEEGQECEYGQRRNRSDGFDAEAIAQLLCISGQDFARTTAGRR

SEQ ID NO: 181216 - protein, 111 aa, Glycine max
  Coding DNA Sequence Number=SeqID_89531
MKETGEEWKTEVDRDNNHSGTSDHVFSAYHPWRVICMQCMQEYGAQNPSRKIPWSILQRACETQGPPLVSPTDRHNRVSSTCHFVRGVYVRAQYLHCTQDSSNPTFALADP

SEQ ID NO: 181217 - protein, 131 aa, Glycine max
  Coding DNA Sequence Number=SeqID_89532
MHKALRANAPLPYPYLVTLFLHYFNVPLDDEPYVKVKRSFSIGADAVTSFGYRKDVDGQWVRKQDLPPPIPDERTPSPPPQKDDSTSLLTEVLIELRDLQAFMDLLGLFYGLNQFMDALCYDFDVALVPFS

SEQ ID NO: 181218 - protein, 278 aa, Glycine max
  Coding DNA Sequence Number=SeqID_89533
  Gene Ontology: Mol. function=motor activity; Cellular component=cell projection
  Homolog annotation: Hit_ID=UPI00016621D1; Match level="QueryCoverage =99%, HitCoverage=44%, E-value=3e-24, Identity=37%"; Hit description =UPI00016621D1 related cluster
HVVAIRGLHTLTFRGLHVLLFRGLQVLTFRGLHALAFRGLHVLAFRGLHVLPFRGVHVLTFRGLHVLGIRGLHVLSFRGVHVLTFRGPHTLAFRGLHVLTFRGLHVLAFRGLHALTFRGLHVLAFRGLHALTFRGLHALAFRGLHVLAFRGLHVLPFRGLHVLSFSGLHVLGFRGLHAFTFRGLHVLGFRGLNVLIFRGPHALAFRGLHVLTFRGLHVLAFRGLHVLTFRGQHALAFKRLHALTFRGLYVLNLKRTTCPHTSEDYTSSPSEAAHSLQR

SEQ ID NO: 181219 - protein, 155 aa, Glycine max
  Coding DNA Sequence Number=SeqID_89534
  Gene Ontology: Mol. function=nucleotide binding; Cellular component =intrinsic to membrane; Biological process=defense response
  Homolog annotation: Hit_ID=Q2YE87; Match level="QueryCoverage=98%, HitCoverage=12%, E-value=2e-71, Identity=88%"; Hit description=NBS -LRR type disease resistance protein Rps1-k-2
MAEDLLRKPRKGGTLEEVGQEYFDDLVLRSFFQRSNRSSWSHGKWFVMHDLMHDLATSLSGDFYFRSEELGKETKINTKTRHLSFAKFNSSFLDNPDVVGRVKFLRTFLSIIKFEAAPFNNEEAQCIIISKLMYLRVLSFGDFQSLDSLPDSIEN

SEQ ID NO: 181220 - protein, 165 aa, Glycine max
  Coding DNA Sequence Number=SeqID_89535
MKDKRDEEEKLEKQKKKKDSKALSSKAKGKEKEEKDSFKKIVKKENHFATKGDIKRALLIKQSFYLLLSRETSPSIAIPLELEVIPQVKELLDEGLVHKSLNPCALLMPKIGLPMDPKRIKVILEWPTPPSVEERINEFQEPLDLRSNPFQGGGNDAILPPKGIG

SEQ ID NO: 181221 - protein, 164 aa, Glycine max
  Coding DNA Sequence Number=SeqID_89536
MVFCFIVFVCHALQRPYGSRASARVPSLWVHGRHGGSTGDIVDRGYSREVTGRKWCNYFEWHDPVANIRQKKIIVALMKKVDELKLREKDLQSRISDMKMKEKIIGIVLVVSWVCVCLLVCLLCSKGLQFDNVVGNVIWQCHRGMLLVVGGLFAGPMQMVFGSL

SEQ ID NO: 181222 - protein, 43 aa, Glycine max
  Coding DNA Sequence Number=SeqID_89537
MASYGEAKDSIDEEDSRPTSSTWSYISFGGVTGHFQKVKEVGR

SEQ ID NO: 181223 - protein, 82 aa, Glycine max
  Coding DNA Sequence Number=SeqID_89538
MTISTTLTVEYIFPSMIWFSSELLMQSSQGGDPSPEPWLGDSRKIGPGVATYLSVGGRRETYGSIFQGRKTRGVTTNVYLRK

SEQ ID NO: 181224 - protein, 174 aa, Glycine max
  Coding DNA Sequence Number=SeqID_89539
MRGEEQSVVNEQLEAYVANIYNRPPQQQNQQQQNNYDLSSKKYNPGWRNHPNLRWTSPPQQQQPVPPFQNAAGPSKPYVPPPMQQQQRQQATEAPPQTSLEELNPKNVSAITLRFGNQIQVPPPVATPAPEPVKLHSTPEKEDELAAQKRKLPDHEGANTNFHAGGPSLSSSDL

SEQ ID NO: 181225 - protein, 121 aa, Glycine max
  Coding DNA Sequence Number=SeqID_89540
MIVNQQVKVAKDQLAMKDKRNEEEKLEKQKKKKDSKALSPKAKGKEKEEKDSSKKIVKKENHFATKCDIKRALILKQSFYLLLSREISLSTAIPLELEVIPQVKELLDEGLRITLQSSNLI

SEQ ID NO: 181226 - protein, 166 aa, Glycine max
  Coding DNA Sequence Number=SeqID_89541
  Gene Ontology: Mol. function=histone acetyltransferase activity; Cellular component=nucleus; Biological process=regulation of transcription, DNA-dependent
  Homolog annotation: Hit_ID=Q2PEU3; Match level="QueryCoverage=43%, HitCoverage=13%, E-value=3e-22, Identity=65%"; Hit description =Putative uncharacterized protein
MEGITEGVNNIMNPLFQDDEKASACPFVSERSKLAYSKDENRYLKRGVNEKGRVANDVETEQQLVNSWVDWHLLLSSDIKCEARWIFALFLHPRKKKSRKYRTDQGLYAELSEAMECLEHICYDGCTHVEPYDAAEVKRERTPCGRIATCQALQVLIRHFATCEKK

SEQ ID NO: 181227 - protein, 303 aa, Glycine max
  Coding DNA Sequence Number=SeqID_89542
  Gene Ontology: Mol. function=binding; Cellular component=Golgi apparatus
  Homolog annotation: Hit_ID=O65551; Match level="QueryCoverage=63%, HitCoverage=5%, E-value=1e-49, Identity=54%"; Hit description =Putative uncharacterized protein F6I18.100
  Pfam annotation: Domain name=DUF1068; Domain location=109-303; Score =93.4; E_value=7.4e-25; Accession=PF06364.3; Description=Protein of unknown function (DUF1068)
MHIFKDLVENPILYAGDLGSPFSGRFVEDQDPCSRFVVKDAWHPCGAGADSTPPLPVPEPYPAPCPRLCSPWWGCNEGFHGFTAETNSEEGTVKRTVKKRISEEGEDSVKRGCLVVFAVVSALGVCGPALYWRFKNAITLRNNNNKLSCPSCLCDCPPPLSLFQLAPGLANLSVSDEISEGGNSCILNCKELTIRSVNKLDQLHCGSNDPDLKEEMEKQFVDLLSEELKLQESVTEANTRHMNITLAEAKRVASQYQREADKCITATETCEQARERAQAILTKEKKMTSVWEKRARQMGWEGE

SEQ ID NO: 181228 - protein, 67 aa, Glycine max
  Coding DNA Sequence Number=SeqID_89543
MVEKIPLFFKRFWTGSMVFKPLFVKGLILWSYKWTCDSMRWSQGSPRVVIIKKGEIVEASFMMLNPD

SEQ ID NO: 181229 - protein, 133 aa, Glycine max
  Coding DNA Sequence Number=SeqID_89544
MSDGFCGTHLQIMIRTKGLGRALGQVTRKGVGRGDHDDSDDAPHRRRPTASARRQRVAVTADHVDDPVIPNPDVQDDPMEALAVVEDIPADIPADVGAEAAEDQPQGFPSGLSDPSVLTAYADHVACNVWTGE

SEQ ID NO: 181230 - protein, 174 aa, Glycine max
  Coding DNA Sequence Number=SeqID_89545
AALEFDSHRFRSAEHQQRFEAIKGWSFHRERRLQLREDEYPDFQGEIARRHWAQLVTPMAKFDPEIVIEFYANAWPTEEGENQQCEFSQRRNQADGFDKEAITQLLCIPGQDFARSAAGRRVCIMRTNMTTLTQIWMALLFSNVLPSDHNFDLPLPKCQLVYAIQTRKSVHVAK

SEQ ID NO: 181231 - protein, 132 aa, Glycine max
  Coding DNA Sequence Number=SeqID_89546
MAIQKRCESTLYKLRPLAVLSRQHGSSFSSLRGLRGDVAVLKSMWIFQETPEVSGFSLSLPLRLDRDVQPKQYPILHRLGNFLERAPPVGYNTGCSGGFAQRWGGDVEQEETAGRSYAKIAGPSGNPNAGTV

SEQ ID NO: 181232 - protein, 616 aa, Glycine max
  Coding DNA Sequence Number=SeqID_89547
  Gene Ontology: Mol. function=coproporphyrinogen oxidase activity; Cellular component=cytoplasm; Biological process=porphyrin biosynthetic process
  Homolog annotation: Hit_ID=A1FSW0; Match level="QueryCoverage=43%, HitCoverage=50%, E-value=1e-134, Identity=90%"; Hit description =Oxygen-independent coproporphyrinogen III oxidase
  Pfam annotation: Domain name=BLUF; Domain location=340-432; Score =60.3; E_value=6.8e-15; Accession=PF04940.3; Description=Sensors of blue-light using FAD
  Pfam annotation: Domain name=HemN_C; Domain location=139-259; Score =176.1; E_value=9.3e-50; Accession=PF06969.7; Description=HemN C -terminal region
  Pfam annotation: Domain name=UDPG_MGDP_dh_N; Domain location=516-616; Score=-27.4; E_value=9.6e-07; Accession=PF03721.5; Description=UDP -glucoseGDP-mannose dehydrogenase family, NAD binding domain
  Pfam module annotation: Pfam domain module=BLUF::HemN_C::UDPG_MGDP_dh_ N; Domain location=340-432::139-259::516-616
ISTRRCRNRSTAYRVVQQTLDILRACRDSGMRSVNVDLIYGLPGQSLEGFGRTLERVLALRPDRLAVYGYAHLPHLFRAQKQIDEGRLPSPEDKLALLGLAVEKLSAAGYQYIGMDHFALPEEDLSRAQRAGQLHRNFMGYTTHTDTDLLGLGVSAISHIGATYSQNPRDLPSWEDTVDQGQLPVWRGVALSADDQLRAELIQQLMCQGEVDGVLLGQRHGVDFEQYFAEDLRSVQRLQEDGLAEYRDGVVRASEPGRPLLRLLAMCFDPYLRAAHMSNRVIRGRSEGSVCCARVRGADCSPPAVPRPDCITAAACLTVDRIHVIVFAIVPRGGSHLMSLHAIAYASEARADLQTTDLDRLLADATAFNRVAGVTGVLMFDGARFLQYLEGPEDGIDSVFQRILNARSHVQLKVLCRAPVVQRAFPRWSMGTRRIEPELLAQIVDAAWPGFLLGSGGFERLLQAWTGADGELEPAAVALGGAADECVGRSHGSVCAIASVARDVPMSAPVAAASAPRFAVIGLGYVGLPLAVAFGRQWPTLGFDIDAGRIAELRSGQDHTLEMEADELASAQLLQFGSDPALLDACNVYIVTVPTPIDAYEQPDLEPLRSATRLIA

SEQ ID NO: 181233 - protein, 172 aa, Glycine max
  Coding DNA Sequence Number=SeqID_89548
  Pfam annotation: Domain name=Transposase_23; Domain location=65-124; Score=3.9; E_value=0.00045; Accession=PF03017.5; Description =TNP1ENSPM transposase
  Subcellular localization annotation: CTP_CleavageSite=32; ConfidenceScore=5.16e-01
MELDAIKSELSQIHTQQSAPPRPSNPDVFVARVSTKESCAEAANNVVGNERSTFDTCSMGFYIVCGDSTQLVAGGKVFGVGGLIHTVAYGDDVVRVCVDTVYDGEAIVPLPTSEIQYVRDAVNSFIGWPRHLVKPLSYDSDLNVRKPVEHSSDAKLAESSGSAVGGEPIWTS

SEQ ID NO: 181234 - protein, 62 aa, Glycine max
  Coding DNA Sequence Number=SeqID_89549
CFYTSFPSSSGSEEEVRGEESSKEVYPREEGDLLMVRRLLGGQSCDLSQSQRDNIFHQDEIF

SEQ ID NO: 181235 - protein, 143 aa, Glycine max
  Coding DNA Sequence Number=SeqID_89550
MAAQLIHDCVVMECLEGVWETLEGNERCQFRGTIRLTSTSLVHPEEPAHTLQQPVEWILPTPTPYRLVEPVQVIEVSSSEEDPEEDPEELPLEPAVDALDFPEDDEDPLPDVDSLEDIMSASKVDSTEESGPGGTTNSEDSSS

SEQ ID NO: 181236 - protein, 279 aa, Glycine max
  Coding DNA Sequence Number=SeqID_89551
  Gene Ontology: Mol. function=lyase activity; Biological process =phosphonate transport
  Homolog annotation: Hit_ID=A8G937; Match level="QueryCoverage=41%, HitCoverage=32%, E-value=2e-53, Identity=93%"; Hit description =Phosphonate metabolism
  Pfam annotation: Domain name=PhnH; Domain location=3-177; Score= -76.6; E_value=0.0007; Accession=PF05845.3; Description=Bacterial phosphonate metabolism protein (PhnH)
  Pfam annotation: Domain name=PhnI; Domain location=164-279; Score= -74.7; E_value=1.7e-05; Accession=PF05861.3; Description=Bacterial phosphonate metabolism protein (PhnI)
  Pfam module annotation: Pfam domain module=PhnH::PhnI; Domain location=3-177::164-279
VDSRGSPEQPIDQSQHTFRLILKALSEPGHRVTLPNGPAWAPLNAASTAALLTLADQETPLQLCAALKTAGRRSAGVTARHGNLAGVRCHGHRAARRTGERRRAAPDRPRHRESSPDSAAPAAGAAGLPGQPPAALPAGAGYFADLRRSPAGDPADHPRGGVLMYVAVKGGEKAIEAAHQLQEQLRRGDDALPALGAEQIEQQLGLAVDRVMTEGGIYDRELAALAIKQASGDLVEAIFLLRAYRTTLPRLAVSEPLASQNMRLERRISAVYKDLPGGQ

SEQ ID NO: 181237 - protein, 123 aa, Glycine max
  Coding DNA Sequence Number=SeqID_89552
MEATQKGLDHISSDVECPILLQPSSHIPHLRFKHGELGQISSIAQSNSSRLGFPALIIALYKARGVTSNSLTYESLSPAINLAYIKKNCWNLGYLTVNFRGTRKVRARPADVSSSSTPPARVL

SEQ ID NO: 181238 - protein, 64 aa, Glycine max
  Coding DNA Sequence Number=SeqID_89553
MEKSDKMNFKEKKEKKGYITWEDNINEYVIYEDSKRRPHFSPRKVNMRYMETTNKGLLINNPNK

SEQ ID NO: 181239 - protein, 125 aa, Glycine max
  Coding DNA Sequence Number=SeqID_89554
  Homolog annotation: Hit_ID=A5BZX9; Match level="QueryCoverage=84%, HitCoverage=7%, E-value=5e-09, Identity=33%"; Hit description =Putative uncharacterized protein
MASSSSCSSNIQTRSGPIDGDVLWMQPKHVSKHVWNGKPDRKLHIRRAVPTYQGEEQISEEIVPLLQQSGFYWIMKMGYLKINAALISLRTDGAPLIGSTNLDWANLCEELLGVRPHEGDLKAVW

SEQ ID NO: 181240 - protein, 84 aa, Glycine max
  Coding DNA Sequence Number=SeqID_89555
  Subcellular localization annotation: CTP_CleavageSite=40; ConfidenceScore=5.19e-01
MRTRSPLKARTCSPLKVRACSPLMVRACNPLMARTCNPLKARACSPLKIDCPFERGDSPFNLILSFANLSGNSLKVCVLFDLVT

SEQ ID NO: 181241 - protein, 77 aa, Glycine max
  Coding DNA Sequence Number=SeqID_89556
  Homolog annotation: Hit_ID=A2Q2U3; Match level="QueryCoverage=100%, HitCoverage=15%, E-value=4e-21, Identity=68%"; Hit description=CENP -B protein; Homeodomain-like
MDIGILMNYPGENEACSKVQSLEDIMGTIIENNEEDDGEDDTVSLESVTRMEALMTSNTLHNFMIQYKIQHLRYWIQ

SEQ ID NO: 181242 - protein, 85 aa, Glycine max
  Coding DNA Sequence Number=SeqID_89557
MNQTLIQQLLYLRNNLKPKRYDSANKCLLRKERMWRLSKRETLTSLHFSLTIKGRPSSWGQISSLDSSPFASSLSLEEGEVVALS

SEQ ID NO: 181243 - protein, 144 aa, Glycine max
  Coding DNA Sequence Number=SeqID_89558
MNENAIDGAPKKGENGELHYEITTHGSKLEGGGHMNENAIHGAPKKGENGELHYAITTHSSKLEGGGHMNENAIRRAPKRLRMENCTKWRTQERKRNSSGSEKIENGELHYAITTHGSELEGGGLMIENAIHGAPKKGENGELH

SEQ ID NO: 181244 - protein, 164 aa, Glycine max
  Coding DNA Sequence Number=SeqID_89559
  Gene Ontology: Mol. function=mannosyltransferase activity; Cellular component=membrane; Biological process=protein amino acid O-linked glycosylation
  Homolog annotation: Hit_ID=A6TF96; Match level="QueryCoverage=53%, HitCoverage=16%, E-value=1e-13, Identity=45%"; Hit description =Undecaprenyl phosphate-alpha-4-amino-4-deoxy-L-arabinose arabinosyl transferase
MGWLSLKTGRWQLAALCPLALALLVGLAIPQKVRDSKQPQSFVSAVRPQLAQSRYLVVNNSGIASAVAWELRRSDITFFDEKGELEDGWSTTATTRHHESAADPAGKPAQLCRPAVPETGGPLRRAPPVRLAGAQPAAAGDGDAAVAGGAAHVPVSGAYPDAEP

SEQ ID NO: 181245 - protein, 98 aa, Glycine max
  Coding DNA Sequence Number=SeqID_89560
  Subcellular localization annotation: CTP_CleavageSite=38; ConfidenceScore=5.17e-01
MSSFVPFVNQRQASPLTRGDLRCLPRRLPLSSTNPRKRARSHAEIYVVFGADYLCQPLTREHAKTNVVFCTLFQPEAIESVDTRRFTSSSAQTTSVNH

SEQ ID NO: 181246 - protein, 59 aa, Glycine max
  Coding DNA Sequence Number=SeqID_89561
HVGRLKVNDSSFLGDPTVPSSEGKDGNSHPGSSSGIKECRTLFPLHTCNNDDLEILWKT

SEQ ID NO: 181247 - protein, 43 aa, Glycine max
  Coding DNA Sequence Number=SeqID_89562
MAEPSQKRKDTSSRSQRHSGSQEPPIPSSIPSRSLFSSEEQRI

SEQ ID NO: 181248 - protein, 62 aa, Glycine max
  Coding DNA Sequence Number=SeqID_89563
MDAHPRQDGVHQLTLRPGEVGIMVDVQDVAEQQSHPYLSQGGHVGAHNSHSPPCSSPGKIPP

SEQ ID NO: 181249 - protein, 55 aa, Glycine max
  Coding DNA Sequence Number=SeqID_89564
MKNGKKRQVVAAQLAQVSSACLGKLGLLPPEGTAFCWNPLEGPSGPGCYLHTPFY

SEQ ID NO: 181250 - protein, 472 aa, Glycine max
  Coding DNA Sequence Number=SeqID_89565
  Gene Ontology: Mol. function=protein dimerization activity; Cellular component=nucleus; Biological process=regulation of transcription, DNA-dependent
  Homolog annotation: Hit_ID=A5B2U1; Match level="QueryCoverage=93%, HitCoverage=94%, E-value=4e-86, Identity=48%"; Hit description =Putative uncharacterized protein
  Pfam annotation: Domain name=bZIP_1; Domain location=357-431; Score =21.8; E_value=0.0017; Accession=PF00170.12; Description=bZIP transcription factor
  Pfam annotation: Domain name=bZIP_2; Domain location=357-436; Score =16.2; E_value=0.0091; Accession=PF07716.6; Description=Basic region leucine zipper
  Pfam module annotation: Pfam domain module=bZIP_1::bZIP_2; Domain location=357-431::357-436
MVVPESQMNSQNEVESPLQLEEQQQQQNNNNNKNHPFSSLGRQSSSIYSLTLDEFQHTLWENGKNFGSMNMDEFLSSIWSAEENQVLNNSVSNHNNLSLEASTEKGVIRKEPSLPRQGSLTLPAPLCRKTVDEVWSEIHKGQQSQQQQQQNNNTNNNCGSNNNNNVQNTESAPRQPTFGEMTLEDFLVKAGVVREQGGMAAMPVQASAHQHVQQYGMYPNNNPTMGASFVGRPVMGMAGGVRVGSGGRNVVAPPYQAVPQGGVGVGVGGAIAESSGYAGNGKRDVGYPPGAPGVCFGGRVVNGGGGYAAVSNMGVVAPVSPVSPEGIGTGENSGGQFGMDMSMLRGRKRVLDGPVEKVVERRQRRMIKNRESAARSRARKQRYCAMCIASCEYMPYIYSSFTIFILAYTVELEAELNQLKEENGQLKLALADLERRRKQQHLDQEVNGRVQTNAQKAKKKLRSLRKTLSCPL

SEQ ID NO: 181251 - protein, 194 aa, Glycine max
  Coding DNA Sequence Number=SeqID_89566
MDSDESGGHVIVSGVRLWVVGKLVGKCLGAFGGPWVKEYLEKGEEKDSREAEGERRPRPSLFGASAGSGHGWPLLGWVKETSYVILNKIVLTPAVDKDDDFVTLDGTCDAQGGRYGMSGHDMQNGFIWEGFVRSDEKEEFGSTPVVCGGAKSRGGGGGTKVMGGATKEELGCQGHDGHLASLILSSCSFASAAA

SEQ ID NO: 181252 - protein, 76 aa, Glycine max
  Coding DNA Sequence Number=SeqID_89567
  Gene Ontology: Mol. function=ATP-dependent helicase activity; Cellular component=cytoplasm; Biological process=mRNA processing
  Homolog annotation: Hit_ID=P93008; Match level="QueryCoverage=92%, HitCoverage=9%, E-value=1e-18, Identity=61%"; Hit description=DEAD -box ATP-dependent RNA helicase 21
MNRHEQKKLIVKNENDMRDQIRKKDDIEEKPEKADAQRRKVASAELYNTFNIRIDRHWSEKKLEEMTERDCPKGRA

SEQ ID NO: 181253 - protein, 38 aa, Glycine max
  Coding DNA Sequence Number=SeqID_89568
MAGLPTLACPANTNGDTRYIADGNGDTCLPPVGMAEST

SEQ ID NO: 181254 - protein, 75 aa, Glycine max
  Coding DNA Sequence Number=SeqID_89569
MQKKDMKDVNEREVPGSRWCYWRNAQSQSAPISLVLLAIPASCPVSFGSAFANGGTHVLTCHHDVCGMLEGPDKS

SEQ ID NO: 181255 - protein, 328 aa, Glycine max
  Coding DNA Sequence Number=SeqID_89570
  Homolog annotation: Hit_ID=Q6WAY6; Match level="QueryCoverage=70%, HitCoverage=37%, E-value=7e-25, Identity=34%"; Hit description =Putative uncharacterized protein
ESDHRKQVKNGVVGVPRKCLEAKARVLAGKGEWAPFMDILALLIFGGVLFPNMDGLVDQTAIDAFLAFHDRKESLVVTILANLYDTFDRRCEKNSTRIVCCTPTLYVWLVSHLFRQEVRHACPLEGHRSCIEKKEASWDRLLASKEGAFVNLFPRWKEGRTGILISCRGFPNVPLMGTRGCINYNPILAIRQLGYPMRGAPLEEDLTPIISRGFNTTNVEALQKVRKALEMVQKKDKELRGSSNGPIGGYHRWLKAYTRARREEHGRNKFRGALWGSNSELKLRREERDQSRVDNLLLKDDLRICLRSKRSLSQRLCETETNMLAIIS

SEQ ID NO: 181256 - protein, 160 aa, Glycine max
  Coding DNA Sequence Number=SeqID_89571
  Gene Ontology: Mol. function=transferase activity
  Homolog annotation: Hit_ID=A5FH65; Match level="QueryCoverage=68%, HitCoverage=25%, E-value=2e-32, Identity=56%"; Hit description =Glycosyl transferase, group 1
MEEKKVLIITYYWPPAGGPGVQRWLKFAKYLPDFGWKPIIYTPENPSYPLLDESLLKEVPRDLKIVKTTIWEPYQLAEKLNKSNKKFKAGQFDVGKNQSWKSKLSIWISGIHGQKSPIISISNLPKDLIRNTENWKVKFSEMQTLLLQPVIQMLKISEKR

SEQ ID NO: 181257 - protein, 62 aa, Glycine max
  Coding DNA Sequence Number=SeqID_89572
MASYGDDDKKPKRMISRLSQEQFKNQEKFDFKIQEKMNSRFKRRNQEDLTREVLKRFFKKQT

SEQ ID NO: 181258 - protein, 304 aa, Glycine max
  Coding DNA Sequence Number=SeqID_89573
MGRAALVPGVEAGSSTEQQPKHHAQHGHAVAQQQAPFLACNGPGRAHAAAPCTPASASAFAFALALALAPEPPAARDEAHAVGHIGRPQQVVRDHENGHALAAQLRDQPAEFGRGLRVQARSGFVQQQRRHLACQRQRNGHLLPHSLGKARDAPVMRGRIQPCSGQGLADGIPAGGLARQVQQIGHVLARAQVLVQRHVLGDIGDQAARLRGSRHRVHALHAHLAAARPHKAQEQAQRGGLARAVGAQQRIDLAGMHGQVQALEDGALAIVHHGAQCLEHGRGGRSGVGRNRKGWMHGGAQNLA

SEQ ID NO: 181259 - protein, 102 aa, Glycine max
  Coding DNA Sequence Number=SeqID_89574
  Gene Ontology: Mol. function=nucleic acid binding
  Homolog annotation: Hit_ID=A5C3F7; Match level="QueryCoverage=62%, HitCoverage=6%, E-value=3e-13, Identity=54%"; Hit description =Putative uncharacterized protein
MEKSEKKNLSEKKLKKAYITWDENDMESSEDSENEEINLCLMAKSYESDEEVSLRKKWYIDSGCSKHMTGDASNFTHISPKKSGHVTYGDNNKGRILGVGEI

SEQ ID NO: 181260 - protein, 176 aa, Glycine max
  Coding DNA Sequence Number=SeqID_89575
  Homolog annotation: Hit_ID=Q6WAY4; Match level="QueryCoverage=70%, HitCoverage=22%, E-value=4e-10, Identity=30%"; Hit description =Putative uncharacterized protein
MGLSQAPSLKKRFYQVKIKSLRVTSLKELRQLMGQLQRQAFCKTYGKIWDLTMAEVSTEAIASLAQYYDQPLRCFTFGDFQLTPTVEEFEEILGCPLGGRKPYLFSGFYPSLARISKIVKISTQELDRGKQEMFGSKGESLGKSRRMGPVHGHPDTFDLRGGPLSKCGWVGGPSSD

SEQ ID NO: 181261 - protein, 31 aa, Glycine max
  Coding DNA Sequence Number=SeqID_89576
MSGLSVGLRFKGETEPLLFNHGISFNNELLK

SEQ ID NO: 181262 - protein, 98 aa, Glycine max
  Coding DNA Sequence Number=SeqID_89577
TCKGILQDSGTLKRVSWGLDVGTGVWLNQHWWYEHKRIHQTLFNSLKCYLTIVFPLNRLILTQQLEKRLSEIFFPFGRYKSGTINLLILEDSYDSSNV

SEQ ID NO: 181263 - protein, 59 aa, Glycine max
  Coding DNA Sequence Number=SeqID_89578
LLQVFRSHGRRTPGGPWSWSKVLFDRDIGSSSTHMTRVFWLSNGSSQYILTSMGDKGIL

SEQ ID NO: 181264 - protein, 152 aa, Glycine max
  Coding DNA Sequence Number=SeqID_89579
MALRQADCGALQMFSALAVLPAERHIFQLAHLFMLNQIAQFGGAVTGMMLQRLFAVLLNLLQQRQGPAAVAFRQLRHACQRKVIVLRQRTEPGGLGGRRRKIPAAANRQVAAGDATLFSQQAQHAVGGLLPEAAEGSPFTADQTQRAPGTRV

SEQ ID NO: 181265 - protein, 91 aa, Glycine max
  Coding DNA Sequence Number=SeqID_89580
MDDIFKDLWKLKIPAKASIFAGRLIRDRLPTKSNMRERKIDINDSLCPFCTKHNILVGIPIMDRHLGGLSYKSKAPLSAAQQWDERWEEIQ

SEQ ID NO: 181266 - protein, 38 aa, Glycine max
  Coding DNA Sequence Number=SeqID_89581
MEMSKIASKLKSLKLELGEDLLIHLILISLPAHFGQFQ

SEQ ID NO: 181267 - protein, 332 aa, Glycine max
  Coding DNA Sequence Number=SeqID_89582
  Homolog annotation: Hit_ID=Q6WAY6; Match level="QueryCoverage=68%, HitCoverage=51%, E-value=2e-27, Identity=30%"; Hit description =Putative uncharacterized protein
MGTNQTGKRFYQVKIKSLDITSIKELGLLMGPLQMQAFRKVYGEILDLTIAEISTEAIASLTQYYDHPLRCFTFGDLQLVPTVEEFEEILGCPLGGRKPYLFSGFLPSLSKIAIVVRDSARGLDCVKQTRNGIVGLPRKYLEGKVRDMANQEEWVPFMDVLALLIFGVVLFSNVDGLVDLATIDAFLAYHHSKESPVEGREGVLFSCGDYPNISLIGTRGCINYNPALSIRQLGYPMRGAPTEESLSPFLVRDFGTKDKELRGIRNGIIGDYHELLKVHTRGLDWLSKLKIINEENFEAPEEDEEVRALKIELGKARLAKEKFKLVATDVRK

SEQ ID NO: 181268 - protein, 163 aa, Glycine max
  Coding DNA Sequence Number=SeqID_89583
MACTHIPRHLTTAFKIAPCVASLVNVRIYTRFSSNFSQHKLDLAPYASEPYNAQWDAPRLLRDKHTLRSSRILREMKVDEPWLGLWLPLNYQVDMGASLAYDNGIWGGLRHWKCVDFVVDLGMAFVDNWVVGKEKEWLSQHGLLPYSHPLHLPQFSHSSKQDD

SEQ ID NO: 181269 - protein, 149 aa, Glycine max
  Coding DNA Sequence Number=SeqID_89584
  Subcellular localization annotation: CTP_CleavageSite=41; ConfidenceScore=5.40e-01
MTTPPSSPSLSPLTDAASHSPSTLKWTRKVTHLRSLVTRPVGAERPLFHVDPAIGKADGSHRKKLRTYSVIVARDKAEFDIPEASDPRTKKKILQTVGKWRRQFKFDFTSKGALAAYKDNVNDTVCEKYDISRGKWTQFCQSRRDPSWE

SEQ ID NO: 181270 - protein, 52 aa, Glycine max
  Coding DNA Sequence Number=SeqID_89585
VDSRGSHVLNSALKGLDDTPQSKSKAAARWIIVKYFNDARSLESERLKALHI

SEQ ID NO: 181271 - protein, 438 aa, Glycine max
  Coding DNA Sequence Number=SeqID_89586
  Gene Ontology: Mol. function=oxidoreductase activity; Cellular component=cytoplasm; Biological process=response to gibberellin stimulus
  Homolog annotation: Hit_ID=Q4JH25; Match level="QueryCoverage=100%, HitCoverage=100%, E-value=1e-134, Identity=59%"; Hit description=GA 20-oxidase
  Pfam annotation: Domain name=2OG-FeII_Oxy; Domain location=218-379; Score=85.0; E_value=2.3e-22; Accession=PF03171.11; Description=2OG -Fe(II) oxygenase superfamily
MDSGFCLVSSPNHQEVVQSRFFDPSWLQMQPHVPMSFVWPKECLVNANEEFHAPMVDLGGFLRGDDDDATNRAVRLVRKACSSHGFFQVINHGVDPLLIGEAYDQMDAFFKLPIRRKVSVKKTLGSVWGYSGAHADRFSSKLPWKETLSFPFHDNNELEPPVVTSFFNDTLGGDFEQAGVVFQKYCETMKQLGIKLLELLAISLGVDKLHYNYLFEEGCSVMRCNYYPSCQQPSLALGTGPHCDPTSLTILHQDQVGGLDVFADNTWQTVPPRPDALVINIGDTFMVFEKQHYQTTPISHGVNGENLRLFTTIFILKYRRQYLSSSIFVPGNKWWAEQETVKKKLQLQALSNGRYKSCLHRAVVNKYKERRSLAFFLCPKEDKVVSAPEDIVRRDGTKQYPDFTWSRLLEFTQKYYRADEATLQNFTKWLLSSKQQTL

SEQ ID NO: 181272 - protein, 52 aa, Glycine max
  Coding DNA Sequence Number=SeqID_89587
MVNDIFILSRHKENMAKIPLRHFTEHLVGALLGTNNKGMGAMWLAPSSQNTT

SEQ ID NO: 181273 - protein, 88 aa, Glycine max
  Coding DNA Sequence Number=SeqID_89588
  Homolog annotation: Hit_ID=Q2QPQ8; Match level="QueryCoverage=76%, HitCoverage=29%, E-value=2e-07, Identity=43%"; Hit description =Putative uncharacterized protein
MKPPDVQEDHIFLKAFPHSLEGVTKDWLYYLAPSCPHHQISEQLLLQYFYEGLSNMERSMTDVASGGALGDMTPTKARNLIEKMASNS

SEQ ID NO: 181274 - protein, 121 aa, Glycine max
  Coding DNA Sequence Number=SeqID_89589
MCLFNTSSYYNIQGFIEIHECPPKSNPFEMQEPIFVNIDNIKFVSGDCWANGLSYLTKGVPLLVIDYKFKIQIQNLSQHALLRAGEGEAHGCAFQRRKDARSRHQRLFVKNVGKTEGNRSK

SEQ ID NO: 181275 - protein, 216 aa, Glycine max
  Coding DNA Sequence Number=SeqID_89590
MHLGEATFSELAHDAEAVLVDPNITSAVHGVVKCVQPKLRADADFEIVSSEGACTNEKAKRLDIGDNCGVLMCAQEEPLVGSNVEEQNQIMDVDADIIDFAKLGDDESFGAEDNSRSFCFNKIRVCAGLARGHAQRARALGEPQWLGPSGMKMTWMALLVRTSRWRKKRCGCVLVEFIERTMSEARASETKYAMATCTMVVMTRFEDLTKLWTQRE

SEQ ID NO: 181276 - protein, 83 aa, Glycine max
  Coding DNA Sequence Number=SeqID_89591
  Gene Ontology: Mol. function=aspartic-type endopeptidase activity; Biological process=DNA integration
  Homolog annotation: Hit_ID=Q69FA4; Match level="QueryCoverage=100%, HitCoverage=8%, E-value=7e-20, Identity=46%"; Hit description=Gag -pol polyprotein
MHGVAFALTTKKPKSVAPTKELDHWNQANKEAKEIWESLVLKYTIESVLRQFFIIDNYYHWTMIEDKDIKVLINKYHKLLEDL

SEQ ID NO: 181277 - protein, 57 aa, Glycine max
  Coding DNA Sequence Number=SeqID_89592
MVNESRMRTLLSAERNEEKGYVCVRELNLKVGNWGWCAYAWACGNGIFVLGHRPIAT

SEQ ID NO: 181278 - protein, 136 aa, Glycine max
  Coding DNA Sequence Number=SeqID_89593
MPASPSENRTRWRKRKRDSQISRHHQKHEEEEDDDKNPNAEEDLVKRDYDSEDQTHQNHPNSQPHVEAEVLFDHDVWISQFPVVIKRFVNCPHSSVTAIVALERALESGENKAPSAIGLEGVRLVIFRCCEWYVWN

SEQ ID NO: 181279 - protein, 159 aa, Glycine max
  Coding DNA Sequence Number=SeqID_89594
  Homolog annotation: Hit_ID=A7P473; Match level="QueryCoverage=31%, HitCoverage=8%, E-value=1e-07, Identity=54%"; Hit description =Chromosome chr1 scaffold_5, whole genome shotgun sequence
MAIGGEKSLSDPLSFTNVQHFWVRLETMRMSKLILGNTPSSDHVLAKLSTLLDMDDREEEFKTVFIFSYGLKLRRWDDNIFLKEEVEASCISKKEATLKREKPEAKLTKTIDTADTTRGAKSALVPMAARKATSADTVDTIDMSFVKTDVDINYVTSVF

SEQ ID NO: 181280 - protein, 61 aa, Glycine max
  Coding DNA Sequence Number=SeqID_89595
MIIKKDFMVGQKVLLYNSRLGLMSVEIKSDSTKKRFKVNGHRLKPFLTNPSLVDVVEDDTS

SEQ ID NO: 181281 - protein, 211 aa, Glycine max
  Coding DNA Sequence Number=SeqID_89596
MKRYSTLLFAVKEQGLETRKLRKLLAKEEEEEEVQRDVQKLIGKGFFEMQVKETGNRLPESKKLCVSSKRLAKKECHFAIKTNIKETSLLRQPLHLLICKKTLVSTPTPLGFEVIPQVKELLVEGLVLKSLNPCALLVPKIDIIRHQIPKIGDMMNVLSGATLFCKITHAPNIFMICVHKDSLGSDEGVPTDPKRIKVILEWPTPPSIREI

SEQ ID NO: 181282 - protein, 66 aa, Glycine max
  Coding DNA Sequence Number=SeqID_89597
MAPKKIFAKRSRRDATAEGTSAALEFDSHRFRSAKHQQRFKAIKGWSFHRERLVQLRDDEYTNFQE

SEQ ID NO: 181283 - protein, 198 aa, Glycine max
  Coding DNA Sequence Number=SeqID_89598
MTGRLLAGSLAFESRILHYLIVHILLPLSSNLAQVSEEDLIIMWAFHIGRQLDWAHLVRYRKHKALRLNAPLPYPQLVTLFLRHFGIPLDSESYIPIKRSFLIGAAVIASFGYRKESDGSWVKKGVPPADDEGHLPVEDNSTLLQRLMDKYCHHQKGGDCRQRIKLNVLMMPKDYMNHMLLKDLFKTKIFKMNDQDSL

SEQ ID NO: 181284 - protein, 327 aa, Glycine max
  Coding DNA Sequence Number=SeqID_89599
  Gene Ontology: Mol. function=peptidase activity; Cellular component =cytoplasm; Biological process=lipopolysaccharide biosynthetic process
  Homolog annotation: Hit_ID=Q65SN0; Match level="QueryCoverage=59%, HitCoverage=85%, E-value=7e-78, Identity=68%"; Hit description=ThiJ protein
  Pfam annotation: Domain name=DJ-1_PfpI; Domain location=165-299; Score=29.0; E_value=1.6e-05; Accession=PF01965.15; Description=DJ -1PfpI family
MANMIFQQLKRIADGGRRNFQFSCGCRNIALTCNALKDPYLETMMRILCLDIPAPGASLEKYAPHLNAEALHAWGLYKSGFIRDIYFRQDRPGVAIFLECDSVDEAMNVMAEFPLAKAGLLSFDHPIKGASGVPTGFFLAELTHPLKVLEDAGLKTMIASIRGGQPPVDGFNLSDPVNAWYWNETDFQQRLATTPALSELNGTDYSAVFFAGGHGTMWDFRDSQDAQRIIREVYESDGIVSAVCHGPAALVDAKLSSGEYLVKGKNVAAFTNKEEEEVHTTDVVPFLLETALREHGALHHEAPNWSENVVTDGRLITGRIPLQRTVS

SEQ ID NO: 181285 - protein, 232 aa, Glycine max
  Coding DNA Sequence Number=SeqID_89600
GGKIKMKTPEEAMDLIESMATSDIAILRDQAHIPTKKSLLELTSQDALLAQNKLHDVQFVAKLMNLDVVSLMKSKLHMKSIIWGINPEAISIQVDFQDFRTTSSIYGRDSGKITLMPSLYDRTIKLEETLAQFMQVSMSNQKSTESAIKNLEVQKNPKKECKAVMTRSKMAIQAEESKADQKVEGFKQQLANELALEPVDDLVELEEIVEEVEGVEEGETPIRDCEEKMGIL

SEQ ID NO: 181286 - protein, 53 aa, Glycine max
  Coding DNA Sequence Number=SeqID_89601
MTTKKHEMELMRLHQHEEKYIKRKGIALRASSSSIQEESDKEDLTEIEENDDF

SEQ ID NO: 181287 - protein, 187 aa, Glycine max
  Coding DNA Sequence Number=SeqID_89602
MEVMKEQMTIMMEAMMSMRKMMEVNTATVVTASTTTEVDPTHLSGLNQVNRSVSDIVGQGGEALGNTGSPHVVQVQSKHSFPPYGLPPNFTPPNVAHSPDENVDNFAPIPIESQQTQFGHAQVSQPMRKTHEVPWDHTLADFKLHLGYATEEQAFGGVSLPNTLGGPQYHPQPQPLHFAMKGGFPAM

SEQ ID NO: 181288 - protein, 87 aa, Glycine max
  Coding DNA Sequence Number=SeqID_89603
MRRSPTGNLVPLDLEIKATLRRNRAERRRKLLQDRTVASILEEETHFSNSLSPDSPSSRESAAQFPEATIMADEQHLRITLEDYSSS

SEQ ID NO: 181289 - protein, 151 aa, Glycine max
  Coding DNA Sequence Number=SeqID_89604
DSASRFSVPVTPSKVIRSPITRAYIEKYCTQRQVQGDAPQVADASPPHQAGPAGLFDTEQYLRHLVRQQAANHRAHVQTHDCLYQMSLSLQSQGFTSFPCPTLDQFRAEVAWPRDWPEAQAGEAPAEAPDEADEAREDEEMTDLLDFLGGS

SEQ ID NO: 181290 - protein, 160 aa, Glycine max
  Coding DNA Sequence Number=SeqID_89605
MWAFHKGLQIDWAHLVRYRMHKALRLNAPLPYPHLVTLFLQHFNIPLDSKPYVPIKRSFLIGASVIASFGYQKEHDGSWVKKGARHADEEGHGGEDSSLLQKILERFNGLQTFVGERFDTLELQVDMRFNEMESRITKVEEDVSYSRSSFNLPPPPPPSS

SEQ ID NO: 181291 - protein, 131 aa, Glycine max
  Coding DNA Sequence Number=SeqID_89606
MDIDDLVPYVEKIMILSEEQERITEPVAHGPASERRFPAQEFHILQSSVETRGFGRQREAVEVEEISQQMEERDHGMYYTPPTFSQYLSQMYQYPFEGHHTDMSASKHSFGGVVETISSFFMADYDPFIAT

SEQ ID NO: 181292 - protein, 115 aa, Glycine max
  Coding DNA Sequence Number=SeqID_89607
  Gene Ontology: Mol. function=phosphoprotein phosphatase activity
  Homolog annotation: Hit_ID=A5C0F5; Match level="QueryCoverage=88%, HitCoverage=15%, E-value=7e-17, Identity=40%"; Hit description =Putative uncharacterized protein
  Pfam annotation: Domain name=DUF1723; Domain location=81-115; Score =43.2; E_value=9.2e-10; Accession=PF08330.1; Description=Protein of unknown function (DUF1723)
SMTSSSSCSSNIQIRSGPIDGDVLWMQPKHVSEHVWNEEHRKLHIRRAVPTYQGEEQIPEEIVPLLRQFGFYWIMKMRYLKINAALISALIERWKPETHTFHLRCGEATITLQDV

SEQ ID NO: 181293 - protein, 111 aa, Glycine max
  Coding DNA Sequence Number=SeqID_89608
MTTFGVKYPCQNIKGLRDFLQRIFEEDAVDSTLNKSVPLGVGVQRRLAVATSGLEWWKNEVLGFGWRFEEEESEKSCFSRRERIYNLQIALSELIALSRSPLFILSARIHT

SEQ ID NO: 181294 - protein, 526 aa, Glycine max
  Coding DNA Sequence Number=SeqID_89609
  Gene Ontology: Mol. function=translation elongation factor activity; Cellular component=cytoplasm; Biological process=selenocysteine incorporation
  Homolog annotation: Hit_ID=A8G7W1; Match level="QueryCoverage=99%, HitCoverage=84%, E-value=1e-137, Identity=49%"; Hit description =Selenocysteine-specific translation elongation factor
  Pfam annotation: Domain name=GTP_EFTU_D2; Domain location=98-166; Score=42.1; E_value=2e-09; Accession=PF03144.16; Description =Elongation factor Tu domain 2
  Pfam annotation: Domain name=SelB-wing_2; Domain location=333-390; Score=60.5; E_value=5.6e-15; Accession=PF09106.2; Description =Elongation factor SelB, winged helix
  Pfam annotation: Domain name=SelB-wing_3; Domain location=467-516; Score=89.2; E_value=1.3e-23; Accession=PF09107.2; Description =Elongation factor SelB, winged helix
  Pfam module annotation: Pfam domain module=GTP_EFTU_D2::SelB-wing _2::SelB-wing_3; Domain location=98-166::333-390::467-516
TREHLQLLSLAGQPPLSVALTKADRVDAARIAEVQQQVAQLTQQLGWPAAAQFVTSSHTLQGIETLRQHLSSLNAPAFEPGRRFRLAIDRAFTLKGTGLVVTGTALSGEVRVGDTLWLSSLNLPLRVRALHAQNQPVTRAQAGERIALNIVGDVEKAQITRGDWLLAQPRPAGTQRLIVALRLLQPLKTASQPVHLHHAASHVTGRLTQLTDDVAELVLSQPLWLAENDRIIIRDSNAQNTLGGGRVLLCDSKKRGKRQPDYLQWLQQLAAARDDSASLQAHLAYQPAAYDELGWARQLTASALDALLLPLNPVRLGTSLMSDTMASAWQQRLREALSAFHQQHPELPGIGHDRLRRVALPHAPAPLVPGLIDQMLAQGELRQKQGWMHLPDFAPRFNPQEATLWQQVEPLFSDQPLWVRDIADTLQQDEEQIRGLLLTAARLGHITAIVRDRYYRSAQIQIFADLIRQRAAAGGSTSAADFRNQLGTGRKVAVQILEFFDRSGFTRRRGNDHLLRDARLFTSSAA

SEQ ID NO: 181295 - protein, 119 aa, Glycine max
  Coding DNA Sequence Number=SeqID_89610
  Homolog annotation: Hit_ID=A7R0W1; Match level="QueryCoverage=85%, HitCoverage=26%, E-value=6e-15, Identity=44%"; Hit description =Chromosome undetermined scaffold_325, whole genome shotgun sequence
MYMIGGALIPDKSGNRVHLMYLNLLRDLNNTKKYIWGSACLANLYRELYRASSEVGKVMGGCAILLQSWAGTACLLLHKESHDPKQLFHGLKDGVVVDKNIGPNHESHLMVTWSDIDLV

SEQ ID NO: 181296 - protein, 77 aa, Glycine max
  Coding DNA Sequence Number=SeqID_89611
MEEFDAQVAWPGDQSSSSRRGGASVSQEPMTEEPPAPAPSPAAVEEETTPDQTPQPSPSFAPALEETHPSALDLNED

SEQ ID NO: 181297 - protein, 60 aa, Glycine max
  Coding DNA Sequence Number=SeqID_89612
MVRSVDGSLSQQISLAEFSDCVVLNSLTREKGDTKEFRRKPENFRKLLEKEEEEEIQEDA

SEQ ID NO: 181298 - protein, 130 aa, Glycine max
  Coding DNA Sequence Number=SeqID_89613
  Subcellular localization annotation: CTP_CleavageSite=43; ConfidenceScore=5.48e-01
QHSAPATVMPISPVGRVTPTRLPVDPKKSNRALGFPALVTGLYQSYRVPIPPGKVMPSRHRDRAHRTPSGPKEVQQGPGVSSSGYGPLLVLRSACHPQQEGETPQQPGDGQQQATNAPPPPPEPLSSSTK

SEQ ID NO: 181299 - protein, 117 aa, Glycine max
  Coding DNA Sequence Number=SeqID_89614
MVTILGMDGLKAEASLSLHLVESLRLFELSNCAQQLASEIVDSAIVPYFLHIQVTRLPPMKWKRERRRHFKEKMSLEEAHNHRRPWIRAWRKKEMNEGRGREEHGILCSKRALKSEV

SEQ ID NO: 181300 - protein, 106 aa, Glycine max
  Coding DNA Sequence Number=SeqID_89615
  Subcellular localization annotation: CTP_CleavageSite=22; ConfidenceScore=5.39e-01
MVPFLDRFTGSFFVANSRLPPSSASVNSGGGGGASVACYCDASPCACLGAQYFSMKALLIGVDDPARGDEHSVELTEARNQSWKSQDPVGLLRVHWVSCGRDPCKQ

SEQ ID NO: 181301 - protein, 211 aa, Glycine max
  Coding DNA Sequence Number=SeqID_89616
  Homolog annotation: Hit_ID=Q1SN17; Match level="QueryCoverage=55%, HitCoverage=28%, E-value=3e-08, Identity=29%"; Hit description =Transposase, putative
MDEDQWIYDNIMSEEVNMNEDNGEELDVFENIDYSDAFNTSQVFATRDDILHWARSVAYDIGFMAVIMRKCGCPFKLQVLKGDGWMVKLICGSHNHALAKSLVGHPYTGRLTKVDKTIGDMTKSVVQLSYINFIQGQLFVNMWTFADQIEILNTHRRPWAHLEYSGGRLLQVEATKLAWASWAATTSLIFAIKWCEGLRKKGSTSLALRIH

SEQ ID NO: 181302 - protein, 76 aa, Glycine max
  Coding DNA Sequence Number=SeqID_89617
MQCMNMINAGMICPLQCHKEMHDAIKEHARGLLVTMHHQKRKTLDEASLLSSESETQHDHRSTSTPYGSHRPGYRA

SEQ ID NO: 181303 - protein, 154 aa, Glycine max
  Coding DNA Sequence Number=SeqID_89618
  Gene Ontology: Cellular component=chloroplast thylakoid membrane
  Homolog annotation: Hit_ID=A5AE12; Match level="QueryCoverage=100%, HitCoverage=91%, E-value=1e-44, Identity=66%"; Hit description =Putative uncharacterized protein
  Pfam annotation: Domain name=DUF149; Domain location=8-146; Score =59.7; E_value=9.7e-15; Accession=PF02575.7; Description =Uncharacterised BCR, YbaB family COG0718
MQNLYETVKKAQMVVQVEAVRVQKELAAAEFDGYCEGELVKVTLSGNQQPVRTEITEAAMELGPEFEIPFSNSQLFPHTDDPLLQETLSELAECRSGSRSCLAPLIECCGRKLSLLITEAYKDAHQKSVQAMKERMNDLAQSLGMPPGLSEGLK

SEQ ID NO: 181304 - protein, 158 aa, Glycine max
  Coding DNA Sequence Number=SeqID_89619
MVRTRGLGHALARVIGRARRRRVHIAVDEGVSQVTEDVPHMAEDVPQMTEDVPHMADDVQMTGDVGATVVEDLGRDGVERSYVDEGFPGGPRDPSVLTSFAEHERPELKLVSHGRKVALIGRPVPEIEGLVVAIGLSPLIGCSVVTGDLGLISAYVER

SEQ ID NO: 181305 - protein, 180 aa, Glycine max
  Coding DNA Sequence Number=SeqID_89620
TSVSLLTQAPPGRLSQSTEAGAGFSKVYSFDLKSATDRWPLSLKTHLIRTLFGKSVGDCLDAIFSRSMKYPFFAQFEVYPGQRFTRYAILGDDVCIADENVASLYRQTVACFQAGPAARKRSLPVLTWISGDGIRRPEATSSRGRSLALGDRLAVSLATAKRLPSAKDSFLSQQEDARLN

SEQ ID NO: 181306 - protein, 131 aa, Glycine max
  Coding DNA Sequence Number=SeqID_89621
MTQELVARGDTLRLSAPRHSVTPSVIDEQRPIWSSAPFPEMSAFSDGDFSSLTRARALVLPAPYLSSMSPMTSRDQVWSFCTLVSSRGGGPDDTRRYLTVIRTLLSSRGGGPDDKQRPSLVILHPCIIQRR

SEQ ID NO: 181307 - protein, 55 aa, Glycine max; identical to SEQ ID NO: 138410
  Coding DNA Sequence Number=SeqID_89622
  Homolog annotation: Hit_ID=A7R0J7; Match level="QueryCoverage=80%, HitCoverage=9%, E-value=1e-07, Identity=63%"; Hit description =Chromosome undetermined scaffold_310, whole genome shotgun sequence

SEQ ID NO: 181308 - protein, 99 aa, Glycine max
  Coding DNA Sequence Number=SeqID_89623
  Homolog annotation: Hit_ID=A4W953; Match level="QueryCoverage=93%, HitCoverage=68%, E-value=1e-39, Identity=88%"; Hit description=Curli production assembly/transport component precursor
MDFDKNAQAQNSYKDPSLKDFSIDTPSALDNFTQAIQSQILGGLLTNINTGKPGRMVTNDFIVDIANTDGQLQLNVTDRKTGRISTIQVSGLQSNSTDF

SEQ ID NO: 181309 - protein, 93 aa, Glycine max
  Coding DNA Sequence Number=SeqID_89624
QAPQQHEPELENDHSSEATISGAVDCKKRRLEMRSNEAAHHGPMPASANAPFPGMDPSPPQHAIDSSIPVLEIHEGQTIPVLPLDTSPPATPV

SEQ ID NO: 181310 - protein, 243 aa, Glycine max
  Coding DNA Sequence Number=SeqID_89625
RTHVLTFRGLHALAIRGLRVLTIRGLHALAIRGLHVLSFVRLHALTLKRTTRPRQQSAARPHLERTTRPRQQRAARPHFERTTRPRQQRAACPHLEEDYTGLHALTFRGLHVLANRGLHALTLRGLQVLANRGLHALTFRGLHVLANRGLHALTLRGLHVLANRGLHALTFKRTTRPRQQRAARPHLERTTRPRQQRAARPHLERTTLPLQQTAARPHLEEDYTSSPTEGFTPSPLEDYTSSP

SEQ ID NO: 181311 - protein, 184 aa, Glycine max
  Coding DNA Sequence Number=SeqID_89626
KEHALRRPYRTRARARVMGEAEEVQEKMKADMEAMKEQMATMVEAMMSMKKIMEANAVTVAATSTVAKVNLMPPSDLNQMNHPTSDMVGKDLGSTDGPMMCKFKTSTPSRHMACLPTIHHPMWRTLPTHEIPHHNLVDFEPCLGYATEGQAVGGIPLKKTLEGPQYHPKGSGTLKEAKIMPLQT

SEQ ID NO: 181312 - protein, 114 aa, Glycine max
  Coding DNA Sequence Number=SeqID_89627
  Subcellular localization annotation: CTP_CleavageSite=45; ConfidenceScore=5.54e-01
MATPPASPPPSPPPPADASASPSTFKRTRKATRPPGAERPVAHVNLAIGKADGPHKKKLRTYLGIIVRDKVDVTYENWKEVPAAQKDLIWEDIQAEFEIPEASDNRTKKKVLQT

SEQ ID NO: 181313 - protein, 127 aa, Glycine max
  Coding DNA Sequence Number=SeqID_89628
MASSLSCSSNIQIKSGSIDGDMLWMQAKHVSEHIWNEEEDKKSHIRRVVPTYQGQEEIPEEIIPLLRQSGLRVNGAPLIGSTNLDWLNNHDGNVQQLERFTHAWILRFIGGVLFVNKSSSKVSLRYL

SEQ ID NO: 181314 - protein, 33 aa, Glycine max
  Coding DNA Sequence Number=SeqID_89629
TCLTAKDSIDEEDPRPTSSTWSYIMWYQEHLHL

SEQ ID NO: 181315 - protein, 130 aa, Glycine max
  Coding DNA Sequence Number=SeqID_89630
CVGALHNNCYIIVASHLWGGKSSVSSAGATKAEIAETLQYMVSPQWRNTWTVDDLVPYVEKITILSKEQERIIEPVPHGPASECQFSAPEFHILQSSVETQGIGRRREAVEAEEYSQQMAERGHEMYYTP

SEQ ID NO: 181316 - protein, 60 aa, Glycine max
  Coding DNA Sequence Number=SeqID_89631
MKCLNKECSRERKLRAHSRHLLKDPNGESKEKQHIPLPFPRRAISNKKNGRGKEGDLGNI

SEQ ID NO: 181317 - protein, 104 aa, Glycine max
  Coding DNA Sequence Number=SeqID_89632
  Subcellular localization annotation: CTP_CleavageSite=63; ConfidenceScore=5.44e-01
MTLSLAHQWAKRASTAKRSFSALSMTEESSKASISRLHAKREISVLSTAVVFSQAQRMTGGPRAQNSTAHHGAYFEKEALEAARGTAFAEIPRFCKLIIVRVSL

SEQ ID NO: 181318 - protein, 225 aa, Glycine max
  Coding DNA Sequence Number=SeqID_89633
MAPRKLASKRSRKDKAAEGTSSTPEYDSHRFRSAEHQQRFEAIKGWSFLRERRVQLRDDEYTDFQEEIVRRRWASLVTPMAKFDPDIVLEFYANAWPTEEGVRDMRSWVRGQWIPFDADALSQFLGYPLVLEEGQECEYGQRRNRADGFDEEAIAQLLCIPGKNFARTAAGRRVRIMRTNMTTLTQIWMTLLLSNIQPSDHNSDLPLPKCQLVYAILTRMSIHLA

SEQ ID NO: 181319 - protein, 83 aa, Glycine max
  Coding DNA Sequence Number=SeqID_89634
  Subcellular localization annotation: CTP_CleavageSite=61; ConfidenceScore=5.53e-01
MATQLNQAQSQNSYKFPSQTVQNPKNVSAITLRYGNQIQVPPPVAAPTPEPPPIPIPFPPRAMPNKKMEEVEKEILETFRKVE

SEQ ID NO: 181320 - protein, 154 aa, Glycine max
  Coding DNA Sequence Number=SeqID_89635
  Homolog annotation: Hit_ID=A6H5B3; Match level="QueryCoverage=43%, HitCoverage=84%, E-value=5e-23, Identity=80%"; Hit description =Putative ribosomal protein S3
GKESKSDSRSSGERNGSSLNRENGVVGELYKCRAARRSSRECCRLDGESPVAESITSLRSDPSSMGHVESRVNQQGPPCKAKYSWVTDSEVVPETTGAVAKASLHRAIVTAYGPEPGSEPTDVEESADELWLGVKCHSNPELAGSPRNALRRSS

SEQ ID NO: 181321 - protein, 89 aa, Glycine max
  Coding DNA Sequence Number=SeqID_89636
MDFEICQIVQQKAIKFVQQNFPNVQKNVCALLVMGKLRGVDGDPMPRGMRIRATWGYVSLVEGGQLGMVGSCLICGCGRVDLHHRPIST

SEQ ID NO: 181322 - protein, 230 aa, Glycine max
  Coding DNA Sequence Number=SeqID_89637
  Gene Ontology: Cellular component=1-2nm peptidoglycan-based cell wall; Biological process=regulation of cell growth
  Homolog annotation: Hit_ID=A4WFI6; Match level="QueryCoverage=100%, HitCoverage=32%, E-value=1e-114, Identity=87%"; Hit description =Intracellular growth attenuator IgaA
  Pfam annotation: Domain name=IgaA; Domain location=1-230; Score= -122.0; E_value=8.4e-14; Accession=PF07095.2; Description =Intracellular growth attenuator protein IgaA
MVLLDDFGDIVLKTQDLCASQDECIRLKNALVNLGNSKDWDSLVKRAEAGRLDGVNVLLRPVSAESLDNLVATSTSPFMMRETTRAAQALNSPAPGGFVIVSDEGSDLVDQPYPQVALYDYPAQEQWSQFQRLAQMLMQTPFSAEGIVTSIYTDANGTRHVGLHRMPDSAGLWRYIGTSLLMIAMLAAIFWNGVMALRRYQRSRTRLAEIQQYYENCLNPKLIPSSESLI

SEQ ID NO: 181323 - protein, 209 aa, Glycine max
  Coding DNA Sequence Number=SeqID_89638
  Homolog annotation: Hit_ID=Q2HW90; Match level="QueryCoverage=91%, HitCoverage=43%, E-value=9e-14, Identity=28%"; Hit description =Putative uncharacterized protein
MGLNQAPSFKKSFYHVKIKSLEVSSLQELGQRMDQLQRQAFLKTYGKIWDLTMIEVSVEAITSLIQYYDQPLSCFTFGDFQLVSTVEEFERILGCPLGGRKLYLFFGLYPSMARIAKMHLEEKAKALADQGEWASFINFLALLVFGVVLFPNVDGLVDLAAIDVFLPYHNSKESPVVAMLVDAYDTFDQRCEKRGARIVCCTPALYVWL

SEQ ID NO: 181324 - protein, 187 aa, Glycine max
  Coding DNA Sequence Number=SeqID_89639
MEEKKKKKLEEATQSRSTDTIIDQPSPIRRHVKWKMVRTKKTGQMTSQPAKEIANKIVRFIGGAGLIGFLCRPWTNTLDWAKDLPHVFLRGSRRPGAADTTNQGPTGGGFPLPPELEIGPSVARVSTKESCIDPSWNDPDMGDSDKCGLYIEENPPRLVAIRRLYEGSTTIHNIPLLHDHVKVGVEE

SEQ ID NO: 181325 - protein, 433 aa, Glycine max
  Coding DNA Sequence Number=SeqID_89640
  Gene Ontology: Mol. function=UDP-glucose:glycoprotein glucosyltransfer ase activity; Cellular component=endoplasmic reticulum; Biological process=protein amino acid glycosylation
  Homolog annotation: Hit_ID=A7PDG3; Match level="QueryCoverage=33%, HitCoverage=28%, E-value=4e-30, Identity=48%"; Hit description =Chromosome chr17 scaffold_12, whole genome shotgun sequence
MCQNHWLYERLSQSLRLSGEYHFSDKQKKHKRSTVGLLGKVFSLRRVSTPHGEPNKVAETVVKKEKKHSSWQIICKQKKASIFHIKAAGARTYKKGGTEFILEKEIHERPVHGIRSKVVARKAPHKDLPNYAQHTVPIFCLPQEWLWCESWCGNATKYKAKTIDLCNNPMTKEPKLQQMRCQKMLIESRQTHPRELLINQIRTGWTRLENLNLARTLTREASLSVPLATKFSTHTKLGGHRSSHKKIKGCFASRNESSESNECVVEHQHGASFHNEVETVNESKKSKGHECPICLKVFPCGQALGGHKRSHMVGGFESRSFQTIVLQEPVAEIRDFLDLNLPAATKEESNSHADSNSNIPWWIVEENHKQEALSAKAVWTARSMSGANKKMIEALAARKKEQYLKKEEYLQQFKMNCHKFHFQSFHPIYACFQ

SEQ ID NO: 181326 - protein, 22 aa, Glycine max
  Coding DNA Sequence Number=SeqID_89641
MSLDVFALEALPGDGTFMRRME

SEQ ID NO: 181327 - protein, 113 aa, Glycine max
  Coding DNA Sequence Number=SeqID_89642
VGADKDYKEVPPPPLFKPAGGHINQAVTFNRSYYKNTFISTTVLLRDYSSINTVSYDGRPQQNTVVVIGPFYDGSPCLNCGPFYDGPLETTVVEQDYVYDGAVLMAVVVSSKF

SEQ ID NO: 181328 - protein, 233 aa, Glycine max
  Coding DNA Sequence Number=SeqID_89643
MSFWDGDGEPDLKKDGDSGCELQCKHDLPLLLDAGNGGGLALRDGGLATVEGFEGFFGEGIKILGFLDNGVLEGGEVGGEGGEEFIKELLDPRRHWRVLRLLSQTEIENRARRAPPYHTSVGPRPIRHAQIHVEEDGRSDVAMVHGVKAEGVSIAVRRDSGGDGGGSGPSLAGGRGNGERKRETNEKRNKKQHRFCFLKIKKKNLCVISLSQRVYMVTHVTMPMCLINGHVSS

SEQ ID NO: 181329 - protein, 85 aa, Glycine max
  Coding DNA Sequence Number=SeqID_89644
MLCVIDYMVMGTSFVVQVKGTSTWVVVTENKRGYISCGSIQVEGTSTWLFKENKGGYIPCGSLLVKAFTRLKRNLKDRRSLGDWM

SEQ ID NO: 181330 - protein, 293 aa, Glycine max
  Coding DNA Sequence Number=SeqID_89645
MCTGMTTLTQIWMTLLLNNILPSDHNFDLPLPKCQLVYAILTQVSIHVAQLILDAIYQFAGITPPRHLVDPEKSNRALGFPALIMGLCQFYGVPQSLHREILYAKAGTTVGSGTTTTRGGPLAASRRCTVVASIGDTIPRVHLRSLVEDRAPDAHIHAAWVKCSLMRPSTGTLCTNRARTSVLSHGLPPSSSGPQLHGLEMSPILRQGQGPQGPLGTMMELKRIMIWLMCLISSLEEAELHDHFCYLIVINLTTSSVLSYYCIAMIKTPKRFLQKRNVCLKGECDERFSRMLK

SEQ ID NO: 181331 - protein, 94 aa, Glycine max
  Coding DNA Sequence Number=SeqID_89646
MTRKPRQDFSVSKVSPKEILEALPLSHAAFFFFSSSTIVAQQSFNLWCSFLLQIAKGGHFRSREVRVYEWDFEISGLGGLLSLLIFVGMGYWEI

SEQ ID NO: 181332 - protein, 84 aa, Glycine max
  Coding DNA Sequence Number=SeqID_89647
MTSRDQVWSFCTLVSSRGGGPDDTRKYPSGYPYKHSFAISPRPIWALQKIPPEGGCFWRKQPCSPGRAELAWASWAATTSPILL

SEQ ID NO: 181333 - protein, 109 aa, Glycine max
  Coding DNA Sequence Number=SeqID_89648
MNFAVKKPVEFTPIPVSYANLIPYLLDNSMVAITPAKVHQPPFLREYDSNATCACHGEAPGRSIEHCRALKSKVQAIGLFAQATYALEFGLPRPFNQRLLVKHVGVGVP

SEQ ID NO: 181334 - protein, 151 aa, Glycine max
  Coding DNA Sequence Number=SeqID_89649
GENVNPYPRKKKSGRKQKRKEGKFPIKELEKAKNKRRKIPKSKSGRKKKEGKKIPDQGSKENRGNVQKGHWTRRYLNNTKLSPNKKKRRKGNHDLKWSSPFDCQPKSCASVTCSPRVKQKQKRKRPENSKPNFPPKEPIPKKSPIDPRSRM

SEQ ID NO: 181335 - protein, 135 aa, Glycine max
  Coding DNA Sequence Number=SeqID_89650
SNALNGPLCFYRLKWTVQKHKINPSLYCRLKELRRSDFLFDGGLLSFGTNVRGANTFLKHKYNSRIWNILHDWFPSVFLTFSTNNVGGDSAHFPPSEDAPVSLASLARKRGPYTRVHGNLRSGGGSMVMLGLRLV

SEQ ID NO: 181336 - protein, 125 aa, Glycine max
  Coding DNA Sequence Number=SeqID_89651
AIRATQAIWAFIGQKGIISTTHSPILAILTNSLDSTGSRVADTYERRLGPLFKNRSLSATITEGCRVYIKWKASEAVVYRAEAEQSEGSPFCMLNYDPAKTEGLDLSIFKKAISLNTKGLLVPVQ

SEQ ID NO: 181337 - protein, 108 aa, Glycine max
  Coding DNA Sequence Number=SeqID_89652
  Homolog annotation: Hit_ID=Q51617; Match level="QueryCoverage=35%, HitCoverage=55%, E-value=5e-13, Identity=94%"; Hit description =Putative uncharacterized protein
MTVKTSDTCSSRRRSQLVCKRMPGADKPVRARQRVLAGCRGWLNYAASEQIMRKEKIPHQAPFAIQAAQLLGRAIGAGLFAITPAGERGMCCKAIKLGNARVFPVTTL

SEQ ID NO: 181338 - protein, 186 aa, Glycine max
  Coding DNA Sequence Number=SeqID_89653
MLNTLFKSPVIVEEGESLCAYSRFALLRPNPQELAAKLCIPGSGFELNADGQPLKILRKNMTTLAQTWSALSFTNLIPTSHTSDVTLDRAKLIYGIIMKMDMNVGGPRKVRGKRFEAPSTSASEAPTPYSSTLPPSSSTEIPVIPPAPTQIPLPTPLFAGPADFIFTPQMLHSMLQSIHRGQSIIM

SEQ ID NO: 181339 - protein, 302 aa, Glycine max
  Coding DNA Sequence Number=SeqID_89654
  Homolog annotation: Hit_ID=A6X3D5; Match level="QueryCoverage=83%, HitCoverage=88%, E-value=1e-123, Identity=88%"; Hit description=MltA- interacting MipA family protein precursor
  Pfam annotation: Domain name=MipA; Domain location=65-272; Score =219.2; E_value=9.8e-63; Accession=PF06629.3; Description=MltA -interacting protein MipA
MPQNLLGRFLLEFNVAHIVPLALVAGAAFLTSSSLAFSADVQQTDIYAAETVQPARKYFWSGDWYLKVGAAGLVAPKFEGSNKYRFSAQPLISLGRQGQATRFSSRNDNVSFALIDNDRFRVGLAGKLLFERDDDIHGLKDTKFGGEAGAFVDVYPTDWMRVRGEVRHGIRAHNGVVADIAADAFYDVTPTVRVSGGPRATFASKDYFKTYFGVDAEEAVTSGLSEYSPGGGFKSAGVGGAITWKATDKIDTSLFGEYSRLQVFGKGFKHREGTRLPGPVHGRRFCDLPFRFLAGLTSTVSM

SEQ ID NO: 181340 - protein, 139 aa, Glycine max
  Coding DNA Sequence Number=SeqID_89655
  Pfam annotation: Domain name=Retrotrans_gag; Domain location=18-119; Score=7.5; E_value=0.01; Accession=PF03732.8; Description =Retrotransposon gag protein
DRTSGLSDERIPSSESSSSFPTELREIEVGASEANIVAEDQPPRVTLEDYSRNNLKTWEEVVEKFLKKYFHESKIAEGKAEISSFHQFHDESLSEALERIRARGKIKLKTPKEAMELIENMVASDHAILRDMTHIPTKR

SEQ ID NO: 181341 - protein, 128 aa, Glycine max
  Coding DNA Sequence Number=SeqID_89656
  Homolog annotation: Hit_ID=A5AZ88; Match level="QueryCoverage=54%, HitCoverage=6%, E-value=3e-07, Identity=38%"; Hit description =Putative uncharacterized protein
MGRNVSALIGKSVPQILEKCKDPEEGCCKGSVPIILGRPFMKTTRTKIDVYAGTVSMEFGDIIIHFNILNAMKHPSEDLSVFHVEIIDHIVDEYMTDLHSNLHACHSSCIESEFVLDHMSEFDAEMNL

SEQ ID NO: 181342 - protein, 75 aa, Glycine max
  Coding DNA Sequence Number=SeqID_89657
MAKALSFSGKTKLSDHVLHGDKRTLKKKTKIIISGGFIDLISIMPAPTSTTIADGTEHHVDDTQVDRPHDMSKDH

SEQ ID NO: 181343 - protein, 381 aa, Glycine max
  Coding DNA Sequence Number=SeqID_89658
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=74%, HitCoverage=99%, E-value=1e-150, Identity=94%"; Hit description=Beta- lactamase TEM precursor
  Pfam annotation: Domain name=Beta-lactamase; Domain location=31-280; Score=186.5; E_value=6.7e-53; Accession=PF00144.15; Description=Beta- lactamase
  Pfam annotation: Domain name=Peptidase_S11; Domain location=29-263; Score=-122.5; E_value=0.033; Accession=PF00768.11; Description=D -alanyl-D-alanine carboxypeptidase
  Pfam module annotation: Pfam domain module=Beta-lactamase::Peptidase _S11; Domain location=31-280::29-263
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHCVRPRRKDQRIFLRSFFSARNLLLANKKTTATSGGLFAGSRATNSFSEGNWLQQSADTKYCSSSVAVVRPPVQELCSTVYIPRSANPVTSGCCQWR

SEQ ID NO: 181344 - protein, 274 aa, Glycine max
  Coding DNA Sequence Number=SeqID_89659
IASIASSGYSLILRLYRERGDARVQAEHEGGDAGRGQVQVARLLGADALAAQLHARSPVNMDRLDGRQRDQQRRIHRRAGALQDAGNAERLVGMRGQRDRAGAVRQHDLVAEADLLRASHLRADHRVIQIIEGPPLCKGQRVAGTITIVFKVAASGTHYPVAAPGIAQRQRHRPLHLRPCGQLLVGLPGHVVGRVADMEHRIQQQVHRSRTRTDDQISARYGAGKPLVRLRAYTLDAQQQHHAEGDDQHGQAHAQRAAAQAGPGKLKHGRHLPG

SEQ ID NO: 181345 - protein, 126 aa, Glycine max
  Coding DNA Sequence Number=SeqID_89660
MKWMNRFALTLNESQVLPRLLARAKAVADMYSTPDEVHGLFDYCQHMMLHYSFHSVFSSHYHHQKVTIVTKKNECALRHCRNLPFGGRAMRGLTGASSKKGKCAESPPTFIEGKRRKNQKGVVYEL

SEQ ID NO: 181346 - protein, 349 aa, Glycine max
  Coding DNA Sequence Number=SeqID_89661
  Homolog annotation: Hit_ID=A5BY33; Match level="QueryCoverage=68%, HitCoverage=13%, E-value=3e-12, Identity=24%"; Hit description =Putative uncharacterized protein
MEFFSAETFDCIQAFQNLGLIPFMSLQLPVYPELVKAFYCNLEIQDNTLISEVFGIKMVIDQSFFHDLTQLSSDGVPFEGTLNDDWKFDFSAHDARQLVCTNNADMTGRLLAGSLAFESRILHYLIVRILLPRSSNLAQVSEEDLVIMWAFHTDRQLDWAHLVRYRMHKALRLNAPLPYPHLVTLFFRHFQIPLDSEPYVPIKRSFLIGAAVIASFGYCKEHDGSWVKKGAQPLMKKATYQLKIIPLFFEGLWTSLMPWNCKSTCGSMPWNQGSPKLKKMSPSFVLALIHHHRLHHHLSLTCLDFRDCHHQKGGDCRQRIKLNVLMIPKFSHASQSFIQDKGIKDIQDR

SEQ ID NO: 181347 - protein, 174 aa, Glycine max
  Coding DNA Sequence Number=SeqID_89662
  Gene Ontology: Mol. function=nucleic acid binding
  Homolog annotation: Hit_ID=A5AYU6; Match level="QueryCoverage=55%, HitCoverage=17%, E-value=2e-15, Identity=41%"; Hit description =Putative uncharacterized protein
MELKRLNQHEENDKKKKGISLKASSSIQEESDKEDSIEIDKDDDLSLFAKKAYITWDDNDMDSFEDSENKIVNQSLMAKSYESNEEVSLKKSWYIYSGCSKHITGDASKFTHISPKKSGHVTYDNNNKGRILGVGKIDDVSESLEEMHIHEEDHKGKGDGNNEDFQTNAYLPRE

SEQ ID NO: 181348 - protein, 139 aa, Glycine max
  Coding DNA Sequence Number=SeqID_89663
  Homolog annotation: Hit_ID=A4DID9; Match level="QueryCoverage=45%, HitCoverage=88%, E-value=7e-19, Identity=53%"; Hit description =Putative uncharacterized protein
GKEGLLLGGPEPSVRYHSGRARILTLCQDLRAEGQSQAEGSLTARPTRRAGTKVGLSDPTVPSGRAVAQRIKGWAVRPLKRYVSWVQNVVRQFGPYPDREGRTSGVPVIVPTVNAGASGSTAETAMGSLPPAGMERKKF

SEQ ID NO: 181349 - protein, 236 aa, Glycine max
  Coding DNA Sequence Number=SeqID_89664
  Homolog annotation: Hit_ID=Q2HW90; Match level="QueryCoverage=94%, HitCoverage=46%, E-value=8e-63, Identity=54%"; Hit description =Putative uncharacterized protein
  Pfam annotation: Domain name=DUF1723; Domain location=2-51; Score =11.5; E_value=0.023; Accession=PF08330.1; Description=Protein of unknown function (DUF1723)
VDVEEGCLETLVQFYDPLYHCFTFPDYQLVPTLEEYSYLVGLPVPDKIPFHGFEPTPKPSDIAAALHLKTSIIQANLTSKGGLQGLPTHFLYQQASIFAEAASILAFHSILALLIYGLLFFPNVDNFIDINAIKIFLTKNPVPTLLADTYHSIHDRTQAGRGTISCCAPLLYQWFTFHLPQSRAFKTNDDKLSWPRRIMTLDPSDIVWYQAASDVGEIIVSCGDIPTYLFWVCVAD

SEQ ID NO: 181350 - protein, 264 aa, Glycine max
  Coding DNA Sequence Number=SeqID_89665
MAINPSRAHKYTKFSKRKQGECSQVALNRLDTWFIDENKKTNFKMIYTMKNVRIPNANMEGNLYSIVNGVEMIIDAAVWKAVAGLNIVGVCTFKESTNGHSKMQTYKASRFIDYFNINVYNEIVDFTKASNETTERHLKKLGMRYVVHEWIMVGEQPAAINMDRMEEEKEEESEQELAHRWNPFESLMIQKMDAILHLHQEHQAKVHTLCRACRPWIFFINGVLCFLNINGNGMGKEKDDWRCHFKEKMSQEEAHHHRKPQIRA

SEQ ID NO: 181351 - protein, 67 aa, Glycine max
  Coding DNA Sequence Number=SeqID_89666
MAKGANDHNLSLHANERTCIRKAKGADDHNLSLRADGLACLWKAKNVQMTINCLRMLTDSVVYGRKR

SEQ ID NO: 181352 - protein, 95 aa, Glycine max
  Coding DNA Sequence Number=SeqID_89667
MATQVAPPMIEKEMITMIVDTLPVFYFEKMVGYTPSSFANLVFTGKRIEVGLKRGKFDHPTLVNGKPGANREDDKQGGSHVVTVVPTWPNFPPTP

SEQ ID NO: 181353 - protein, 159 aa, Glycine max
  Coding DNA Sequence Number=SeqID_89668
MGEVDEVQQWIKANIEALKEQIATMMEAMMSMKKMMEVNATAVAATSVVAKVDPILSSGLTQIIHPTSDMVGQAGKELGSMGGLHFLQVQNKHPFLSYGLPPNYTPPNLAHTPDENVNNPTLILIDSQRPQSDHAHILQPIEETHEIPHHNLVNFEPCL

SEQ ID NO: 181354 - protein, 23 aa, Glycine max
  Coding DNA Sequence Number=SeqID_89669
MSVSVLVPGLGQVRVVTLSASEA

SEQ ID NO: 181355 - protein, 141 aa, Glycine max
  Coding DNA Sequence Number=SeqID_89670
MSNSDNRAYHRAIRPMRAGFSKMYLTGSILDTNQVVWLSMYCLRRWAAHNKAQHILSSREICPLNLMMKYVQFKLSLAHQWAKLVSTAKFAKAALSATKEYGRASISRPRAKREINVLSATIVFSQAQRMTDAKLKSTYSH

SEQ ID NO: 181356 - protein, 56 aa, Glycine max
  Coding DNA Sequence Number=SeqID_89671
MDLTKLPAKRYSKDTTEEGSSTAPQADMDFDRHRERRVQLRDDEFPNFQGEIARRR

SEQ ID NO: 181357 - protein, 117 aa, Glycine max
  Coding DNA Sequence Number=SeqID_89672
  Gene Ontology: Biological process=cell division
  Homolog annotation: Hit_ID=A7PKI3; Match level="QueryCoverage=99%, HitCoverage=58%, E-value=2e-38, Identity=65%"; Hit description =Chromosome chr15 scaffold_19, whole genome shotgun sequence
MASSLIISPRKLRSDLYSYSYQEDHYSTPLVINVLASLIERSMARTERIVKNGSRSLSKAISTNIFDCREILDMTIQSYLERIFRFCQNNPGFRINARNVHRLLITTIMLASKYVED

SEQ ID NO: 181358 - protein, 41 aa, Glycine max
  Coding DNA Sequence Number=SeqID_89673
MDGWANPSINYDLCKPYQGLVRVSLNHQGVTMLRDMLELIA

SEQ ID NO: 181359 - protein, 105 aa, Glycine max
  Coding DNA Sequence Number=SeqID_89674
MTGLMVSYPNFIRGPLFDGMQPLFDRFEQPDPLGPSRLFLQKAVASGGSNLARLDELRGKLLPYFPINRGRSEEGRGSAFLAFRNHLKFVRKIVSVKKIEAEALP

SEQ ID NO: 181360 - protein, 109 aa, Glycine max
  Coding DNA Sequence Number=SeqID_89675
MKMLLIPHDVAPYGACRPWIFFINGVLCFLNINGSRMEKEKDDWRCHFKEKMTPCGACRPWIFFINGVLCFLNINGSKMEKEKDDWRCHFKEKMSQEEAHHHRKPWIRA

SEQ ID NO: 181361 - protein, 96 aa, Glycine max
  Coding DNA Sequence Number=SeqID_89676
MLIDVGNALACACCVCSWGAKCTDLPGSLALALGHVHTLDVVYVRGGRSALIFHGLWHLLWATFIHRNSFWPQADHLWGGQLCAQPGGLDELCMVS

SEQ ID NO: 181362 - protein, 532 aa, Glycine max
  Coding DNA Sequence Number=SeqID_89677
  Gene Ontology: Mol. function=transporter activity; Cellular component= integral to membrane; Biological process=transport
  Homolog annotation: Hit_ID=A8GJF0; Match level="QueryCoverage=98%, HitCoverage=62%, E-value=0.0, Identity=64%"; Hit description =Fimbrial biogenesis outer membrane usher protein precursor
  Pfam annotation: Domain name=Usher; Domain location=1-512; Score =300.6; E_value=2.9e-87; Accession=PF00577.11; Description=Fimbrial Usher protein
GRVIYETHVATGPFRIQDINDAVNGTLDVRVEEQDGTVQKFTVNTASVPYLTRPGRVRYKLATGRPSDFRHHINGPTFAAGEYSWGINNGWSLYGGGIASARYGAVSVGLGRDLLFLGALSFDATQSQAKLPHTGTQSGRSYRLSYSKRFEEYDSQVTFAGYRFSQRNFMTMGDYLNAQRDARRNGRNKEMYTVTLNKSFRDLGVTAYLSYTHQSYWNRPASDNFSLSMSRYFDIGRLKNVSVSLAAYRNKFNKVTDDGAYISLSFPFGNSSNISYSADVKRDDTSHDVSYYDRVNENSSYQLRAGHSRRGNSMGGYVSHHGDIADTTASINYQEGQYSSLSVSAQGGAVLTPEGGALHRNMMLGGTRLLVDTSGVPDVPVRGFGAPVYTNRFGKAVISDVNSYYRSSARIDFGKLDDNAEATRSVVQTTLTEGAIGYRRFNVIAGAKAMAIIRLADGSVPPFGASVMNSKKQETGIIYDQGNIYLSGVHPAERMDVSWNGQVQCSVTLPATLPDDLYSGLLLPCLREDEKI

SEQ ID NO: 181363 - protein, 432 aa, Glycine max
  Coding DNA Sequence Number=SeqID_89678
  Gene Ontology: Mol. function=glutamine-fructose-6-phosphate transaminase (isomerizing) activity; Cellular component=cytoplasm; Biological process=carbohydrate biosynthetic process
  Homolog annotation: Hit_ID=Q8Z9S8; Match level="QueryCoverage=100%, HitCoverage=70%, E-value=0.0, Identity=87%"; Hit description =Glucosamine--fructose-6-phosphate aminotransferase [isomerizing]
  Pfam annotation: Domain name=SIS; Domain location=112-242; Score =144.6; E_value=2.7e-40; Accession=PF01380.13; Description=SIS domain
  Pfam annotation: Domain name=SIS; Domain location=284-415; Score =120.1; E_value=6.4e-33; Accession=PF01380.13; Description=SIS domain
  Pfam module annotation: Pfam domain module=SIS::SIS; Domain location =112-242::284-415
PLVIGRGVGENFIASDQLALLPVTRRFIYLEEGDIAEITRREVTIIDRHGNQAQRAEIESNAQYDAGDKGVYRHYMQKEIYEQPNAIKNTLAGRFHDGIVDLSELGANAETLLSQVEHIQIIACGTSYNSGMVSRYWFESLANIPCDVEIASEFRYRKSAVRKNSLLITLSQSGETADTLAALRLSKELGYLGSLAICNVAGSSLVRESDLALMTKAGTEIGVASTKAFTTQLTVLLMLVAKLGRLHGMRADTEHEIVHALQALPSRIEQMLAQDKVIENLAEGFSDKHHALFLGRGDQYPIAMEGALKLKEISYIHAEAYAAGELKHGPLALIDADMPVIVVAPNNELLEKLKSNIEEVRARGGLLYVFADQDAGFSDSEGMKIIPLPHVEEVIAPIFYTVPLQLLSYHVALIKGTDVDQPRNLAKSVTVE

SEQ ID NO: 181364 - protein, 59 aa, Glycine max
  Coding DNA Sequence Number=SeqID_89679
MAILVDDKRLLLEGEATMWKRLTLEGEMCWVTSVRSPYVVARGPQVYPSNLPNIALLPK

SEQ ID NO: 181365 - protein, 190 aa, Glycine max
  Coding DNA Sequence Number=SeqID_89680
  Homolog annotation: Hit_ID=A5AZ88; Match level="QueryCoverage=39%, HitCoverage=7%, E-value=1e-08, Identity=44%"; Hit description =Putative uncharacterized protein
  Pfam annotation: Domain name=Retrotrans_gag; Domain location=26-116; Score=2.4; E_value=0.031; Accession=PF03732.8; Description =Retrotransposon gag protein
AVASILEEGTHFSNSSSPDSPSSRESAAHLPEVASMADEHQQRVTLEDYSSSSMSQFFTSIARPKEKPRGGSTHLRFPNESLSEALERFRGLLRKTPTHGFSEPIQLNMFIDGLRPQTKKLLDASAGGKIKLKTLEEATELIKNMSASDHVVPFMVRLMKQANVSPLKKTLKKFIIWEINRDKDILKEDF

SEQ ID NO: 181366 - protein, 226 aa, Glycine max
  Coding DNA Sequence Number=SeqID_89681
  Gene Ontology: Mol. function=manganese ion binding; Cellular component=ribosome; Biological process=protein modification process
  Homolog annotation: Hit_ID=Q57R87; Match level="QueryCoverage=100%, HitCoverage=75%, E-value=1e-110, Identity=89%"; Hit description =Ribosomal protein S6 modification protein
  Pfam annotation: Domain name=ATP-grasp_3; Domain location=63-226; Score=-24.5; E_value=0.00042; Accession=PF02655.5; Description=ATP -grasp domain
  Pfam annotation: Domain name=Dala_Dala_lig_C; Domain location=65-226; Score=-115.1; E_value=0.041; Accession=PF07478.4; Description=D-ala D- ala ligase C-terminus
  Pfam annotation: Domain name=GSH-S_ATP; Domain location=65-222; Score= -17.8; E_value=8.5e-09; Accession=PF02955.7; Description=Prokaryotic glutathione synthetase, ATP-binding domain
  Pfam annotation: Domain name=RimK; Domain location=63-226; Score =288.8; E_value=1.1e-83; Accession=PF08443.2; Description=RimK-like ATP-grasp domain
  Pfam module annotation: Pfam domain module=ATP-grasp_3::Dala_Dala_lig_ C::GSH-S_ATP::RimK; Domain location=63-226::65-226::65-222::63-226
MSCYMNIDPAASSIHYKGRKLPHFDAVIPRIGSQITYYGTAALRQFEMLGSYPLNESVAISRARDKLRSLQLLARQGIDLPVTGIAHSPDDTSDLIDMVGGAPLVIKLVEGTQGIGVVLAETRQAAESVIDAFRGLNAHILVQEYIEEAKGRDIRCFVVGNEVVAAIERQAKEGDFRSNLHRGGIARVATISDREREIAVKAAQTLGLDVAGVDLLRATRGPLVME

SEQ ID NO: 181367 - protein, 83 aa, Glycine max
  Coding DNA Sequence Number=SeqID_89682
MARSVVRFVPLFKGPIWERAKRVFSDNPQVPSGVANCRNLPFDGRATRDSQVRVPRKEYARSRHQRLFEENVGKTRKDVIYEF

SEQ ID NO: 181368 - protein, 102 aa, Glycine max
  Coding DNA Sequence Number=SeqID_89683
  Subcellular localization annotation: CTP_CleavageSite=60; ConfidenceScore=5.38e-01
LAPTRHPLDPDKSNRALGFPALITRLYQSFRVPVAPSKLSLSLQSQGFTSFLCPTPDQFRAEVTWPGDWPEAPAEAPDEADEAREDEEMTDLLDFLGGSRAT

SEQ ID NO: 181369 - protein, 356 aa, Glycine max
  Coding DNA Sequence Number=SeqID_89684
  Gene Ontology: Mol. function=aminoacyl-tRNA ligase activity; Cellular component=cytoplasm; Biological process=tRNA aminoacylation for protein translation
  Homolog annotation: Hit_ID=A8GAY0; Match level="QueryCoverage=79%, HitCoverage=61%, E-value=1e-146, Identity=89%"; Hit description =Cysteinyl-tRNA synthetase
  Pfam annotation: Domain name=DALR_2; Domain location=163-224; Score =125.9; E_value=1.2e-34; Accession=PF09190.2; Description=DALR domain
  Pfam annotation: Domain name=tRNA-synt_1e; Domain location=1-136; Score=108.2; E_value=2.5e-29; Accession=PF01406.10; Description=tRNA synthetases class I (C)
  Pfam module annotation: Pfam domain module=DALR_2::tRNA-synt_1e; Domain location=163-224::1-136
MDFVLWKMSKPGEPSWQSPWGPGRPGWHIECSAMNCKQLGTHFDIHGGGSDLMFPHHENEIAQSSCAHDGPYVNYWMHSGMVMIDKEKMSKSLDNFFTIRDVLGHYDAETVRYFLMSGHYRSQLNYSEENLKQARTALERLYTALRGTDADAAPAGGEAFEARFREAMDDDFNTPEAYSALFDLAREVNRLKGEDMAAANGMAAELRKLAKVLGLLQQAPEQFLQGGAQVDDGEVAEIEALIKQRNEARAAKDWALADAARDRLNEMNIVLEDGPQGTTWRRFNHDLATVELHHLIGDDLAALAGFDLAVDFHLPFSDDFFGGAAAFTPALELQQIAQFDVGMIVQIENFHTALLI

SEQ ID NO: 181370 - protein, 106 aa, Glycine max
  Coding DNA Sequence Number=SeqID_89685
  Subcellular localization annotation: CTP_CleavageSite=32; ConfidenceScore=5.14e-01
MVEPSKKHKGSSSRSQRYSKVQDTPIPSSIPSSSLFSSEEQHIRYTNLFSSRSIIDPKFIDMDFFSNESFECIQAFQNSNLIPFMSLKFPVYFELVKAFYSNLEIQ

SEQ ID NO: 181371 - protein, 190 aa, Glycine max
  Coding DNA Sequence Number=SeqID_89686
  Homolog annotation: Hit_ID=Q5XM22; Match level="QueryCoverage=65%, HitCoverage=84%, E-value=4e-24, Identity=42%"; Hit description =Resistance-like protein HAAS-2
VTITLDDVASLLHLPIIGAFHNFEQLYVDHVVNMLVKLLETKIDACHWIVVARAYLLHLLGCTLFANKSVIHVHVIFLDALHDLTQSGTYAWGIIALVHMYDNLNKASKSMTRQLAGYITLLQCWIYKYFSSIGSAIAAKDYDERRPRACRWTFGKALPVLTYRRHLDRLTPDVVCWIPYDDHRSFREFK

SEQ ID NO: 181372 - protein, 299 aa, Glycine max
  Coding DNA Sequence Number=SeqID_89687
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=89%, HitCoverage=23%, E-value=1e-111, Identity=77%"; Hit description =Candidate disease-resistance protein SR1
  Pfam annotation: Domain name=NACHT; Domain location=87-241; Score= -3.0; E_value=0.0001; Accession=PF05729.3; Description=NACHT domain
  Pfam annotation: Domain name=NB-ARC; Domain location=48-299; Score =68.4; E_value=2.4e-17; Accession=PF00931.13; Description=NB-ARC domain
  Pfam module annotation: Pfam domain module=NACHT::NB-ARC; Domain location=87-241::48-299
MGFTCLLIELVKFKYGCKGFTLTSSELFLFVRNRDSYEYEFIGSIVEEISRKFSRASLHVADYPVGLESEVTEVMKLLDVGSHDVVHIIGIHGMGGLGKTTLALAVHNFIALHFDESCFLQNVREESNKHGLKHLQSILLSKLLGEKDITLTSWQEGASMIQHRLQRKKVLLILDDVDKRQQLKAIVGRPDWFGPGSRVIITTRDKHLLKYHEVERTYEVKVLNQSAALQLLTWNAFKREKIDPSYEDVLNRVVTYASGLPLALEVIGSNLFEKTVAEWESAMEHYKRIPSDEIQEILK

SEQ ID NO: 181373 - protein, 63 aa, Glycine max
  Coding DNA Sequence Number=SeqID_89688
  Subcellular localization annotation: CTP_CleavageSite=40; ConfidenceScore=5.20e-01
MRGKLMVTRTIRQPGANEPVDAQRLTSSSAPFVVLSREVRGQTNPVERKETNIVFFTFRRPNP

SEQ ID NO: 181374 - protein, 111 aa, Glycine max
  Coding DNA Sequence Number=SeqID_89689
  Homolog annotation: Hit_ID=A7NUI1; Match level="QueryCoverage=89%, HitCoverage=24%, E-value=1e-08, Identity=36%"; Hit description =Chromosome chr18 scaffold_1, whole genome shotgun sequence
MSHFIIEREEFSCPPWFPVGAKMLIHRILDPNPKTASSAYIFWPNGSPLNIISRSDFQHRLLTDVESTDIESNIVNISFLKLISKDFDVLMMPKGHALLKFNSRGSYASQV

SEQ ID NO: 181375 - protein, 121 aa, Glycine max
  Coding DNA Sequence Number=SeqID_89690
MLVLESSKPADSVLEFLGSMLLSFYKKHSPLKELTSERKKSHGEGVVTHDAAERERERACDGVLRGRDSSSVVCDEIEGEHVKFYESITEATETIFQQRGGACHLVASSLNNPTSKMCWTG

SEQ ID NO: 181376 - protein, 58 aa, Glycine max
  Coding DNA Sequence Number=SeqID_89691
MLEWIIVGKKFGDIGESDASKEFGWLMGVGNEGVVVGHGRQGWGTTSLIEEIGNGWIV

SEQ ID NO: 181377 - protein, 70 aa, Glycine max
  Coding DNA Sequence Number=SeqID_89692
  Homolog annotation: Hit_ID=Q53JN4; Match level="QueryCoverage=80%, HitCoverage=9%, E-value=7e-09, Identity=51%"; Hit description =Transposase family tnp2, putative
MGDRLEDIIYDLGQESFQQAHARYTKNLHRLEASIVERYIPEEAIEFCSEYIERAKPVGLPESRHEERVR

SEQ ID NO: 181378 - protein, 109 aa, Glycine max
  Coding DNA Sequence Number=SeqID_89693
  Subcellular localization annotation: CTP_CleavageSite=23; ConfidenceScore=5.12e-01
MGGKCAELPPTFIRGKRRKNRKRCSLRTLSVKGSGVAFPHGEGVGPFKRSFDSFERRETLRYWTINDLLVFESKEMLRRWTINDLLGWSTKVRLLLLCILNCDEEIRPT

SEQ ID NO: 181379 - protein, 76 aa, Glycine max; identical to SEQ ID NO: 151804
  Coding DNA Sequence Number=SeqID_89694

SEQ ID NO: 181380 - protein, 69 aa, Glycine max
  Coding DNA Sequence Number=SeqID_89695
MADDIVYNYKKSSTSPALQLDDRTLQNMVLLEIEQLLQANQRLLRVYPSMPYQEDVNCPTNLENSLILA

SEQ ID NO: 181381 - protein, 371 aa, Glycine max
  Coding DNA Sequence Number=SeqID_89696
  Homolog annotation: Hit_ID=A5B5G7; Match level="QueryCoverage=57%, HitCoverage=14%, E-value=1e-09, Identity=23%"; Hit description =Putative uncharacterized protein
MASKKRKAPSTPSQVRYDRSRFTSQEAWERYTDIIVPKKLLPERNVVVYYTKFDEFKEELERRHWGEELTDFAYSSIDVAIVKEFYANLYDSEDKSPKHVRVRGHLIKFDEDTLNTFLKTPVILEEGENLCTYSRFALLRPDPQELAAKLCILGRGFELNIDGQPLKILRKNMTTLAQTWSVLSFSNLIPTSHTSDVTLDKAKLIYGIIMKMDMNVGLGFPALITALRKARGVQSDSRSLESLIPAINLAYIKKNCWNLDDPTMTFRGPRKAMGKRSEVPTTSAAPEIATPFSSTAPALSISTPAQTPGIPTPSTQIPLPSPLSFGPSYFLFTPQMLHSMLQSLHRGQTIIMQSLQGLGLPSIMSMDEFDT

SEQ ID NO: 181382 - protein, 108 aa, Glycine max
  Coding DNA Sequence Number=SeqID_89697
MAQEEETSTDQMPEPSPASVPEETQPSAPVMEPEQPIQDSSAALTLDLNEDQSQDEHDAFLGGSLLMVELILDVAVKVLNGIVLIVDEVQKRGGGGERLCISENGKEV

SEQ ID NO: 181383 - protein, 370 aa, Glycine max
  Coding DNA Sequence Number=SeqID_89698
MPTVAWPAITSGSSKGCTKVSFSFFSSVCAWDEGIGEALAWRPRLRHQPAHPSRSILDRTGGGHDASAPAGSSATLRVFQENVLDRRDQTALRVHARSVFAIADNSPTLRPAIRPRRRRPGSMRFHGWTWTSADHLRRNLQQRRAAAGPPPMAGDYSGKAARRRFSGAFATHRTAAAARGYTRWHHGRKPPLRRPLVARPAGLALGRPARDLRGVVDFRHAAAAGIRAGGVRLSETVAGHVLARHPGGDRRQHHWRGHQLCHGPGRGEGGRALERAPPARAGRTTHARPLARARPRLDPPHGTAGAAAVLAAGGGRSAVRRGRMAAAAVLALRGLYGHRQIPALSGHDGQPAVAVSRAGLALTSRLIGDI

SEQ ID NO: 181384 - protein, 49 aa, Glycine max
  Coding DNA Sequence Number=SeqID_89699
KEKYYNARGISLISDVISKFPTEKERVLGEQERKNEIGRQRRLRSQSEN

SEQ ID NO: 181385 - protein, 63 aa, Glycine max
  Coding DNA Sequence Number=SeqID_89700
  Homolog annotation: Hit_ID=A0PAV3; Match level="QueryCoverage=60%, HitCoverage=17%, E-value=5e-07, Identity=76%"; Hit description =Restriction endonuclease
MVKVGTSYVPINVSFSPKVGPGLPGINRDTRIYLFCEVIFRHRCSKWLLFLSSCPSCSATDGV

SEQ ID NO: 181386 - protein, 106 aa, Glycine max
  Coding DNA Sequence Number=SeqID_89701
  Homolog annotation: Hit_ID=A6FJQ2; Match level="QueryCoverage=35%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLAPSNSQGNFPQSHDHISTLTLNPHEAPLIHYKGFKLVIKEPTIQSPKWFGSPIHIRTLHD

SEQ ID NO: 181387 - protein, 239 aa, Glycine max
  Coding DNA Sequence Number=SeqID_89702
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A6YA17; Match level="QueryCoverage=66%, HitCoverage=31%, E-value=7e-49, Identity=65%"; Hit description=NADH -plastoquinone oxidoreductase subunit 2
  Pfam annotation: Domain name=Oxidored_q1; Domain location=3-188; Score=59.0; E_value=1.6e-14; Accession=PF00361.11; Description=NADH -Ubiquinoneplastoquinone (complex I)
MVLFLILNVFDLGSVEKEVRNPLFDSDSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLIFLSFNRTPYECCFYLLLFKNNQVINDWTKPRNNSSRAKLSKAHQAYRYRRPRGGA

SEQ ID NO: 181388 - protein, 142 aa, Glycine max
  Coding DNA Sequence Number=SeqID_89703
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGSGQ

SEQ ID NO: 181389 - protein, 304 aa, Glycine max
  Coding DNA Sequence Number=SeqID_89704
  Gene Ontology: Mol. function=nucleic acid binding; Biological process= regulation of transcription, DNA-dependent
  Homolog annotation: Hit_ID=A4W6G3; Match level="QueryCoverage=100%, HitCoverage=31%, E-value=1e-156, Identity=91%"; Hit description=SNF2- related protein
  Pfam annotation: Domain name=Helicase_C; Domain location=227-302; Score=55.3; E_value=2.1e-13; Accession=PF00271.22; Description =Helicase conserved C-terminal domain
MAIEQLAERVPGVLLLTATPEQLGLESHFARLRLLDPNRFHDFEQFVEEQNNYRPVADAVALLLAGKRLSNDELNTLSDLIGEQDIEPLLQAANSESDNAESARKELIDMLMDRHGTSRVLFRNTRNGVKGFPKRELHTIKLPLPTQYQTAIKVSGIMGARKTQEERARDMLYPEQIYQEFEGDTGTWWNFDPRVEWLMGYLTAHRSQKVLVICAKAATALQLEQVLREREGIRAAVFHEGMSIVERDRAAAWFSEEDSGAQVLLCSEIGSEGRNFQFASNLVMFDLPFNPDLLEQRIGRLDRI

SEQ ID NO: 181390 - protein, 72 aa, Glycine max
  Coding DNA Sequence Number=SeqID_89705
MTKLGLCVPTDTTVSEWQRGADNRKVSPRIIMTKLGLCVPTDTTVSEWQRGADNRKNDQTWSLLVIGPAASG

SEQ ID NO: 181391 - protein, 21 aa, Glycine max
  Coding DNA Sequence Number=SeqID_89706
VEGVTQENREQLNKINSSNLE

SEQ ID NO: 181392 - protein, 123 aa, Glycine max
  Coding DNA Sequence Number=SeqID_89707
MMCEDKKPNPDQASSADSSCWTKLNHDRIKTNILQLGYRTPIPRENTINYPRPIKFEESDQFPLLNDPKDTCIYMIKILPHAQPKSVALSRWLAKSVDWLSEKVHGNIGSGDESVVMLSLRLA

SEQ ID NO: 181393 - protein, 180 aa, Glycine max
  Coding DNA Sequence Number=SeqID_89708
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
VSYEKAPRFPEGRKPDRYPVSGRVGTGERTRELPGGNACLWKNASNAAFLRFLAFCWPFAHMFFPALSPDSVDNRITAFEKRKSAQYANRLSPRVGRFINAAGTTADNNFTQETAMTMITNSSSVSKGMQAWHWPSFYNVVTGKTLALPNLIALQHIPLSPAGVIAKRPAPIALPNSCAA

SEQ ID NO: 181394 - protein, 176 aa, Glycine max
  Coding DNA Sequence Number=SeqID_89709
MTLLFSNILPGDHNANLPLQMYRLGSRPQDSQWARRSPIGPWGFQLWLRASVSPTGCPFPQRGHAIVISIQMESHLQRHPVDPEKSNRALGFPALVTGLCSPIGCPFPPARSCHHRVHATSSKGIKPPTNRAFIKKYCAPRQAQGETPQQPGDGQQRATDARPSPLEFTSAHPQKG

SEQ ID NO: 181395 - protein, 119 aa, Glycine max
  Coding DNA Sequence Number=SeqID_89710
  Gene Ontology: Mol. function=voltage-gated potassium channel activity; Cellular component=integral to membrane; Biological process=potassium ion transport
  Homolog annotation: Hit_ID=A7QWI7; Match level="QueryCoverage=89%, HitCoverage=15%, E-value=5e-53, Identity=88%"; Hit description =Chromosome chr10 scaffold_204, whole genome shotgun sequence
  Pfam annotation: Domain name=Ion_trans_2; Domain location=1-98; Score= 51.3; E_value=3.3e-12; Accession=PF07885.7; Description=Ion channel
VTLFAVHCAGCFNYLIADRYPDAKSTWIGSVYPNFKEMSLWDRYVTAMYWSIVTLTTTGYGDLHAENTREMLFDIFYMLFNLGLTSYIIGNMTNLVVHWTSRTRNFVCALKLVLLLLLN

SEQ ID NO: 181396 - protein, 251 aa, Glycine max
  Coding DNA Sequence Number=SeqID_89711
IGEIQRLTEKNSYPWILRANPTEYVHRWAETTNQAITRCFCWGKIKLKTPEEATELIENMSASDQAILRDRTHQPTKKSLLELTSHDALLAQNKLLSKQLEILTETLVKLPTKLSIGQPTHSSVLQVTGYTQGGFSGFQQGPYNQQGQWRTHPGNQFNKDQGGSSNRPIQQGPNIFQRTTKLEETFIQFMQIVDKSSNNFGANTENNPKEECKAVMTRSKRFVEAEDEENVVDKEQLSEKTGAEVKKNDVK

SEQ ID NO: 181397 - protein, 94 aa, Glycine max
  Coding DNA Sequence Number=SeqID_89712
MKIVISIPLINYDFAGGEHHQDSCYFYSINNFDWRQEPAMYNYYEKGRAPDLESVLADFMTYQASSKGDCYSMQQQGIQFKRDYSFVHYQWESE

SEQ ID NO: 181398 - protein, 112 aa, Glycine max
  Coding DNA Sequence Number=SeqID_89713
MLSGSNKRLPSKSPTTAHLLPRTKVQDHHRHQSHGTKIAKGYPIWSPHPQCKYTTYIIKIKIISSQHHHQHHKQSHSTYILINSCPGFTFPRPSGNINLIQQQSIIPQYSYF

SEQ ID NO: 181399 - protein, 444 aa, Glycine max
  Coding DNA Sequence Number=SeqID_89714
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=41%, E-value=0.0, Identity=100%"; Hit description=DNA -directed RNA polymerase subunit beta
  Pfam annotation: Domain name=RNA_pol_Rpb2_1; Domain location=14-372; Score=218.3; E_value=1.8e-62; Accession=PF04563.6; Description=RNA polymerase beta subunit
  Pfam annotation: Domain name=RNA_pol_Rpb2_2; Domain location=128-315; Score=261.6; E_value=1.7e-75; Accession=PF04561.5; Description=RNA polymerase Rpb2, domain 2
  Pfam annotation: Domain name=RNA_pol_Rpb2_3; Domain location=376-444; Score=126.9; E_value=5.7e-35; Accession=PF04565.7; Description=RNA polymerase Rpb2, domain 3
  Pfam module annotation: Pfam domain module=RNA_pol_Rpb2_1::RNA_pol _Rpb2_2::RNA_pol_Rpb2_3; Domain location=14-372::128-315::376-444
MLGDGNEGMSTLPGLNQIQFEGFCRFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWARVSRKQKISILVLSSAMGSNLSEILENVCYPEIFVSFLNDKDKKKIGSKENAILEFYRQFACVGGDPVFSESLCKELQKKFFQQRCELGRIGRRNMNQKLNLDIPQNNTFLLPRDILTAADHLIGMKFGMGILDDINHLKNKRIRSVADLLQDQFGLALVRLENMVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARI

SEQ ID NO: 181400 - protein, 285 aa, Glycine max
  Coding DNA Sequence Number=SeqID_89715
  Homolog annotation: Hit_ID=A5BSR3; Match level="QueryCoverage=28%, HitCoverage=25%, E-value=2e-11, Identity=48%"; Hit description =Putative uncharacterized protein
QKLLAEKTKKKLEEASQPGSVDGIIDPSSPVKRHVKWKMAPQKKTGEMTTEAAKEIAEKIDSFEEQATRGSFVPYGRQDVLAAAIGCPEHPGRVRAAGASVTIKQYFGSAPRTSRNASSLPPDELQQLTQQIRDQQEESIIEKVTRQVSVEEVIDADAPVPVPTDEVSLVGQALHTFLAWPTHLVKSLSQQVAVSPAKPPPKPDPEVDDPLYLMALTIPELFLRSYQVRWDGTVFGVVNPDFPLYIKHEDLSEIAHGGQCLSISVLQLWILHLTETCMRVRNSDI

SEQ ID NO: 181401 - protein, 162 aa, Glycine max
  Coding DNA Sequence Number=SeqID_89716
  Homolog annotation: Hit_ID=Q6WAY4; Match level="QueryCoverage=91%, HitCoverage=26%, E-value=3e-17, Identity=33%"; Hit description =Putative uncharacterized protein
MIEVSVEAIASLTQYYVQSLRCFAFGDFQLAPTIEEFEGILGCPLEGRKPYLFFGFYPSLARIAKVVKISEQELDRVKQTRNEVAGIPRKRLEEKVEALASQGEWTTFIDILALLVFGTVLFPNVDGLVDLAVIDAFLAYHHNKESPVIAVLADAYDTFDFR

SEQ ID NO: 181402 - protein, 220 aa, Glycine max
  Coding DNA Sequence Number=SeqID_89717
MKSWQQILQDVASRFDMANYDNPISELSKLHQEEKSVCIHNPRSLQDAMQLARLQDEGKLSAIFAAQGEASEESKEEEEQENIIALGKELLATDAVQISLNALKGIASGQTLQLKGIINNTELPFLMDIGSTHNFWLKTLGEITWNYKSLTMEFEHAGKTVKLVGEQQCRQHQGASIAMNCIFPEAMLLSISILETQQETSHQETMLTEQQQQDLTEILL

SEQ ID NO: 181403 - protein, 249 aa, Glycine max
  Coding DNA Sequence Number=SeqID_89718
MATLAQTWSVLSYSNFVPTSHTSDITFDRAKLIYGIIMKMDMNLGYLISHQISIIAQQDSSRLVFPALITTLCKARGVTLDSRSLESLSSAINLAYIKKNYWNLEDPTMTFRGPRKARGKRSEAPPTSAAIDSLHKWQVIIMQSLQSSGLPSIMSTDEYLTQVAWLGVQPSPSRGGGTSAAQEPKQATEEPVLAEDELIPLEPSSVVADTSMAQEEVSLPDPMPEPSLAPISEDTMPLVPAMEPEQPIL

SEQ ID NO: 181404 - protein, 55 aa, Glycine max
  Coding DNA Sequence Number=SeqID_89719
MPISPCKSISWDRTQETPSGPGKVQQGPGVSSSGYGPLSVLQGARTLPPSSHHHR

SEQ ID NO: 181405 - protein, 121 aa, Glycine max
  Coding DNA Sequence Number=SeqID_89720
  Homolog annotation: Hit_ID=Q9KHC4; Match level="QueryCoverage=35%, HitCoverage=8%, E-value=1e-07, Identity=67%"; Hit description=SocE
RQARQGASTGVAGCRGWLNYAASEQIVLRVHHMRAIGAGLFAITPAGERGMCCKAIKLGNARVFPVTTLMSRETCRASCINESANARGEAVCVLGALPLPRSLTRCARSFGCGERYQLTQR

SEQ ID NO: 181406 - protein, 298 aa, Glycine max
  Coding DNA Sequence Number=SeqID_89721
RGIHLHVLTLERTTRPRLERTTRPRLERTTCPHHQRVARPHLQRTTRPRLERTTCPHHQRVARPHLQRTTRPRLERATRPRLGGLHILAFRGLHVLTLRGLNVLALRGLHVLTIRGLHALTSRGLHVLALRGLHVLTIRGLHALTSRGLHVLALRGLLALALGLHALTFRGPHVLTFRGLHVLANRGLHALTFRGLHVLANRGLHALTLRGLHALTSRGLYILALRGLHALTFRGLRVLIFRTSSFLLTVPGPPPDIGGRPTVRAQPEREAITQLLCIPGQDSPVPLQRDECGSCAPT

SEQ ID NO: 181407 - protein, 28 aa, Glycine max
  Coding DNA Sequence Number=SeqID_89722
MVVRGRWRSVEALHPSGQLFGFVWYTFE

SEQ ID NO: 181408 - protein, 32 aa, Glycine max
  Coding DNA Sequence Number=SeqID_89723
MLNDMNDSGMEKEEKEEMPLQGEDESRKSSPP

SEQ ID NO: 181409 - protein, 53 aa, Glycine max
  Coding DNA Sequence Number=SeqID_89724
MPPKATAPPSTAFRSRNIDLSLTICREHPLSRFSTFEADDLIAFEKLLWRLDL

SEQ ID NO: 181410 - protein, 298 aa, Glycine max
  Coding DNA Sequence Number=SeqID_89725
  Pfam annotation: Domain name=zf-CCHC; Domain location=46-63; Score =20.6; E_value=0.0012; Accession=PF00098.14; Description=Zinc knuckle
MKEGIGHILDLTPIGEKMKESLKRKSTSKSYGSHSYPKNDQGQGILGCFKCLGRGHITSQCPTKKTMIMRGQDIYSSQDEATTSPSSSKSEEAKEEESSEEIYPQEEGQPLMVKEECKETLVSIATSLRLEFIPQVKELLDEGLVRKRLNPCALLVPKIGIIRHQIPKIGGVMNALGGATLFCKITCAPNIFMICVHRDSLGVPMNPKRIKVIPEWPAPPTPLIELVRNHVPSWEDAQEMSFQTLPYFNILNTTNTYVFVLFTGVEEKSPEFQEPRDLRSNPFQGGGNDAILPRKGIG

SEQ ID NO: 181411 - protein, 70 aa, Glycine max
  Coding DNA Sequence Number=SeqID_89726
  Subcellular localization annotation: CTP_CleavageSite=36; ConfidenceScore=5.27e-01
MRGVVATYPSAGGLAGLAGASSVGGKCTESPPTFIRGKRRKNQKGCFPRSYVSSIAMRKSDLRSSLQDIF

SEQ ID NO: 181412 - protein, 161 aa, Glycine max
  Coding DNA Sequence Number=SeqID_89727
MIESAEDDVNLRVSTDNHLCISARHLTSRVTITKGGAVNKSEAFAPTYPQFVMRNSDLRSYFFCARLKNSLYREMLTFSERVQMTTLASACQSNLGSLNDEVRITGRCLCMLPDSWVMIAKGGVVDKSEALAPTYPPFVMRNSDLHSSFKSETKIVLMFLH

SEQ ID NO: 181413 - protein, 253 aa, Glycine max
  Coding DNA Sequence Number=SeqID_89728
  Gene Ontology: Mol. function=RNA-directed DNA polymerase activity; Biological process=regulation of transcription, DNA-dependent
  Homolog annotation: Hit_ID=A5AL87; Match level="QueryCoverage=77%, HitCoverage=4%, E-value=2e-33, Identity=39%"; Hit description =Putative uncharacterized protein
MEPKYWDKNPFKATAKKFSAPFDPAGYNYWDYIDAWTNVFWHQNSKFKHSWLIYFKNNTVYNFPNWFLQWWNYFGPIPQIFPEEVQQGFQQFNKLFNSKESRIPADLKYFSSFALSWIFSWQYKYGKTENCKQYPPLQRHAFVKWWSQFDTSKAAPDQVKNWFQSNPEFLKPADPETSLFLNQKSQLAAFLASSKSKESLAQNLKEVLQLLQQEEDEEPPKKEAESSENNDDQDDDPFYQNEDDCFGISLDDD

SEQ ID NO: 181414 - protein, 239 aa, Glycine max
  Coding DNA Sequence Number=SeqID_89729
MGEAEKVQEKMKADMEAIKEKMATMMEAMMSVKKIMEANAVAIAATSVVAKAKIWEVRAAPIMYKFKTSTPSRHMACLSTIRHPKWRTLPIRMSITPLLYPLRANNPKLIMHMSLKPWGGTHEIPHHNLADFEPCLGYPTEGQAVGGIPFENTLEGPQFRPQPQPLHFAVGRAPPAMAEKGKADHLEERLRAIEGGEDYSFANLEELFLVPNIITPPKFKVLDFDKYKGTTCPQEPSKD

SEQ ID NO: 181415 - protein, 106 aa, Glycine max
  Coding DNA Sequence Number=SeqID_89730
MTETVCTDNRLGISIRHLTSWVSMTETVCTDNRLGISEHHLTSRVRMIESTEDDVNLCMSTGADNRKVSPHATGLLGHDSKRWGGQQNRGSCSYASSIRDEELRPT

SEQ ID NO: 181416 - protein, 79 aa, Glycine max
  Coding DNA Sequence Number=SeqID_89731
GTVLSLSRPPGCARNSPPPIGDQPGSPKVFPTSASHDHTQHPTYERGQKASAKDPESMQQGQADILIARFPDPNYGVKT

SEQ ID NO: 181417 - protein, 261 aa, Glycine max
  Coding DNA Sequence Number=SeqID_89732
MGEIDEVQERMKADMEAMKEQMATMMEAMTSLKKIIEVNAAGVAATSAIVEVNPTPPSGLNQINYPVSDKVGQRGKELRSTGDPHFVQVQNKHAFLPYGLPPNYTPPNVGHTPDENVNNSTPTPIESQQPQADHAHVSQPMGKTYEIPHHNLADFEARLGYALEGQVVGGVPLPNTLEGPQFRPQPQPLHVAAGRIPPAMAENGKFDHIEERLKAVEGGRDYAFTDMAELCLVPDIVILPKFKVSDFDKYKGTTGPKNHLK

SEQ ID NO: 181418 - protein, 32 aa, Glycine max
  Coding DNA Sequence Number=SeqID_89733
MFAFKSALKGLDDTPQPKSKAGARWIIVKTNL

SEQ ID NO: 181419 - protein, 135 aa, Glycine max
  Coding DNA Sequence Number=SeqID_89734
MDICEDNDIPIILGRLFLLTASCIVDMRRKKLELGFEDKKIDFDLFVEDKPTPEQNVCLQVMEVGKEILELRTKIPFAKRKPRAKRIFCHALSGESLALSAQPLYLKLIWSAKLAKAKLSPFLFDLNLAKRWPSC

SEQ ID NO: 181420 - protein, 197 aa, Glycine max
  Coding DNA Sequence Number=SeqID_89735
MPTTRLTEDARKVVQGLFAAHPPFMCGWSRTSFAMKVDPSIPFKVIACAPRKGRQFGNISWLVWWGHPLIGSPNGRKEELGFCPCAWSTVQRKDKELRGSNNGIIVGYHKWLKARTQELDWLLKLKASSEEEAKTPEENEEVQALKAELEKAQAVKERFKMTAIKVRKECDELRDVNVATTEALELETKRARKEEWG

SEQ ID NO: 181421 - protein, 72 aa, Glycine max
  Coding DNA Sequence Number=SeqID_89736
VFSCLPVDSAAVRKVDLYREFPGSTLMFNSPKHFVAYYALPRLWVPSSRVGDKRTRTADIRHRVNHRLSGPD

SEQ ID NO: 181422 - protein, 128 aa, Glycine max
  Coding DNA Sequence Number=SeqID_89737
SEETIKKIKVKVRGVNSLPRELRIIVNFDDQGQTIGEAQALLAGFLGTLAADCKLFPMDYDRWSGPSGVPKAYFDYCFETILKPRFYFKINEAGAKQYCKLSMGRKWVEIGKAYGMNSTIQPKQEMKS

SEQ ID NO: 181423 - protein, 359 aa, Glycine max
  Coding DNA Sequence Number=SeqID_89738
  Gene Ontology: Mol. function=transporter activity; Cellular component= integral to membrane; Biological process=transport
  Homolog annotation: Hit_ID=A6TD74; Match level="QueryCoverage=63%, HitCoverage=98%, E-value=7e-87, Identity=72%"; Hit description =Putative ABC-type metal ion transport system, permease component
  Pfam annotation: Domain name=BPD_transp_1; Domain location=150-353; Score=25.1; E_value=0.00026; Accession=PF00528.13; Description =Binding-protein-dependent transport s
MDAVRQAADAVAEIRDGEIVQYGTVSALLAQPDSALGQRLLPLTAQVSDAGLVLQLSYRTDVAVASDWISRISQQFALKVDLLGRTVAGGHSFSAGAGAAGTVADAAGTVWPGGQRCCQRAAVTGGGMSVSVISQDTPWPEIPALMLPALGETALMVGIVMLFVVSLGGVVGVVLFNTSPRGLFPQRGVHRVLSWIVNMGRSLPFLVLMAAIIPFTFWLTGTTIGIPAAVVPMIAAGIPFFGRLVDNALRELPGEVTAVGLVCGGSRWQIIRSAQLSEALPAIVAAITLNLISMIEYSAIAGTIGAGGIGYLAVVYGYQRFDNHIMIATIVVLIALIQTIQFFGDRLVAALRHPQGTSL

SEQ ID NO: 181424 - protein, 73 aa, Glycine max
  Coding DNA Sequence Number=SeqID_89739
MTRVRGPKLLMLRQPLRKDDDLLVVTLASFCVRPQVSESRKQRGVANLDRVVCLTLIGFYCFNFVSTPEGSSR

SEQ ID NO: 181425 - protein, 238 aa, Glycine max
  Coding DNA Sequence Number=SeqID_89740
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q1H1X1; Match level="QueryCoverage=97%, HitCoverage=70%, E-value=5e-91, Identity=71%"; Hit description =Acetyl-coenzyme A carboxylase carboxyl transferase subunit alpha
  Pfam annotation: Domain name=ACCA; Domain location=1-64; Score=30.4; E_value=5.2e-12; Accession=PF03255.5; Description=Acetyl co-enzyme A carboxylase carboxyltransferase alpha subunit
ELHGDRAYSDDPASVGGIARFKGIPVMVMGHQKGRDIKERQYRNFGMPRPEGYRKALRLFRLAEKFHMPIITFIDTPGAYPGIGAEERGQSEAIARNLYVMAELKTPIIGVVIGEGGSGGALALGVVDHLNMLQYSTYSVISPEGCASILWKSASKAPDAAETLGITADRLKSLGLVDTIVSEPLGGAHRNYEEVMERIGQAIGQQLKTLQAKKLPQLLESRYQRLMSYGKFKASSEK

SEQ ID NO: 181426 - protein, 136 aa, Glycine max
  Coding DNA Sequence Number=SeqID_89741
MAPPSDLVLLCLSLHLHGGKSPLKDLIEAQISSLHRSPTRKLPPILEEDTHFSDSSSPDSPSSRESVTYLLEVISMADEHQQRVTLEDYSSSSIQQFFTSIARPEVYQMKPLDSVYFHFPWQEKPKGGSTHLRVTV

SEQ ID NO: 181427 - protein, 181 aa, Glycine max
  Coding DNA Sequence Number=SeqID_89742
  Homolog annotation: Hit_ID=A7PBS1; Match level="QueryCoverage=57%, HitCoverage=71%, E-value=1e-07, Identity=32%"; Hit description =Chromosome chr16 scaffold_10, whole genome shotgun sequence
MYLNLLRDLNNTKKCSWGSACLANLYRELCRASSESWAWYHMPFIALRVPRPETTFSLAKRWSGGRLEYRATPHGDLVGYKSHKDHMESHEENTTLFLYVAQQLHDPRTTITHNVAGSGVEQTHFEIPHPQSKYSTPSAVHQTFGHTGESVTATTQEWMTDLFGVDFNTPNSLASYLATLQ

SEQ ID NO: 181428 - protein, 165 aa, Glycine max
  Coding DNA Sequence Number=SeqID_89743
MRKWALAADQDDVEDTVCEKYGISKEKWAQFCQTRRDPSWEDVRKKSQAIQKQNTAPQVLSRGGYDYLEQKLLAEKTKKKLEEAAQSGSVDGVIDPPSPDSFEDQATQGSLVPHGRQDVLAAAIRRPEHPGRVRAAGAGVTIKKYFGSAPRTSHGSSSLPPEELQ

SEQ ID NO: 181429 - protein, 58 aa, Glycine max
  Coding DNA Sequence Number=SeqID_89744
MESPTFATYPSARGRCGAHRCVFQERKMREVATNVYLRKTSEKPEKGVSLAPTYPQLR

SEQ ID NO: 181430 - protein, 188 aa, Glycine max
  Coding DNA Sequence Number=SeqID_89745
  Homolog annotation: Hit_ID=Q1H0T4; Match level="QueryCoverage=94%, HitCoverage=32%, E-value=7e-27, Identity=44%"; Hit description =Membrane protein-like protein
MNPSRANHQYQRGAIGLVGVMLLLSAVLLTALVLDSGRLWMQKKQLQSIADLAAISASRHLGCSADLSNVTQMAQLAAANNGFDGQLSESPNLVLLGRLQTVQGIRQFTADGSHGAVFVRATREVPSSLAAGGLFGGTIILRAEAVSASDPPLAAFSAGSFTASLSSEQSTLLNGLLSGMLGAPLNLD

SEQ ID NO: 181431 - protein, 207 aa, Glycine max
  Coding DNA Sequence Number=SeqID_89746
MLESFKQDQMSVLELYIEKDVAGGSMFHSANSLTSCGNYLSNDETQPATNMSNLHIDEDDDDDDDDDDYLVSNSYIEESLDEDDSVDGISDTDDEVTNIPQPVRIVHPAKGAQRIENPFWNNALHYNNINWSYPDEEDICGLEMPSTFNVGQELYVGMEFDSKDAVKNAVKQYVMKVHQSFKVVESKTNKYVVCCLNKNAECPAHSI

SEQ ID NO: 181432 - protein, 324 aa, Glycine max
  Coding DNA Sequence Number=SeqID_89747
  Gene Ontology: Mol. function=ATP binding; Cellular component =intracellular; Biological process=transport
  Homolog annotation: Hit_ID=Q1H0S9; Match level="QueryCoverage=30%, HitCoverage=23%, E-value=3e-31, Identity=65%"; Hit description=Type II secretion system protein E
MDVLQAMNTGHDGCMSTVHANSPEDAMLRFEMLAGLAKFQGTESTLRKMIAAAIELVVQIARTTNGQRKVVSITEIVGIRDGHFVLNELYAYDTNTGYFSHPGEVAMSVLAVSFIVGAIALLLLAIWMLKHSKEARFRERMMHNFREVLPYGTTVSGMAPGTPPPFWHVLKIRASIYAGFELRKKHAVVIPLAFISVGLLGWLTYGLLGAALTFFITVFVFGFLLPYNRLRRRQAQIIAQIPLFIDQVLRSLSTGRSLESAIRFGAGEAPPPLRYVLDRVIRAADLGADMVESLAEAAKLHDLRELNLIALSMRISNNYGSSPA

SEQ ID NO: 181433 - protein, 956 aa, Glycine max
  Coding DNA Sequence Number=SeqID_89748
  Gene Ontology: Mol. function=transmembrane receptor activity; Cellular component=intrinsic to membrane; Biological process=innate immune response
  Homolog annotation: Hit_ID=A2Q1X9; Match level="QueryCoverage=86%, HitCoverage=76%, E-value=0.0, Identity=42%"; Hit description=TIR
  Pfam annotation: Domain name=LRR_1; Domain location=610-631; Score =2.6; E_value=1e+02; Accession=PF00560.24; Description=Leucine Rich Repeat
  Pfam annotation: Domain name=LRR_1; Domain location=633-654; Score =0.6; E_value=2.4e+02; Accession=PF00560.24; Description=Leucine Rich Repeat
  Pfam annotation: Domain name=LRR_1; Domain location=656-678; Score =3.5; E_value=70; Accession=PF00560.24; Description=Leucine Rich Repeat
  Pfam annotation: Domain name=LRR_1; Domain location=698-720; Score =4.8; E_value=39; Accession=PF00560.24; Description=Leucine Rich Repeat
  Pfam annotation: Domain name=LRR_1; Domain location=721-743; Score =6.1; E_value=23; Accession=PF00560.24; Description=Leucine Rich Repeat
  Pfam annotation: Domain name=LRR_1; Domain location=745-769; Score =6.8; E_value=17; Accession=PF00560.24; Description=Leucine Rich Repeat
  Pfam annotation: Domain name=LRR_3; Domain location=610-629; Score =37.0; E_value=7e-08; Accession=PF07725.3; Description=Leucine Rich Repeat
  Pfam annotation: Domain name=NB-ARC; Domain location=209-457; Score =50.9; E_value=1.6e-13; Accession=PF00931.13; Description=NB-ARC domain
  Pfam annotation: Domain name=TIR; Domain location=53-180; Score =174.9; E_value=2.2e-49; Accession=PF01582.11; Description=TIR domain
  Pfam module annotation: Pfam domain module=LRR_1::LRR_1::LRR_1::LRR _1::LRR_1::LRR_1::LRR_3::NB-ARC::TIR; Domain location=610-631::633 -654::656-678::698-720::721-743::745-769::610-629::209-457::53-180
MARKQNNENALTITCCHLLVQQLEFVLAEQQMISAVASSSSSSSMLSPKKYDVFLSFRGEDTRRNFTSHLYEALKQKKVETYIDEHLEKGDEISPALIKAIEDSHVSIVVFSKNYASSKWCLVELIKILDCKKDRGQIVIPVFYEIDPSDVRKQTGSYEQAFAKHEGEPSCNKWKTALTEAANLAGWDSRTYRTDPELLKDIVADVLQKLPPRYQNQRKGLVGIEEHCKHIESLLKIGPTEVRTLGIWGMGGIGSSFLSNVNEKSDKLENHCFGNSDMSTLRGKKALIVLDDVATSEHLEKLKVDYDFLEPGSRVIVTTRNREILGPNDEIYQVKELSSHHSVQLFCLTVFGEKQPKEGYEDLSERVLSYCKGIPLALKVMGASLRRKSKEAWESELRKLQKISSMEIHTVLKLSYDGLDHSQKDIFLDIACFFKGRERDWVTRVLDAFDFFAASGIEVLLDKALITISEGNHIEMHDLIQEMGWEIVRQECIKDPGRQSRLWRQEEVQNILKYNRASGKCNFFYLIKGTDVVEGIILSLRKLTEALRLSFDFLAKMTNLRFLQFYDGWDDYGSKVPVPTGFESLPDKLRYLHWEGFCLESLPLNFCAEQLVELYMPFSKLKKLWDGVQNLVNLKIIGLQGSKDLIEVPDLSKAEKLEIVNLSFCVSLLQLHVYSKSLQGLNAKNCSSLKEFSVTSEEITELNLADTAICELPPSIWQKKKLAFLVLNGCKNLKFFGNEIVHLLSSKRLDLSQTNIERLSALPPSLKYLMAEGCTSLETNFTQHLVLHHMIQSRIPYLHKHPSNPGYYNNHECFFFPGDRITKACGFCTGDSSITIPYLPKSDLHGFIYCIIFSEGIYGKRSSVLSCSINQDGIQITWGIKECGVFPVYARASGFKVVGSNSKETFECESITQISNNESQPRPRAIRVEAGVRGSNNENEEDRSNFLQQKSMRTSP

SEQ ID NO: 181434 - protein, 94 aa, Glycine max
  Coding DNA Sequence Number=SeqID_89749
  Gene Ontology: Mol. function=acyltransferase activity; Cellular component=plastoglobule; Biological process=metabolic process
  Homolog annotation: Hit_ID=A5B7J6; Match level="QueryCoverage=97%, HitCoverage=21%, E-value=1e-28, Identity=62%"; Hit description =Putative uncharacterized protein
MSDAGGEVANQLVHMPLILPKVPGRFYYYFGKPLETEGRKQELGDDRPKSKLYLQVKSEVERCIAYLKVKRGIGPRLLYQATHGFESEVPTFEI

SEQ ID NO: 181435 - protein, 150 aa, Glycine max
  Coding DNA Sequence Number=SeqID_89750
MKLAQEIQKTLKELTFVDGPNPELALDGRNQGGTLEGGAGEGFEGMGYLGDIRDDDEVSQWRAVTVAAKGNRVTKTKLRQRRREILNRHGKKTCTHGYPPESVPTLTGNIRVDRVWVRVRVFPDNQKSGTGTGMGLLDSSRPRTRTRPAT

SEQ ID NO: 181436 - protein, 178 aa, Glycine max
  Coding DNA Sequence Number=SeqID_89751
  Gene Ontology: Mol. function=nucleotide binding; Cellular component =Golgi apparatus
  Homolog annotation: Hit_ID=A7PAF3; Match level="QueryCoverage=85%, HitCoverage=30%, E-value=1e-66, Identity=77%"; Hit description =Chromosome chr14 scaffold_9, whole genome shotgun sequence
  Pfam annotation: Domain name=DUF246; Domain location=11-178; Score =17.7; E_value=1.2e-15; Accession=PF03138.5; Description=Plant protein family
MSCNARDELRFVFTIFENAGRAVSISDFKDIFDVDHFITSLRDEVRIIKILPPKVKKRVELGLLYSMPPISWSNISYYENQVLPLLLKHKVIQLNRTDARLANNGLPGEIQKLRCRVNFNALRFTTQIEELGRMIVKVLREKRPFLALHLRYEMDMLAFSGCAHDCYSKEEEELTRMR

SEQ ID NO: 181437 - protein, 138 aa, Glycine max
  Coding DNA Sequence Number=SeqID_89752
  Gene Ontology: Mol. function=transcription factor binding; Cellular component=intracellular; Biological process=regulation of transcription, DNA-dependent
  Homolog annotation: Hit_ID=A2XTV2; Match level="QueryCoverage=80%, HitCoverage=20%, E-value=1e-15, Identity=43%"; Hit description =Putative uncharacterized protein
  Pfam annotation: Domain name=Ras; Domain location=11-116; Score= -71.3; E_value=0.00054; Accession=PF00071.13; Description=Ras family
MGWVAIDYLNKLLLIGDSSVGKSCLLLRFVEIRTVDMEGKTVKLQIVSILRKSEIPSMSHLRLSMNESSKPSFKWRRVLLKVSGEALAGNHSQNIDPKWDGAGQERFRTITSSYYRGGDAKDTSRSSKKNSIEEEIET

SEQ ID NO: 181438 - protein, 217 aa, Glycine max
  Coding DNA Sequence Number=SeqID_89753
  Homolog annotation: Hit_ID=Q2QP36; Match level="QueryCoverage=58%, HitCoverage=14%, E-value=4e-15, Identity=37%"; Hit description =Retrotransposon protein, putative, Ty1-copia subclass
MEYKDLAMILLAFLPPSYENFVGSLSVGKDSIIIEEVKSNIYSRELQLKKKSSVNILIGDDVPCKFVGIGFVQIKMHDDVFRTLSEVRLTLELQKNLVIWVPKIRKAISITCYLVNPSTSTVIDFKNLIEVSKSLEPRKDSLWAIDGVKGFQVWFPFERKVILSRDVVFEKLFMLHYKPDEDLGKVKDVTKQVEFESFKIRNVSDQKQFEAPDETGR

SEQ ID NO: 181439 - protein, 291 aa, Glycine max
  Coding DNA Sequence Number=SeqID_89754
MTRQLGSYIITLVIDYNETSPNGRIIKEAQGLIILHHHHHSPSGDLPTPPNPYLSSPRFLTLFSTDVQHGGVIFSKVNKIPVFVDQSLFYSLTKLSSQGVPFEGTLVDDWKPIYSSLDARKMICGSNVDISGRLLVGSFIFECRIMHYILYRVLLPHSTNLAQATEEDLILMWALQTGRQIDWAHLVRNCMHKALRANAPLPYPHLVTLFLKHFKVPFTNEPSIKDYQANALDERTPSPPPRDPSSALLNDVLNEIRDLHAFVGDRFDSMDSCITLLEDEMEFIRRCLIPN

SEQ ID NO: 181440 - protein, 100 aa, Glycine max
  Coding DNA Sequence Number=SeqID_89755
MVIRTFRQPGANELVDGKRLTLSSAPFVIQGQRVRWLAEIPYGRLHLSSTKANEFDGFYSCRPETFEPATHEILLYWAGTIKFDRVWKRRGYPILSLSRH

SEQ ID NO: 181441 - protein, 236 aa, Glycine max
  Coding DNA Sequence Number=SeqID_89756
MNGKQACEWTSLRTHDKEITINIQERMLREGKTMDFNTMFKKCLDMAKISIKFASWEPINIVFKVKINDRIHDICVVEEDSVPVFYGEVEARKSVSSSSSKMSKWPKKGWSEWQEFFDEENCVFNVKNNEESRIEIQKDLDENKGWGKRRLRMDKMISFAKEGVWVWALEPYEVEGFCVAKTSNDESEAFLEALGRDWYWGDGVVMESRRSKFKGSFKNPMNGEGEENDIQALETS

SEQ ID NO: 181442 - protein, 65 aa, Glycine max
  Coding DNA Sequence Number=SeqID_89757
MVEKTKKKLEEAAQSGSTEAVIDPPSPIRRHVKWKMDRTKKIGQMTSEATKEITEKIDSLEEQAS

SEQ ID NO: 181443 - protein, 76 aa, Glycine max
  Coding DNA Sequence Number=SeqID_89758
MDLLQGNSVANFWHERKMLKLAKRRNDELQFRVKRGEEVPTDGLLARDGILVLAEPEATKSKHDPKRNPFIIPYQR

SEQ ID NO: 181444 - protein, 243 aa, Glycine max
  Coding DNA Sequence Number=SeqID_89759
  Homolog annotation: Hit_ID=A7PQZ9; Match level="QueryCoverage=68%, HitCoverage=84%, E-value=3e-56, Identity=63%"; Hit description =Chromosome chr6 scaffold_25, whole genome shotgun sequence
MGNAAVTPCFHPKNSSSSSSSKLIFWDGTMRCLKGKHIAGEIMYEFPDKVVCHADSFFIGHPIPALALEDELIQGEAYFVLPIDSFTCKTLSISSLLSLGSDPSKSTIKFGECPFEYLKGSNGRVLIKVMPEFITRLINRSKRPCCPSSNDNNNFLCSTPELRKHYQMLVKSKDQVWSPKLETISENKQGLDQALEDERPASVNEIEWTKIQRREVSTIRLALALEITQHVEGDNTESLVGEA

SEQ ID NO: 181445 - protein, 119 aa, Glycine max
  Coding DNA Sequence Number=SeqID_89760
MEALTEALDTFDGGTSERGHKETLRGCELVRQSETLRKGASIQAKTLDLQRLFSKTVFQLESSTTILQRIVFYFRLQSHFFKNHRCNFTNTYKNTTKLVTSMVMVNIGFLQKSMLTSKR

SEQ ID NO: 181446 - protein, 285 aa, Glycine max
  Coding DNA Sequence Number=SeqID_89761
  Homolog annotation: Hit_ID=A5BSR3; Match level="QueryCoverage=22%, HitCoverage=20%, E-value=3e-09, Identity=50%"; Hit description =Putative uncharacterized protein
MARTKKTGQMTSEAIKEIAKKIDSLEEQASQDSFVPHGRQDVLTAAIGRPEHPGRVRAIGVGVTIKQYFGLAPQTQMQSQFQSQMQSQGLALPPEPEVGPSVARASTKESCVDPLGNDPYTGDLDKCGLYIEENPPRLVALERVYEGSTAVHNILLLHDQVKVKVGVEEVKDADAPVPVPTDEFNLVGQTLNTFLAWPTHLIKRLSEHGVVGLAKPADRSDHEVDDPQYLMTLIIPELFLKSLQVMWDATVFGVFNQDFPLYIKHEDLSEITHGGQCLSISVIQL

SEQ ID NO: 181447 - protein, 77 aa, Glycine max
  Coding DNA Sequence Number=SeqID_89762
MVLKFHDDPTVNESEIVVFLRQVRWPTGKRKGFGRREKKRNFYENWDVTLYGTSRGYIYLGLTENKRGYISCGSVLV

SEQ ID NO: 181448 - protein, 290 aa, Glycine max
  Coding DNA Sequence Number=SeqID_89763
  Gene Ontology: Mol. function=sucrose transmembrane transporter activity; Cellular component=integral to plasma membrane; Biological process=sucrose transport
  Homolog annotation: Hit_ID=Q7X9X8; Match level="QueryCoverage=97%, HitCoverage=39%, E-value=8e-85, Identity=57%"; Hit description =Sucrose transporter
MTTGKSDLVSIRVPYKNLHDDSSAPELELVDVHHRGNHRNSPPPNHSPSPPNSNNAPLLHLVLSCTVAAGVQFGWALQLSLLTPYIQVPLPLPLRLNNFDFFDITVSSLTRSFCNRNRILYVFIFNFPINCVLSYCVLVQTLGIGHAFSSFIWLCGPITGLVVQPCVGIWSDKCTSRFGRRRPFILAGSLMICLAVILIGFSADIGYVLGDTHEHCRTFKGTRTRAALVFILGFWMLDLANNTVQGPARALLADLSGPDQRNVANAVFCSWMAVGNILGYSSGASGKWNK

SEQ ID NO: 181449 - protein, 105 aa, Glycine max
  Coding DNA Sequence Number=SeqID_89764
MWWRESQIVSSFLSSSVNLVSTTGTKKACVEYVVIVTCLRKHDQNLNDEMCFKKASSGGIMVVNEELSMKDLSLVGTMTRARFRKLQEELNKKMNSLWRRKSKEG

SEQ ID NO: 181450 - protein, 127 aa, Glycine max
  Coding DNA Sequence Number=SeqID_89765
  Homolog annotation: Hit_ID=A5AWR0; Match level="QueryCoverage=56%, HitCoverage=8%, E-value=5e-07, Identity=39%"; Hit description =Putative uncharacterized protein
MEVWNTHLSPAMGKCTITLEDVTLHLGIRVDGRAVTRPSFLHWDELCGELLGEVPPDNASWYRMPFIAPRVQRLEKTYPLAIRWSGGKLEHRGTPHGDLVSFLGSYIEDLKNTYKDMHIETGTFGLH

SEQ ID NO: 181451 - protein, 36 aa, Glycine max
  Coding DNA Sequence Number=SeqID_89766
MVVEMVVVVVDTMVVETIVVVMEMVVVHTSEIVIVV

SEQ ID NO: 181452 - protein, 78 aa, Glycine max
  Coding DNA Sequence Number=SeqID_89767
MAKMPFSIVRDLLVDARGTFLPRVSTEEELRKNHLSWNYAEELLLPNILCRNNEQGVRKRQGGRQKRFCWQAQGRLRR

SEQ ID NO: 181453 - protein, 112 aa, Glycine max
  Coding DNA Sequence Number=SeqID_89768
MVGEGTKNTPTVDLSSADSSERWQIWLFRESPRKNHLPREANGTSLTHTEEASSAETIFRPTSNGTQTRAEETNLPQKKARLQPRATKTMKKQTRPNMSSTLWPSKAIKGEK

SEQ ID NO: 181454 - protein, 217 aa, Glycine max
  Coding DNA Sequence Number=SeqID_89769
MARQHAWGIASLTGDLGVTWTGCSHYHWQNSQWYMMDLVITILYFNGRVYEETDGVIFEGSKKAIQIKRGISFNALKKIGDKAEPPRNVSNLHGDEDYDDDDDDYLVSNSYLEESLDEDDSVDGISNTDDEVTDMIQPVRIVHPVEGVEQIQNPFWNDVLHYNNINWSHPDQEDICGLEMPSSFNVGQQLYVGMDFDSKDAVHVSLSYYATFALFVI

SEQ ID NO: 181455 - protein, 31 aa, Glycine max
  Coding DNA Sequence Number=SeqID_89770
WWSESDDGEGVPWWSYWSAGVSNTIVSSYEN

SEQ ID NO: 181456 - protein, 82 aa, Glycine max
  Coding DNA Sequence Number=SeqID_89771
MGGNKRNRRREKWIKGLAHERRLSDKVGSHRPWTIMDSKLEVWNMFVVNCKWKSHKYRWQDVQFWFGICMKNVSKGKEKITK

SEQ ID NO: 181457 - protein, 232 aa, Glycine max
  Coding DNA Sequence Number=SeqID_89772
  Gene Ontology: Mol. function=sequence-specific DNA binding; Cellular component=nucleus; Biological process=regulation of transcription, DNA-dependent
  Homolog annotation: Hit_ID=A7QEH5; Match level="QueryCoverage=83%, HitCoverage=68%, E-value=3e-59, Identity=62%"; Hit description =Chromosome chr1 scaffold_84, whole genome shotgun sequence
  Pfam annotation: Domain name=HALZ; Domain location=83-127; Score =74.8; E_value=2.8e-19; Accession=PF02183.9; Description=Homeobox associated leucine zipper
MVLCFIFVLDLTFLANDIPSALYFTGVGYTHHSLPLLRDRNFGSCNKVYANTYSIRVAESLALRWCVEVILRFQNRKARWKTKQLEKDYDLLKRQYDAIKADNDALQAQNQKLQTEILALKSREPTESINLNKETDGSSSNRSENSSEINLDISRTPAIDSSLSTQQSNNKTFFPSSARPTGVAQLFQTTSRPEIQCQKIDHMVNEESLSNMFCGIDDQSGLWPWLEQQHFN

SEQ ID NO: 181458 - protein, 54 aa, Glycine max
  Coding DNA Sequence Number=SeqID_89773
MDCYKTKAIQVYYQMLPGVPPNTSERRNEASNVAYVHGNNVKVQESEPGRNIGP

SEQ ID NO: 181459 - protein, 92 aa, Glycine max
  Coding DNA Sequence Number=SeqID_89774
MKTKARSRIIDNIVSETEQETPYQDDELVGLQEVLEVDPDVINESLADVDGGGEEIDVDLLKQVNLVEPDKDECILSDNDIKSDFDDTYTAL

SEQ ID NO: 181460 - protein, 94 aa, Glycine max
  Coding DNA Sequence Number=SeqID_89775
MENHDHQSQDMRQQMQEQNEQMQCILQHLHIQPIMSAPSPSTTIADGIDHHVNDAQVDCPHDILIMALTCWISLEMEGDLFKNFMRPWRMKGIA

SEQ ID NO: 181461 - protein, 810 aa, Glycine max
  Coding DNA Sequence Number=SeqID_89776
  Gene Ontology: Mol. function=oxidoreductase activity, acting on the CH-OH group of donors, NAD or NADP as acceptor; Cellular component =cytoplasm; Biological process=malate metabolic process
  Homolog annotation: Hit_ID=A7QRU5; Match level="QueryCoverage=15%, HitCoverage=27%, E-value=5e-37, Identity=62%"; Hit description =Chromosome chr13 scaffold_152, whole genome shotgun sequence
  Subcellular localization annotation: CTP_CleavageSite=47; ConfidenceScore=5.37e-01
MGTPLRSHPSRSNGQSKATSRRSRQSTRLRRLTLRALDQPRPIVNIDSATGRGSHPHKDKFHNYLRVVAREKIPIVHSNWKDVLESLKDLIWDEILGIRKRAQKTQGTFVPNGRGDILSIAIGRLEHGGCVCVAVSQYYGKASRGSSSSSTSISQQQLADTIRSLKEEWRNEIVGNLEEEIRNEIDEENKRCLERMKQELKEAIKIEFSQRGSQYTPLVEADIQVLGARVSTKGSNAEIAVKPSGKEDGVHVIPSMGLYVQDDAVRVNVEIFFDSDAQVPFPTSEIQYVSQKKLAEAIAPDDPLRGLIKSLYDIYEKPVELLWDGTKFGIPNVDASLFLTYADVNDIIAGLWMSGVQAWVMTQCMDFLSLSPYTMQRIDVLNVNITLKHGLRNPKERVMFKAEAMSVAKHWMWNIVTGGLKNDWTMWFGDGTPLDIETMTTIRKKWTAYFIKLKNIQCHCQAEDLDSSNDSPIRINQLKYEFDFTTLVFNKNSSWAVILRQLFENKYTQKTKIIPPKHFSDFVQQKQLQERLTSLCSLNTHQTIGAFIDLNKGLAFSTKERYAQYLHGLLPTTINTQQLQEKKLMNNISLYQVPLQKYVAMVDLQVFVAEMNWSSFLGYCNGMNKKQSNWLLYKGGLGVKGDNSWESWWDLEQTTRGLPPGLVPISEPYFDGELPEVELIVVDTSKFDDATTPEPEHTNKEDKSELYKPKVSTWGVIRRPGNISKTFGGGRVICPGEVLESKEEKVVKEARTKQLLAAYNNKTGLNVDPKLKSECEELSIFSDIQILQPFFPSFIHAFPFYAHCWVFFVS

SEQ ID NO: 181462 - protein, 176 aa, Glycine max
  Coding DNA Sequence Number=SeqID_89777
  Gene Ontology: Mol. function=helicase activity; Biological process =viral genome replication
  Homolog annotation: Hit_ID=Q2R1R7; Match level="QueryCoverage=100%, HitCoverage=11%, E-value=8e-38, Identity=47%"; Hit description=AT hook motif-containing protein, putative
MRTYNMMFVFTSAGIKFDKSINHSRGLPTIRIQGQPCHRIGSMLPMPGKEPKFAQVYIFDTENEVQNRINAISPHNQIQGHIVSQLSEMLDEYDVHAKTFKMARDRLQDGQVDNIKLKLITNREKDGRTYNVPTVPEVTTLIVGDFDANSKRDIIIETQHGQLQKIHELHSSYLAL

SEQ ID NO: 181463 - protein, 132 aa, Glycine max
  Coding DNA Sequence Number=SeqID_89778
  Subcellular localization annotation: CTP_CleavageSite=5; ConfidenceScore=5.04e-01
TRKARARESEGPSSAAPQTSTTPAPTPSALVAWPGVQPSSHGGGEASTAQEPQPDPETRPVAQKDDLEATPLESFVPETDPEADPMIAEASPQASPISKPVLELSTPHGSPVGTPVLHLTDDEAMDQDTPQD

SEQ ID NO: 181464 - protein, 23 aa, Glycine max
  Coding DNA Sequence Number=SeqID_89779
MATTAALSAVGVRSRFGHPDFRA

SEQ ID NO: 181465 - protein, 68 aa, Glycine max
  Coding DNA Sequence Number=SeqID_89780
  Gene Ontology: Mol. function=phosphoprotein phosphatase activity
  Homolog annotation: Hit_ID=Q9LNG5; Match level="QueryCoverage=76%, HitCoverage=3%, E-value=3e-09, Identity=63%"; Hit description =Serine/threonine protein phosphatase 7 long form homolog
  Pfam annotation: Domain name=DUF1723; Domain location=34-68; Score =47.7; E_value=4.1e-11; Accession=PF08330.1; Description=Protein of unknown function (DUF1723)
MYAQIGSDLIACLLCLLSQFDLTQLRKVLGDMCRIDPALITALVERWRPETHTFHLPWGECTITLDDV

SEQ ID NO: 181466 - protein, 48 aa, Glycine max
  Coding DNA Sequence Number=SeqID_89781
MKRSKTCLRPLMTSSSLQEEERLVMEMSESALLTTACGKNKAAKSQAN

SEQ ID NO: 181467 - protein, 72 aa, Glycine max
  Coding DNA Sequence Number=SeqID_89782
MHGHAGKPPLPLASSLRLAHVELATSVGDSGDAFLNRQFDWRFCFAGGAVSHRHVDGQSFSEKGELQLLLAI

SEQ ID NO: 181468 - protein, 494 aa, Glycine max
  Coding DNA Sequence Number=SeqID_89783
  Gene Ontology: Mol. function=sequence-specific DNA binding; Cellular component=nucleus; Biological process=regulation of transcription, DNA-dependent
  Homolog annotation: Hit_ID=A7Q2T1; Match level="QueryCoverage=82%, HitCoverage=72%, E-value=2e-79, Identity=43%"; Hit description =Chromosome chr1 scaffold_46, whole genome shotgun sequence
  Pfam annotation: Domain name=WRKY; Domain location=140-200; Score =143.3; E_value=7e-40; Accession=PF03106.6; Description=WRKY DNA -binding domain
MGEVGEGNDNLKLSLAKLVKDSTSDEESELVSLSLGISSTGQHEMKKKKNRNEKMRENEDLKDILALGLDIRFDSSAIKNLSTESSCDGERKDEELSETWPPSKVVKTIMRTRDKSEVSQHAELKKARVCIRARCDTLTMNDGCQWRKYGQKMAKGNPCPRAYYRCTVSPSCPVRKQVQRCAEDMSILITTYEGTHNHPLPTSATTIAYTTSAAASMLQSPSLSSQLGPANSDTVPLINSSVAYNLNALNFTSSSYDQQFSKSSQHLYFHNSSISTSNSHPTITLDLTSPQTSPHVGKFTPGLSFIPKHSSTNLHFSSSTFSPLQSSMLQSPWSPYGDCFNYEGLITQNSNQNGFLTKTGKQPFQGHLYQPNYISNRVISQQPLPDSVVAATKAITATPKFQSAIAAALTAYVGNGVRENHVGAESAGLDLNLGGDMPYTTKKADYTSNASRYKRMSSSAPTAPKRNLVISQPLQASKSSFGSSSLKSNQFIDQ

SEQ ID NO: 181469 - protein, 377 aa, Glycine max
  Coding DNA Sequence Number=SeqID_89784
  Homolog annotation: Hit_ID=A5B5G7; Match level="QueryCoverage=51%, HitCoverage=13%, E-value=6e-10, Identity=26%"; Hit description =Putative uncharacterized protein
  Subcellular localization annotation: CTP_CleavageSite=57; ConfidenceScore=5.32e-01
MKWVARSYALSTRPRAKRSGKPRDTPLGALNGQMASCKRRAVPTPGEASNWDSSRVTSEIAWHRYQDNIQLRNILPERNVELGPGMFDEFLQELQRRRWDQVLTRLPEKRIDVALVKEFYSNLYDPEDHSPKFCRVQGQVVRFNAETINDFLDTPVVLTDGEDYPAYSQYLHTPPDHDAILSALCTPGGRFVLNVDGAPWKLLWKDLTTLAQTWSVLSYFNLAPTSHTSDINVDRARLIYALITTLCEIQGVVSDTLIFESLSPVINLAFIKKNYWNPADPSITFPGTRRTRTRASSSAFEPPLPSQPPSQPSSQRPRPPPASTSAPLDMHGDQPSTNKGEEPSGAAATEDPAVDEDLMADLAGADWGPWADLGGGS

SEQ ID NO: 181470 - protein, 66 aa, Glycine max
  Coding DNA Sequence Number=SeqID_89785
VLKLLPLKECNHLFASPAREKEKRLRRITSSGTPTILTVLHISMYEAKCAYGSSLGRPWKRFPWIN

SEQ ID NO: 181471 - protein, 75 aa, Glycine max
  Coding DNA Sequence Number=SeqID_89786
MVNESKIVIFLRQVWWAAGKRKGFERRRRKTKMRERKGTVSVKNDLTLFIARRRQLAQLGSATGVYKTLMKYLAD

SEQ ID NO: 181472 - protein, 125 aa, Glycine max
  Coding DNA Sequence Number=SeqID_89787
MANQIMVRTRGLGRALGQVTGRGVGRGDRDDSDDAPQRRRPTAFARRQRVVVTAAHDEPVIPVQDVQDDPMEAPAAVEDIVADIHADTGAEATEDEHEGFLGGPSDPSVLTLYADHVACSVWTGE

SEQ ID NO: 181473 - protein, 222 aa, Glycine max
  Coding DNA Sequence Number=SeqID_89788
  Gene Ontology: Mol. function=sugar:hydrogen symporter activity; Cellular component=integral to membrane; Biological process =carbohydrate transport
  Homolog annotation: Hit_ID=A7PUU0; Match level="QueryCoverage=59%, HitCoverage=27%, E-value=3e-57, Identity=84%"; Hit description =Chromosome chr4 scaffold_32, whole genome shotgun sequence
MPNFNFEPCCALETPLVHTVGEAPRAVKQLLTVSVIVSSCRDLLREELLLSSSSISLKPVWLHVLGRGTAQISCVSYCPHHLLDTIFVDCGYSSPTQWAIVHDLNLFISEFSFFGSLSNVGAMVGAIASGQIAECIGREGSLMIAAIPNIIGWLAISFAKDSSFLYMGRLLEGFGVGIISYVVLVYIAEIAPQNLRGGLGSVNQLSITIGIMLAYLLGLFVN

SEQ ID NO: 181474 - protein, 113 aa, Glycine max
  Coding DNA Sequence Number=SeqID_89789
  Gene Ontology: Mol. function=aspartic-type endopeptidase activity; Biological process=proteolysis
  Homolog annotation: Hit_ID=A5B3J2; Match level="QueryCoverage=88%, HitCoverage=22%, E-value=6e-11, Identity=40%"; Hit description =Putative uncharacterized protein
MAEDRPQRVTLEDYSSSVTPQYFTSIARPEVQATNITYSHSLIQLIQGNLFHGLPNVDPYAHLATYIEICNTVKIARVPKDVIHLNLFSFSLAGELKRWLHSFKGNSLRTCEV

SEQ ID NO: 181475 - protein, 564 aa, Glycine max
  Coding DNA Sequence Number=SeqID_89790
  Homolog annotation: Hit_ID=A7Q2R7; Match level="QueryCoverage=43%, HitCoverage=27%, E-value=2e-62, Identity=55%"; Hit description =Chromosome chr1 scaffold_46, whole genome shotgun sequence
  Subcellular localization annotation: CTP_CleavageSite=51; ConfidenceScore=5.40e-01
MSKNLKAQDESSQFSKVQSPNSAKSSLSSKSPDRTKIASIDDQYAIMVSCRCNYTASRLFFKQATSWQPRSSRDIIISVASEMSGESPGPYERNSQLPVQVLTLQASNLTSEDLTLTVLAPASFTSPPSVVSLSSPTSPMSPFIGFKEFLGRINVERHVGAIQGGSFTSLIKDNEKQNDDVRPESVSMNDDVIASSGLSCTHLWLQSRVPLGCIPSQSTATIKLELLPLTDGIITLDSLQIDVMEKVVIKMQNAHYVIAQVLMDLHYGLNRVKAMNHLSIHGIRQLQFSVFQLIISGSLCAGRKSGGSSKGRDSGKFVNFQCQFCLKYDHTRNVCHFRSDMSFQSHGTLTFFDPATLQPIPYSSGSVRTSSTWVNPKYKFGTAALASTHPNAMLTNSTSHGNGHANSTWIPDSGASFHGTNKVFLHGVVSANGLYSFHNLTLQDHSSLLLSTSASPVSSTTYNCLSSVDIAANKIPNVVSNLVISSPSNVKLYLFFKPLSPWLNYNLILKIKVMQAPLELVGLGSSSSMDSFASWKIKGSGMEKEEREETPLQGEDESRRSSPP

SEQ ID NO: 181476 - protein, 195 aa, Glycine max
  Coding DNA Sequence Number=SeqID_89791
  Homolog annotation: Hit_ID=A2Q6B4; Match level="QueryCoverage=71%, HitCoverage=59%, E-value=1e-12, Identity=28%"; Hit description =Ribosomal protein L33; Nucleic acid-binding, OB-fold
MDLKENCTYVMHNFKVLKNNGQYRVCDHQFKLVFIEVTVVRQCALDDLPFRKYRFAEFGDVVARQFELGLLVDVIGVVDEVVFRHVSGKGRRVVFKLKDLSQQLLSCTLWDDYCLQFLKFLDDHEGHGPITVLLTHGRIKEAQGLQSWALRPGQCLNPMVKAVHSFQVLSNYHQRNHSLERLRQRLLLRLTPSLK

SEQ ID NO: 181477 - protein, 281 aa, Glycine max
  Coding DNA Sequence Number=SeqID_89792
  Homolog annotation: Hit_ID=A7PQZ5; Match level="QueryCoverage=16%, HitCoverage=6%, E-value=5e-08, Identity=48%"; Hit description =Chromosome chr6 scaffold_25, whole genome shotgun sequence
MVEVSNFDAREEFEASERVNSGFSKGLGGLLGEWKGSGTRTVMSRTDTMTTSDLNRTGPVERDIEQDESILIWFSGKEEKRLKLTNVSRIISGQRTEISICFSPPPPPISAALAIRMTTPVTAGGGGCDPLLNGGHALPIQPSSANTNFNHIITKKLDAVNYLFWDRLLQFIQNVQILAMSATIADRDAGCVTEAYHAWEQHDQLLPSLLQSVVSASMLCKQLRTDLRQISLKNTDIIIDEIETVLLAHESRKKNVASINIASISTAPLNFNSDSIQANLV

SEQ ID NO: 181478 - protein, 58 aa, Glycine max
  Coding DNA Sequence Number=SeqID_89793
MNEGNAEQKAEIEHDINTEQEASEEEKHRRTKREIVKPRNKTISIFPYLLLEVLGLES

SEQ ID NO: 181479 - protein, 114 aa, Glycine max
  Coding DNA Sequence Number=SeqID_89794
MGVAALSAAVKVKVPASSFAVVGGGKRGTQMVMDKDEWMYEIMSERADMDYENAESCGANEPHVDCSDAFKTSQVFECRDDVLRWARSVAHENGFVAVILRSDTNTGRRGRTTF

SEQ ID NO: 181480 - protein, 77 aa, Glycine max
  Coding DNA Sequence Number=SeqID_89795
MEKLKVSYEGLKGNEKGIFLDITCFFRGYDLKDVRTWEEKLLGSDENPEIGQIQAKGPSGEGRRPKWRRIKPPSGEG

SEQ ID NO: 181481 - protein, 76 aa, Glycine max
  Coding DNA Sequence Number=SeqID_89796
MAAKWRRKRERRRHFKEKMSLEEAHHHKRPWIRAWRKKEMNEGRGREEHEILCSKRALKSEPTNRRSIPRFSTKCA

SEQ ID NO: 181482 - protein, 153 aa, Glycine max
  Coding DNA Sequence Number=SeqID_89797
MKIFDLELEEITYIRTHINIFLCDMFDQGQLQTDFDESKWSNIPLILDTIDPQESGLPNEELDSFIEDEDDVLCNQPQEDDEEEDELVSPIKTAPPYYIPPHMHNFKDSEYGHSLDYEEVEHSGILLVVVAQDDNNKIIPIAFVVVKSETTEE

SEQ ID NO: 181483 - protein, 107 aa, Glycine max
  Coding DNA Sequence Number=SeqID_89798
MQFVDHLLPAGQLCLMPGQRDAPVADPKDYIQPPSPQVPVAFDPPPHVDDYEGYEAIAQRLERVLNLRIVTADIELYDIMQDCLTIARGGPSADGTVRAHQRRRTDH

SEQ ID NO: 181484 - protein, 46 aa, Glycine max
  Coding DNA Sequence Number=SeqID_89799
MEAKNKVKIEDSTTESPTSVLEDEILEWLRTQNWWDFGKMDFFMGS

SEQ ID NO: 181485 - protein, 128 aa, Glycine max
  Coding DNA Sequence Number=SeqID_89800
  Subcellular localization annotation: CTP_CleavageSite=38; ConfidenceScore=5.13e-01
MQNLVLESVKSATKISYRQLPPVTVKKLSAWHRGMNLSVQMLPTWLPTWVSQLTLRREGETRLEAHPGELLLQPEVTLLAQASSVCSSELVTSPLNYLGAQASLSQGSKGQKTLIVSARQKTLIVFEM

SEQ ID NO: 181486 - protein, 256 aa, Glycine max
  Coding DNA Sequence Number=SeqID_89801
  Homolog annotation: Hit_ID=Q6WAY6; Match level="QueryCoverage=82%, HitCoverage=40%, E-value=3e-21, Identity=30%"; Hit description =Putative uncharacterized protein
MARVAKVVKISAQDQEEWASFIDILALLVFGTVLFPNVDGLVNLAAIDAFLAYHHNKESLIIVVLADIYDTLDLRCEKSNAKIVCCMPALYVWLVSHVFCHEGASVSWFPRWKEGGVKMLCSYERFPNVPLMGTRGCINYNPMLSIRQLGYPMRGAPSEETIAPFIARGFNEGNAKILQKIRKAWNTVEQKDKELRGSNNGVVGGYHKWLKAKTQEITWLPKLKGPSGEEAEVPEESEEVQALKVELEKQEWLKKD

SEQ ID NO: 181487 - protein, 195 aa, Glycine max
  Coding DNA Sequence Number=SeqID_89802
MGTKENQLAYDIVDQLAYGYCIYGYCIIRSSLERTPQPQSSVMYVAVTGLWSKNLSLVLPYLSNLIPELVCGSCGSSKELVCCHCRGLFGVLTLHSVWGDHSCSQGVLFSEESLSHLICWSVCFVFVAFFTSKRPRRFMGFMYGVVGVVCPVEPGAASNLVSNSYEICCCSSLNVVALLRPAKETKDVSTLQQDK

SEQ ID NO: 181488 - protein, 229 aa, Glycine max
  Coding DNA Sequence Number=SeqID_89803
  Gene Ontology: Mol. function=protein dimerization activity; Cellular component=nucleus; Biological process=regulation of transcription, DNA-dependent
  Homolog annotation: Hit_ID=Q9FGV1; Match level="QueryCoverage=45%, HitCoverage=12%, E-value=1e-51, Identity=93%"; Hit description=Auxin response factor 8
MEEENVGKCLCNGLKQIEGEKQKKVKLDYMKLSTSGLGQQGHEGEEKKCLNSELWHACTGPLVSLPTSGTRVVYFPQGHSEQVAATTNREIDGHIPNYPSLPPQLICQLHNVTMHADVETDEVYAQMTLQPLTLDIYDVDVFMKRMEEVVRVLKDLPSHLRVAARTHDLVDSMVERLRTLSRKSDGQFIVMDLRVEMLDKKGCQGRDSEKEESCFNAQEVAVFFEEDWF

SEQ ID NO: 181489 - protein, 290 aa, Glycine max
  Coding DNA Sequence Number=SeqID_89804
  Gene Ontology: Mol. function=nucleic acid binding
  Homolog annotation: Hit_ID=Q1SKZ9; Match level="QueryCoverage=69%, HitCoverage=70%, E-value=3e-18, Identity=38%"; Hit description=Zinc finger, CCHC-type
  Pfam annotation: Domain name=zf-CCHC; Domain location=113-130; Score =7.9; E_value=0.097; Accession=PF00098.14; Description=Zinc knuckle
MYGVEGVTWPTNLSPTAMKQPPPMRERVDLIKKKLVRFEHEGRNRLLPKIFLDELVFKDLCNPWKDAIKVKLLGKNLGYNLMKEKLKKLWKLKWGFDIIDVHNGFYIYKGLYIICVGCGYYGHLERNCVKCTAQHESPNKNRPSPSSTKDPPMTSPSKTNVKGQEDVKVINVGDNVHGDWLVLPRRKKPRNKGVNEKVYDHINPFKVMGSIHARSKDIQRKNITIIEGKGSIPMKSQRNPNPIVVVQKRRRYCHNNMSRASKLPPTKVEAKSSPPKSPNSQLRNGKGMQC

SEQ ID NO: 181490 - protein, 283 aa, Glycine max
  Coding DNA Sequence Number=SeqID_89805
  Gene Ontology: Mol. function=nucleoside-triphosphatase activity
  Homolog annotation: Hit_ID=A7Q0A4; Match level="QueryCoverage=20%, HitCoverage=4%, E-value=3e-12, Identity=63%"; Hit description =Chromosome chr7 scaffold_42, whole genome shotgun sequence
MAPGAKFCLLLKIIGLQKLGLGLINQFQMAMILEAFVRMIVGSFVLMTLKQLGHLFPNKVTIQLPQDEALLSDWKQQLERDIETMKVQSNIVSVCTIDRASMLDEAIEYLKQLQLQVQNPIHLRVITHHNALIKVSFGRQNLELDDDDLGVLHAGGYLSGVVDFLVKNETFHELGVVELLHNLDIAEINHVGLGGIHDEESGVDDEGSEEHGVLDDDLAIEGSAGRLHKGVAIRELDGDGHGGENIDNLEGSFVEGVGDDGVVDVVGEEEETLLSGKYSKIVL

SEQ ID NO: 181491 - protein, 516 aa, Glycine max
  Coding DNA Sequence Number=SeqID_89806
  Gene Ontology: Mol. function=protein binding; Cellular component =cytoplasm; Biological process=red or far red light signaling pathway
  Homolog annotation: Hit_ID=A7QEE7; Match level="QueryCoverage=82%, HitCoverage=95%, E-value=1e-50, Identity=40%"; Hit description =Chromosome chr1 scaffold_84, whole genome shotgun sequence
MVTTISSSTSRNFHHQLHTFNSENNINNNLFDATFSPYLNGNNEGTIIVGKLGEPSQKLKPFKSPLQKLEKKEENGEIGVFGAEKYFNVEVETPRSVNCITTPKYLHHRDEQMAIATRKNTLPYGTPSIRSESTTCNSQHALLQSGMMMRNSSRSKKENKGHQAKSVLAGLGFKCSCSDKDSVDAGEISFSKPATYGSVHGKTRRKLVDIAALDASHSIKISKPNAELLKINNVYFQKQESTFGNSQKLLSFSPLSSASGNQNHLAKMQQHQQLDEVEAEKPRNSIEVFGSPILKNKLKSLSFDRTTTRFVMASSRDGTPRLLEEIDSNYINDAASDASSDLFEIESIKSKTNPFHARQTSDVAASSCVSPTNGYAPSEASIEWSVATASAAVMSDCEEQMSEVTIRSPIRTTTFANGKAKSTKEVQRIRRPSMLLGCKSHKSVRVAGDAYITYENPSSTPKLRNRTNSSSMVARFPSETKLGNFGAKHGHHHAYATPSPLQNSHSSPHASKLLYI

SEQ ID NO: 181492 - protein, 118 aa, Glycine max
  Coding DNA Sequence Number=SeqID_89807
MELSNSIDATIFTERGLSGAGLVIRRENGIFIAAKTMKAQGIMEPKETEAWARAEPATPAPTTITSATPEKPGGGSAAALRRREVVVRRSGGDALGRESEETGSIVEEQDHNLCLELK

SEQ ID NO: 181493 - protein, 786 aa, Glycine max
  Coding DNA Sequence Number=SeqID_89808
NLDMSGLMWRMWGPRPSTSALKGAVIAFADNSQLVDNSWELTDNVRDKHLLIDKRLEITWLLGNPTAKSPGQYISPPSFELARGQKRLSSIEERLSHVKGVCLMSEVNVACQAPEPRQVLSGWFCQVVNDGRVFGVSGKGSIVVQNFRELLQLLLVTEESVSSLNGVDVLSSSIMSSFLSDSTIGMSGRYSGGSIEQPIMNWEVILIGDSSYEDIRQGASNNESSFSERVRVSRCASGDTSRPCRRVWPSTSTRGVRRGSDYRDIRASPCVRCSQSVGSLSSIPIVVGYEWVRKDILKYKSCLTLAVSVVVLQLQVKLENLEDSCKMVLGLILPLTVIQCAVLEHLNVALSQLHPNSWAMVLAFEILCSFFNILPSVLVFLFFFRLKLNGKIGWVSLNSMSRKLFAFDSNIFHRFKDHFFKVLALDGGQPAGEVDPFAVVAKVTPSARSSVLAKRNRGDGVGPFGRKKSKASMSLRALRQAIGLMPSAGRLSTVQDVPLNPPPIKASIVAVTTSAPSPPPTIVVQEVTPTIAEVTMSATQSDSARAPSSTSAPTVLPISSSAQLYTSSDADSLWGATYKPEQKTLIGFVSTFDKSLIRSARVMNATDSAKVFLQRSLAILEENGLWYHEAMQNVVSLEAEVAKWRAITDTLWRVEHPKVGNASIAFVEVVRSNHQLSFKVGGVLANVAAERDELAKVVVDLEARLKESKSRLEESELRAAKEREANKELEDELLLYKKNVDLDLGLFDPFKDVKDGVLLDEEDIVAKEEAGNERQGSAKQGNDAYV

SEQ ID NO: 181494 - protein, 30 aa, Glycine max
  Coding DNA Sequence Number=SeqID_89809
MMCEGGYTMMQSFDLLAKCESLAKRALSDV

SEQ ID NO: 181495 - protein, 85 aa, Glycine max
  Coding DNA Sequence Number=SeqID_89810
MSDQATSIVLKALGLFSFRRLAQRACLAERERAKCEKRQHPHWAGWLRAGHADLWLILFQGFPSAKRVGCLAKQMHLAEWIYLAK

SEQ ID NO: 181496 - protein, 141 aa, Glycine max
  Coding DNA Sequence Number=SeqID_89811
MGEHFGAVKTRASATQFNYEREVREKLIYRERMRSAPFDFDKGILEVIEDGEERAEAIGGGLPAKATDEELALGDVVVRDGTHNSKDVEVAHHRILKDVEELVGSEALDELVGFEGGELENEKASIKGKLKHNIKIQHRFL

SEQ ID NO: 181497 - protein, 285 aa, Glycine max
  Coding DNA Sequence Number=SeqID_89812
  Homolog annotation: Hit_ID=A2Q1D6; Match level="QueryCoverage=31%, HitCoverage=14%, E-value=6e-13, Identity=46%"; Hit description =Ovarian tumour, otubain, related
  Subcellular localization annotation: CTP_CleavageSite=40; ConfidenceScore=5.14e-01
MVITWELLCAPSIIAGAPSEVAKLPFSNSSFGRIPTNYFRKNVIQNVSGRTFFRKFPEKASSGISIGGPVKYLKIWWSRVPYLKFCIAGGRSEMTTSGRPSSGSNLGLFRKKCFRKTDLPEVTKTHSGRSASGSVVNFWMWLYDNLNVLVYDAYVLKMDEDQWRYDFAMSQEVHMDYDYDNQEECGVNEPHVDCSNAFNTSQVFATRDDVLQWARIVAHENGFVAVIMRSDTETGSRGRSSFVFIGCERSGTYKCRNKEFVRKDTGSRKCGCPFRLRGKPVHGGE

SEQ ID NO: 181498 - protein, 229 aa, Glycine max
  Coding DNA Sequence Number=SeqID_89813
MVVVLATIVVVEVVAPMATNEVVVGLLTFSVNNPNSGQQNGDTRPANIWMNNNYKSTSTSNQSTPSAMTASGDVVPINLEIEATCRRNNAARRRREQDTEGSSYTSPPLSPHHAEMHGEPARRVTLEDFSNTATPQFFTSIARPEVQAANISYPHSLIQLIQGNLFHGLPSEDPYTHLASRDKTMVALFQRQHLKNLGRSSGKVLKEVLPRVKDRRRENGDFFFPSIPG

SEQ ID NO: 181499 - protein, 68 aa, Glycine max
  Coding DNA Sequence Number=SeqID_89814
MKCKTLESYLQVVSKIANTEPDTYTKNEVTLSKKGNRNEEKEGILKQAQPNSGAKCASGAKRATKCRR

SEQ ID NO: 181500 - protein, 46 aa, Glycine max
  Coding DNA Sequence Number=SeqID_89815
MCGFMSDVSFIATTNAASKADPFTKALGIKEFDKHKWELGMKFMNY

SEQ ID NO: 181501 - protein, 56 aa, Glycine max
  Coding DNA Sequence Number=SeqID_89816
MEEVKPSPMSLSSSTSLKLHDGTPSTDATKAIRGGALESTRDATIANREHLSDYLE

SEQ ID NO: 181502 - protein, 67 aa, Glycine max
  Coding DNA Sequence Number=SeqID_89817
MKDKHMRYATNTLDSSLHTMWYHFSVKNLVGRLGVHDRTCLAMGKSGQSGSRYFARMLQPCGIGTDL

SEQ ID NO: 181503 - protein, 150 aa, Glycine max
  Coding DNA Sequence Number=SeqID_89818
  Gene Ontology: Mol. function=microtubule motor activity; Cellular component=microtubule associated complex; Biological process =microtubule-based movement
  Homolog annotation: Hit_ID=Q0WN69; Match level="QueryCoverage=57%, HitCoverage=14%, E-value=1e-08, Identity=37%"; Hit description =Kinesin-related protein
MTKKQKTWTGVKLSPMGILTKKPKFWTAVNLSTMGISGEKIKEKVNNVDENEVVRLIKEQEDKNLEISALKVELETTKRTYEVQFSQMEEEANSFKAALTRKVREYEHQLEELRNELEEDAKDAKVELTQKAQEYENQLEALGNKFAAQG

SEQ ID NO: 181504 - protein, 297 aa, Glycine max
  Coding DNA Sequence Number=SeqID_89819
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=100%, HitCoverage=99%, E-value=1e-141, Identity=82%"; Hit description =Class III chitinase
  Pfam annotation: Domain name=Glyco_hydro_18; Domain location=26-284; Score=170.6; E_value=4.1e-48; Accession=PF00704.19; Description =Glycosyl hydrolases family 18
MELKSAISVTFLCLVLLALANGSYAGTITVYWGQNGNEGTLAEACATGNYDYVIIAFLPTFGKGQTPMINLAGHCDPHSNNGCTGLSSDIKSCQAKGIKVLLSLRGDVGSPSIDPSQAATYLWNNFLGGHSLTRPLGPAVLDGIDFDIEGGSNKHWGDLARLLKGYGMAKQSKKVYITAAPQCPFPDAWIGNALTTGLFDFVWVQFYNNPPCQYNSGAISNLEDAWKQWITSIPANKIFLGLPASPLAAGSGFIPAADLTSKVLPAIKGSSKYGGVMLWSRYYDVQSGYSSSIKSYV

SEQ ID NO: 181505 - protein, 396 aa, Glycine max
  Coding DNA Sequence Number=SeqID_89820
  Pfam annotation: Domain name=Transposase_23; Domain location=158-225; Score=-13.9; E_value=0.04; Accession=PF03017.5; Description=TNP1ENSPM transposase
MEEFVVRDNHWPHKSLYPSSPFGRIEPIYCYDQLGRDSFEEQVTQGFFVPHGRRDVLTTAIGRLEHPGHVRAAGVGVTIKQYFGSAPRMSRSSSSLPPEELQQLAQQIRNQPEESITKKVTRQLMGLALPPEPLVGPSSPRVSTKESCVDPSGNNPETDDSDRCGLYIKANPSRLVALGRVYEGSTVVHNTPLLPGQVKVGVEEVKDPDAAVPVPTNEVDDPLYLMTLTIPELFLRPYQVTWDATVFGVFNPDFPLYIKHEDLSEIAHGVGNSDIYGFLEPQSIQRSGQSQFETESYIKSWMQSSKRDVYLGAYLNGGHWQMVVIVPKEHLVVWFCSLHNRPDNYLKGIINNALKGLDDAPQPKSKAPARWIVIKTIGSREIKGVADPVDTILSPS

SEQ ID NO: 181506 - protein, 143 aa, Glycine max
  Coding DNA Sequence Number=SeqID_89821
  Homolog annotation: Hit_ID=A5AWV0; Match level="QueryCoverage=85%, HitCoverage=8%, E-value=1e-09, Identity=30%"; Hit description =Putative uncharacterized protein
MSQHISVTIVDSPLSIQRSGQSQFESESNIKSWMQSSQCDVYLGAYINGFHCSGHWQMVVILPKEHLVVWFCSLYNRPDNYLKGIINSALKGLDDAPQPKSKASARWIVVKCNRQKGSTKCGYYVMHWMSTIILGTFRNNWEA

SEQ ID NO: 181507 - protein, 63 aa, Glycine max
  Coding DNA Sequence Number=SeqID_89822
METTTPRAVKQQSAQFRISPTDPFLRLKFWRSDSCGQRDEGVHGGEVCHIDEGCIGNDNNDGG

SEQ ID NO: 181508 - protein, 188 aa, Glycine max
  Coding DNA Sequence Number=SeqID_89823
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=23%, HitCoverage=23%, E-value=4e-17, Identity=91%"; Hit description =Chromosome chr4 scaffold_32, whole genome shotgun sequence
  Pfam annotation: Domain name=APC10; Domain location=96-188; Score= -59.8; E_value=0.00045; Accession=PF03256.7; Description=Anaphase -promoting complex, subunit 10 (APC10)
MDHVPEANPMDTLNLSRCHVEQLKRVEISQLARSKTLLHSLFSFSSHLKSAGNRSVDTHIAPHSFQYCRKPLTGTHRTSYRRKVEENPILVLELWVEENPTLLLEQSWVLKAQSFLRCQLTRYELYLSLLLFLLIVLYVVFKLDESYTPSKVSIRAGDGFHNLKEIKTVELVKPTGWVYLSLSGANPR

SEQ ID NO: 181509 - protein, 146 aa, Glycine max
  Coding DNA Sequence Number=SeqID_89824
MAAKLSQRDVSDFSPTAIAMEFNVFDWPLSIALCGSEAQKQNSTVGEKAATFMIDLKRRLELSPNLLDPMLNLNCSCALSLFGFESWFWKEVRIPPNQSQKNDDLEPVHRWIVVKFEYHVRKTIPSILTVGNFDIMSELREKPFAL

SEQ ID NO: 181510 - protein, 108 aa, Glycine max
  Coding DNA Sequence Number=SeqID_89825
MHGGITSVVTRGRCRQDEWQDSCHLDAASQSSETPVDAASRSSETRDVNSVSPVPMVRQAAAMRCSGTGEQLFLVAVSRWLQWQDSLLVLLGVVVIVVHLPFFHCVKP

SEQ ID NO: 181511 - protein, 376 aa, Glycine max
  Coding DNA Sequence Number=SeqID_89826
MEREKIDKRITWVELLPSKYLKGDSLLWIKEPISQLVDYVNIQDISLSLHDVWHHGARNLRDIATIVPNQVKEKLNTDRSSLGNPGLSGYGGLIRDSLDRWITGFSVSHYSKTSISTGLCSIIDWVNFLIGMSFVRKLVQYRAYPWPCKAMQVYRQHEWRNTQAVETWTDTASGAGDFSVDTASGAGEFGVTSSRHSHWRLGFKFLVSGKYVALQICDDEDVETMLESFQQQNQMSVFELYIEKDVAGDSMFHSANSLTSCGNNLSNNEAQPPTNVSNLRGDEDDDDYLVSNSYVEESLDEDDSVDGISNTDNEVTNMIQPVYNELKIHFGMMLCIITISTGVILMRKTFVVWRCHQLLMLDKNYMLAWILILKIR

SEQ ID NO: 181512 - protein, 972 aa, Glycine max
  Coding DNA Sequence Number=SeqID_89827
  Gene Ontology: Mol. function=metal ion binding; Cellular component =intrinsic to membrane; Biological process=innate immune response
  Homolog annotation: Hit_ID=A7QEG2; Match level="QueryCoverage=92%, HitCoverage=88%, E-value=0.0, Identity=58%"; Hit description =Chromosome chr1 scaffold_84, whole genome shotgun sequence
  Pfam annotation: Domain name=FYVE; Domain location=634-702; Score =54.6; E_value=3.3e-13; Accession=PF01363.12; Description=FYVE zinc finger
  Pfam annotation: Domain name=PH; Domain location=21-122; Score=14.7; E_value=0.067; Accession=PF00169.20; Description=PH domain
  Pfam annotation: Domain name=RCC1; Domain location=306-355; Score =21.2; E_value=0.0038; Accession=PF00415.9; Description=Regulator of chromosome condensation (RCC1)
  Pfam annotation: Domain name=RCC1; Domain location=358-410; Score =38.9; E_value=1.8e-08; Accession=PF00415.9; Description=Regulator of chromosome condensation (RCC1)
  Pfam annotation: Domain name=RCC1; Domain location=413-462; Score =23.8; E_value=0.00063; Accession=PF00415.9; Description=Regulator of chromosome condensation (RCC1)
  Pfam annotation: Domain name=RCC1; Domain location=478-527; Score =26.1; E_value=0.00013; Accession=PF00415.9; Description=Regulator of chromosome condensation (RCC1)
  Pfam annotation: Domain name=RCC1; Domain location=530-579; Score =22.1; E_value=0.0021; Accession=PF00415.9; Description=Regulator of chromosome condensation (RCC1)
  Pfam annotation: Domain name=RCC1; Domain location=584-631; Score =35.5; E_value=2e-07; Accession=PF00415.9; Description=Regulator of chromosome condensation (RCC1)
  Pfam module annotation: Pfam domain module=FYVE::PH::RCC1::RCC1::RCC1: :RCC1::RCC1::RCC1; Domain location=634-702::21-122::306-355::358 -410::413-462::478-527::530-579::584-631
MADHQKTAPGERDIEQAIISLKKGSYLLKYGQRGKPKFCPFRLSNDESLLLWYSGKDEKQLKLSTVSRIIPGQRTATFQRYPRPEKEYQSFSLIYNDRSLDLICKDKDDAEIWFPGLKAIVTRGNNRKWRFESRTDDSLYSDSPKSGTRRSTPSIAPFSDPGDAGGGFIDLQNRWIKAFSEIISYSAASKSSSQAESLANSSLSSGSVDNSSNRNSASEAFRVSLSSAVSSSSQGSYHEDFDSLGDVFIWGEGIADGILGGGVHRVGALSSSEMDAFLPKALESKLVLDVHSIGCGYRHAVLVTKQGEIFSWGEESGGRLGHGVEMDVFHPKLIDTLGGMNIELVACGEYHTCAVTYSGDLYTWGDGAHNSGMLGHGNEVSHWIPKKVGGNLEGLRVLYVSCGPWHTAIVTSAGQLFTFGDGTFGALGHGDLSSANIPREVENLKGLRTTRVACGVWHTAAVVEVVNESVESSTRSSSGRLFTWGDGDKSQLGHADREPRLVPECVNALSTENICRVACGHSLTIALTTSGRLYTMGSTAYGQLGCPASDGKVPTCVEDIISDSFVEDIACGSYHVAVLTSKAEVYTWGKGLNGQLGHGDSDHRNKPTLVEFLKDKQVKSVFCGSNFTAVVCLHKWIPSVDHSACVGCRNLFNFRRKRHNCYNCGLVFCKSCTSKKSIKASLAPNSNKPYRVCDDCYLKLRKAAIESVPSVQTPSLRCVSLQDNRITKIQGTLLRLASFGSIIQTESSQSKLPDSQDSHLFPSLNGKLQMRDFAPSKSSNSLSMDSKKHLSVSEPAARISCQSMSPVSSKSSPRQSYEDINDDLKYRNDILSLEVISLRTLVEELTHKSKSLEAEHERTSTQLKEMTAVAADEAGKCKSAKEVIKPLTAQVGYSISRVSFFSYSALRPAMDTYKEDHYKHQEGGEARHGSAIRHNGMFMWWNFGLPPYSTIDNSKVVKWRCYDGVMVDSAIR

SEQ ID NO: 181513 - protein, 105 aa, Glycine max
  Coding DNA Sequence Number=SeqID_89828
  Homolog annotation: Hit_ID=A5AV98; Match level="QueryCoverage=93%, HitCoverage=13%, E-value=2e-10, Identity=43%"; Hit description =Putative uncharacterized protein
MEKVPFPSSLNSHVSSGQSLMGLTSLTEMSKSNFICVLNLDLAILEEKSATITDASNNEKKAHYKAWEKSNRLSLTRMTVTDNIKTTHPKTDNAKEFMGLVGECS

SEQ ID NO: 181514 - protein, 126 aa, Glycine max
  Coding DNA Sequence Number=SeqID_89829
MDSSKNNSIVSCTKLLGVGSHLLNQIPSFSRGHITKGSTTDSINHTLLHVAKSLIQILKKELLRNLVVSGPRYREEFLQEHPLKVIPAENGPRSKGLHGVTNNMELLKMLMRIFTCKTMKLGQQMY

SEQ ID NO: 181515 - protein, 109 aa, Glycine max
  Coding DNA Sequence Number=SeqID_89830
  Homolog annotation: Hit_ID=A5B0E4; Match level="QueryCoverage=94%, HitCoverage=9%, E-value=5e-09, Identity=37%"; Hit description =Putative uncharacterized protein
MHQSKPVSTLLGNHIMLSITQALNTEEEKRKLDTIPYANGVGSIMYGMVLRYVNGSLESSLKYKKATQGGDAIISLRGSVIVVRNIKEKTLGKKREIENEVWVLVESSS

SEQ ID NO: 181516 - protein, 143 aa, Glycine max
  Coding DNA Sequence Number=SeqID_89831
  Gene Ontology: Mol. function=heat shock protein binding; Biological process=protein folding
  Homolog annotation: Hit_ID=A5AXU1; Match level="QueryCoverage=35%, HitCoverage=8%, E-value=3e-13, Identity=74%"; Hit description =Putative uncharacterized protein
MNYLEAYNEATALASNEEDKKRASVDAELVEKYNKAKWSKTLVQKYQEEVASKSKKKSKELMHFDDKPMTVDEELLFLTSNYSQQLQSWILMRSAQLFLNHLKEILSLTKISKGFSPKERIYLKCSSKLGWMNTTVEVLLQIA

SEQ ID NO: 181517 - protein, 96 aa, Glycine max
  Coding DNA Sequence Number=SeqID_89832
  Gene Ontology: Mol. function=transferase activity, transferring glycosyl groups; Cellular component=integral to membrane; Biological process=protein amino acid glycosylation
  Homolog annotation: Hit_ID=Q9ST51; Match level="QueryCoverage=82%, HitCoverage=15%, E-value=1e-31, Identity=82%"; Hit description=Fuct c3 protein
MSLCTKGYNIVMTTSLSSHVPVGYFSWAEYDIMAPLQPKIEVVVTVAFISNCDARNMRLQALEALEKSNIKIDFYGGCHRNCDGGLKHLCNAQDTY

SEQ ID NO: 181518 - protein, 177 aa, Glycine max
  Coding DNA Sequence Number=SeqID_89833
MREDPIKNRHFRNDPLTKEKAKDHGKEISHAPIRNTKIKDLMQVVNPLKERKVINHRSEMIAPMAARNGSLARDVTTVKSLVIMHGIAGKERVLRISPIISQTWHKMKDQILRLKCSWQPQAMNPPMTLHGRKEWFISLDDSLKSKVRFADDSSLIVEGIGRVAFRDTNGKETIIEE

SEQ ID NO: 181519 - protein, 70 aa, Glycine max
  Coding DNA Sequence Number=SeqID_89834
MSLQRELVPQKSQRVFAEKKEYPLITIPRFSWVDGEMGIMTKVSANMTPSDLLARIEHRFSSAMPSLLSH

SEQ ID NO: 181520 - protein, 165 aa, Glycine max
  Coding DNA Sequence Number=SeqID_89835
MIMRSQDIYSSQDKATTSPSSSESEEAKGEESSEEIYPQEEGKPLMVKEECKEVTVSSKRLAKKERHFEIKTNIKEISPLKQPPHFLLCKKTLVSIVSPLRLEFIPQVKELLDEGLVRKSLNLCALLVPEIGVLMNPKRIKVIPEWPAPPSVLRKKAQSFKNLGI

SEQ ID NO: 181521 - protein, 115 aa, Glycine max
  Coding DNA Sequence Number=SeqID_89836
MADPETSVFLNQKSHLAAFLAGSTSKEVLAKNLKEVLQMLQQEEEVSSSKKEETSSAEEDEEDPFYQNEDDCFAIKVPVKTTCLVTNSQIVPVKTTCLVTNSQIVPVKTTGNYRS

SEQ ID NO: 181522 - protein, 179 aa, Glycine max
  Coding DNA Sequence Number=SeqID_89837
MWLVRWRDKTRRWTRDNVLRPSAEVTGVQQCRQIVEVTAREREESKEFSDCVILNSLRREKGDRKEFRRLVLCSFGKRRRETQKEFRRLVLGEFFLVKGEENAKMNSISFQGLENQKTLKSFWYKEEEEVQRDSRLVKDCKRLIGKVFKTEWMNVLKSKSKPCFYRLFMSGQDNHLEEL

SEQ ID NO: 181523 - protein, 150 aa, Glycine max
  Coding DNA Sequence Number=SeqID_89838
  Homolog annotation: Hit_ID=A5AM06; Match level="QueryCoverage=41%, HitCoverage=3%, E-value=1e-07, Identity=35%"; Hit description =Putative uncharacterized protein
MGLTIVDLQKEMSAFSQQMPLMNAKDEEDDATSRRTRQSTRLRRLTVRSLDQPRKTTNDNPAIGRGSRPHKEKFHSYLGIVAREKIPIVHSNWNVVPESLKNLIWDDILGDNAKKKVMSTVATRWRQFKSSLATKYVYADNKGQQKDDPA

SEQ ID NO: 181524 - protein, 90 aa, Glycine max
  Coding DNA Sequence Number=SeqID_89839
MKTLTTTLEGKPNQHVPRWIEPKSHVQTRGYKSGYYVMHWMWCIVSGGLKNEWNKWFSNGTTLDSETMTTLCKKWAAYFLKVKNMEFRQV

SEQ ID NO: 181525 - protein, 185 aa, Glycine max
  Coding DNA Sequence Number=SeqID_89840
MRSFNGDFPPWRCTRRQRRRGERRHHPLGNKPWKKELHHQDEPWIRSLEGCFNGGKETGRERERGEHEIEGIKEGEKWNFEVCLTRLSFIKVTTSVTHASIYRLGFTSDSPQILASLHQLDFAPYASRPYNAQWNAPGLLHDKHTLRSSRILGEMEVDVPWLGLWLPLNYQVDMGASQHRTPELG

SEQ ID NO: 181526 - protein, 308 aa, Glycine max
  Coding DNA Sequence Number=SeqID_89841
  Gene Ontology: Mol. function=carbon-carbon lyase activity; Cellular component=mitochondrion; Biological process=aromatic compound metabolic process
  Homolog annotation: Hit_ID=A7QJ76; Match level="QueryCoverage=65%, HitCoverage=59%, E-value=2e-64, Identity=63%"; Hit description =Chromosome chr2 scaffold_105, whole genome shotgun sequence
  Pfam annotation: Domain name=HpcH_HpaI; Domain location=1-193; Score =134.6; E_value=2.8e-37; Accession=PF03328.5; Description=HpcHHpaI aldolase family
MEHGPGGIRDALPCLHALAAANTAAILRVPESTAAWAKKALDLGPQGLMFPMIESPLSAQDAVSYCRFPPTGLRGAAHPIVRASKYGLDDEYLGNYLDELLIMCQVESEEGVANTGAIAAVDGVDCVQMGRNKKVREVLKDAENKVLESRNDDVEIGAYLAGFATVYDGARDLRSRGYHMVSGAVDVGLFRSAAVEDVTRFKMGGDGSESDEGEEKEGDEKYWKLVAIRGLGARDKVVVHGGMVVWCHLWFWGQGGEEKKINKMSLPKITSDDSARWSAAEVTVLIVSTGFLVHSMSESEKWVGVADE

SEQ ID NO: 181527 - protein, 102 aa, Glycine max
  Coding DNA Sequence Number=SeqID_89842
MTARGGYRWSWWVAEKKRARLTKWESTFGAKRDNSRSVQFPLGLEFALSVTIRAERNSSCAKRNNSRSMQFPLELELRLARVASSRWALNLVIKVFMVANIK

SEQ ID NO: 181528 - protein, 28 aa, Glycine max
  Coding DNA Sequence Number=SeqID_89843
MLLKHMLVKLLFSMSGGPMIIYECASLL

SEQ ID NO: 181529 - protein, 290 aa, Glycine max
  Coding DNA Sequence Number=SeqID_89844
MASRKRKSTASRPQAQYDTRRFHSLDAWNRYTDNILGWNILPERNVQIYHTEFDEFKVELERRNLHKGLANLQDGSIDVAVVKEFYANLYTTEEQAPKQAKVRGHLIKIDADSLNEFLQTPVGQPWKLLRKDLMTLAQTWSVFFYSNLAPTSHTSDLNMDRARLVYGLVTKMDMNIGALISGQISFIAQSNSTRLRFPALITALCRVRGVTSDSLTYENLSPTINLAYIKKNCWNVDDLTVNFRGVRKARVRPADVPSSTTLPAPSTSATPTPAPPSSSTQDSQCYEAML

SEQ ID NO: 181530 - protein, 167 aa, Glycine max
  Coding DNA Sequence Number=SeqID_89845
  Homolog annotation: Hit_ID=A5CA05; Match level="QueryCoverage=61%, HitCoverage=10%, E-value=2e-09, Identity=37%"; Hit description =Putative uncharacterized protein
MQFKDTIGSIQRAFKSAEIQIGKLVEEVTQVMGRRKEEFVGIEAQEGSPVKEHDLEEERHEDHKVPIILGQPCLSIASCVLGMGKECLVSKNEGEELACIEELNVPEDKSAGHVMFETLENSRPMEKPKVELKTLPTHLKYVFLEDNEAKPVIISSSLQKKEEDQLV

SEQ ID NO: 181531 - protein, 149 aa, Glycine max
  Coding DNA Sequence Number=SeqID_89846
MGDSLSFEDIGDRWMYYSDHLAIGEQICLVPGQCALDYMDWFFRISHPFITPTQAADPPRHPPVPQHDTYGEPDIPEVSMAPEAGPSDAPSDVEQPRHAVDACQAIAEKLEWLLKLRIITTDTEVHEVMEDCIRIATVVTTDGNVYVGA

SEQ ID NO: 181532 - protein, 62 aa, Glycine max
  Coding DNA Sequence Number=SeqID_89847
MFVEFVSATYRLRSKKTTKGKGGKRFWKSIVVGFKTPREAIEVMDLSHLMLRDVFLKSNKLV

SEQ ID NO: 181533 - protein, 122 aa, Glycine max
  Coding DNA Sequence Number=SeqID_89848
  Homolog annotation: Hit_ID=A5C8Q9; Match level="QueryCoverage=95%, HitCoverage=7%, E-value=4e-09, Identity=35%"; Hit description =Putative uncharacterized protein
MANNIDILCIQETKKESVDAKLCQYLWGDSNASWECFPSSNTAGGLLCIWNNGSFLVDRRVLGRGFIMLEVEIILSSRPWCVLGDFNSIRHREERLNSSQTRDTPPSISELNSWISDMTLEE

SEQ ID NO: 181534 - protein, 229 aa, Glycine max
  Coding DNA Sequence Number=SeqID_89849
AWDRYTDNVLGWKILPERNVKLYVTEFDEFRRELERRNWHKELTNFAYGSIDVAGVKEFYANLYDLEDKLPKQEEESLPAYSRFTRLRPDPQELAARLCIPGRRFELNADGLPLKILRKNLTMLAQTWSVLSFSNLAPTSHTSDITLDTVRVIYGIIQKMDMNLGYLILSQVTLIAQHDSLRLGFPALIAALCKARGKSRARRSEAPSTSAPPISAPSTSPLPPTPAAP

SEQ ID NO: 181535 - protein, 184 aa, Glycine max
  Coding DNA Sequence Number=SeqID_89850
  Gene Ontology: Mol. function=protein kinase activity; Biological process=protein amino acid phosphorylation
  Homolog annotation: Hit_ID=A5AT33; Match level="QueryCoverage=86%, HitCoverage=35%, E-value=9e-32, Identity=49%"; Hit description =Putative uncharacterized protein
MKTAALKLPQVMAECIYRNMQKPSMSSWKRDMPSSNICVLSTAYRLYKKGRALEIVDPTLASTAVTEQAEMCIQLGLLCTQGDLNLRPTMGRVIVVLSKKPPGHMEEPTRPGIPGSRYRRVSRRPYAMSSGEVDDDSNLHTFDSSRNCGTNTTTSATTPTTSSNTTAEVDRRGKRPMQRLVLRD

SEQ ID NO: 181536 - protein, 154 aa, Glycine max
  Coding DNA Sequence Number=SeqID_89851
MQSYPARALDRKLQVDWARDAREGPRVLMSLRISKLIWSIKFRALLSLSLHSSPSSSKLLSMASYGVASPLSLPFSIPLSFIFQEAKESIDEEDPRPTSSNGACINRFQLGFKTRSSTGTSTRPQRENILKEFGILSSTMMSHSIISLLRTRNL

SEQ ID NO: 181537 - protein, 85 aa, Glycine max
  Coding DNA Sequence Number=SeqID_89852
SALDVEEHIGEWRNPIGKIPKITFPSQEGSALGGEEHIGEWRNPIGKMTKITFPSQEGPLLAVKNALENGGIQSGKYGGSHFPVK

SEQ ID NO: 181538 - protein, 333 aa, Glycine max
  Coding DNA Sequence Number=SeqID_89853
  Homolog annotation: Hit_ID=A5C4T5; Match level="QueryCoverage=92%, HitCoverage=29%, E-value=6e-13, Identity=24%"; Hit description =Putative uncharacterized protein
NMERSMIDAASGGALGDMTPAEARNLIEKMASNSQQFSAGSDAIVIRGVHEVATNSSGETKKLEGKLDALVNLVTQLAMNKKFAPVARLCGLCSSADHHTDLCPSVQQSEAIEQPEAYAANIYNIPPQPQQQNQPQQNNYDLSSNRYNSRWRNHPNLRWSNPSQQQQQQQPYFQNMRQLATQLNQQQSQNSDRLPSQSVQNPKNVSVITLRSGKQCQGPQPVASSSSANEPAQPHSTPEKDDDKNLKSKLPNNFYAGESKEKHHTPLPFPPRAISNKKMEEAEKEILETFRKVEELCTNKRMLKGSERISMGKNVSTLIGKSVPQIPANCKDP

SEQ ID NO: 181539 - protein, 83 aa, Glycine max
  Coding DNA Sequence Number=SeqID_89854
  Homolog annotation: Hit_ID=Q8LNP1; Match level="QueryCoverage=48%, HitCoverage=10%, E-value=2e-07, Identity=67%"; Hit description =Putative uncharacterized protein T18N24.41
AGGERKLQLSELDEIRLEAYENSKFYKEKTKKFHGSLIAKKDFDAILPRKGPVTRAMSKRLQEDWARVDKEGLRVLMNLRVDF

SEQ ID NO: 181540 - protein, 116 aa, Glycine max
  Coding DNA Sequence Number=SeqID_89855
MSYFLMRGIRFGSILGRIDSLLRGNPSLVLEVMDLFMSWRGSITMPIGWTSQKNGAHAEEEEPTNLRSNPLQGRGDHAILPRKGLVTRAMNKRLQEDWARVAEEGPRVLMNLRVDF

SEQ ID NO: 181541 - protein, 103 aa, Glycine max
  Coding DNA Sequence Number=SeqID_89856
MAAQVTPPMMEREMIIMIVDTLPVFYYKKMVEYMPWSFADLVFTGERIEVGLRRGKFDYATSTSFDNRRPGASGAKKKEGDAHAMTTVPTWPSSPQTPHNPMY

SEQ ID NO: 181542 - protein, 327 aa, Glycine max
  Coding DNA Sequence Number=SeqID_89857
  Homolog annotation: Hit_ID=Q2HW90; Match level="QueryCoverage=60%, HitCoverage=39%, E-value=1e-19, Identity=29%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPSTTRVAKVVKTSAQELDRVKQNRNGVVGVPRKCLEEKGKGLGKIKANGLILLTSWRFLIFGVVLFPNMEGLVDLAVIDAFLAYHNHKESPVVAILAMYDTFNRGCKKSNARIVCCALALYVWLVSHLFLQEGRPVYPLQGHRSCVEKGKANWDQLLASMEGRLLIGSLARRKEESGLYLHAKDDKELRGSSNGIIGGYHKWLRARTQGFDWLPNLKTVRDDEVKASEESDEVQALKAELERARVVEEEF

SEQ ID NO: 181543 - protein, 140 aa, Glycine max
  Coding DNA Sequence Number=SeqID_89858
PGDGHSLSVSGCREQTSPSGARSAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPKRTINNCIK

SEQ ID NO: 181544 - protein, 200 aa, Glycine max
  Coding DNA Sequence Number=SeqID_89859
  Gene Ontology: Mol. function=nucleotide binding; Cellular component =intrinsic to membrane; Biological process=defense response
  Homolog annotation: Hit_ID=Q2YE87; Match level="QueryCoverage=100%, HitCoverage=16%, E-value=9e-82, Identity=81%"; Hit description=NBS -LRR type disease resistance protein Rps1-k-2
MAAALVGGAFLSAFLDVLFDRLASPDFVDLIRGKKLSKKLLQKLETTLRVVGAVLDDAEKKQITNTNVKHWLNDLKDAVYEADDLLDHVFTKAATQNKVRDLFSRFSDSKIVSKLEDIVVTLESHLKLKESLDLKESAVENLSWKAPSTSLEDGSHIYGREKDKEAIIKLLSEDNSDGSDVSVVPIVGMGGVGKTTLVQL

SEQ ID NO: 181545 - protein, 87 aa, Glycine max
  Coding DNA Sequence Number=SeqID_89860
MGGYIPCGSLLVKGFLQDMTSTSGDAIPSSPKTARLMTEMIKLGDQMRRMSYENEERMERMRKENYESLRRIHRISEALSVKIDHIE

SEQ ID NO: 181546 - protein, 121 aa, Glycine max
  Coding DNA Sequence Number=SeqID_89861
MLEEEAHFSDSTSSDSPSSRESATYLPEVVIMADEHQQRVTLEDYSSSLVPQFFTSIAHPEGNLFQRLPNEDPYEHLATFIEICNTVKIAGVPDEAIRLNLFHFPWQEKPRGGSIHLRVPV

SEQ ID NO: 181547 - protein, 69 aa, Glycine max
  Coding DNA Sequence Number=SeqID_89862
  Homolog annotation: Hit_ID=Q6WAY3; Match level="QueryCoverage=85%, HitCoverage=2%, E-value=2e-08, Identity=47%"; Hit description =Gag/pol polyprotein
MSPSKQEAGQTESEEDEDVGLPSELEKIVAQEDREMGPHQEETEVVDLGTGSGKKEVKIGTGMTAPVRE

SEQ ID NO: 181548 - protein, 212 aa, Glycine max
  Coding DNA Sequence Number=SeqID_89863
MALKKFSMKRSRRDTIGEGSSAIPEFDSHRFRSAKHQQRFEAIKGWSFHRERHVQLREDEYMDIQEEIARRRWASLVTPMAKFGPEIVLEFYANAWPIDEGVRDMRSWVRGQWIPFDADALSQFLGDPLVLEEGQQCEFSQRRNRADGLDEEAIAQLLCTPGQDFARTDAGRRVQIMCTSMTTLTQTWMTLLLSNVLPSDHNSDLPLPKCQL

SEQ ID NO: 181549 - protein, 67 aa, Glycine max
  Coding DNA Sequence Number=SeqID_89864
VVVIIKKGQNVNHAGFDDVKKNFLIMSVIIKKGENVNIASTNEALFQDSLKIKPCLTTKGFKVMQGS

SEQ ID NO: 181550 - protein, 76 aa, Glycine max
  Coding DNA Sequence Number=SeqID_89865
GDAHQAAGTPPPPRQADPTRPLGPHQQFGAEVTLPGDCPDAQAREERAGSPGEADESHMDEDMTDLLGYLGGSGAI

SEQ ID NO: 181551 - protein, 131 aa, Glycine max
  Coding DNA Sequence Number=SeqID_89866
QNRGGACHPARPGEQGCFLEKQQTSRGRIWKAQLSKKLRKLTDCAKTPLFDFRHITEFHGSRLTHKNSPQWSHQLSQHALLRASEARLTGALSKGGKMRGVTTNVYLWKTSEKPKESGQKEYSKFGSCIYV

SEQ ID NO: 181552 - protein, 71 aa, Glycine max
  Coding DNA Sequence Number=SeqID_89867
MVKHCFKIKTRLLQQTSIASRFIQDQFLPQNTLFPACQGSATELLKFKLKSHDPSKYNCVIDYQKPVIDYQ

SEQ ID NO: 181553 - protein, 131 aa, Glycine max
  Coding DNA Sequence Number=SeqID_89868
MLVSFFLTHLLLEVASLIIFLLHSTAIHLQEAKHSIDEEDPRPTSSTWSSIMWYQDHLHIGDLEVVFYHFPSNYLEVVFTHLNYKLSQRALLRASEGEAHGCAFQRRKDARSRHQRLFVENVGKTEGNRSK

SEQ ID NO: 181554 - protein, 136 aa, Glycine max
  Coding DNA Sequence Number=SeqID_89869
MPLEKYEWIGLTYSVRNFFAKQKQEMAPKKLSTKRCRRDATRDGSSTTPEFDSHRFRSAEHQQRFEAIRGWSFHRERRVQLREDEYTDFQEEIARRRWTPLVTPMAKFDPEIVLEFYANAWPMEEGVRDMRSWVGG

SEQ ID NO: 181555 - protein, 171 aa, Glycine max
  Coding DNA Sequence Number=SeqID_89870
  Homolog annotation: Hit_ID=A5AWV0; Match level="QueryCoverage=71%, HitCoverage=8%, E-value=2e-10, Identity=30%"; Hit description =Putative uncharacterized protein
MRAGNSDIYGFLEPQSIQRSGQSQFESESYIKSWMQSSKRDVYLGAYLNGAHWQMVVILPKEHLVVWFCSLHNRPNNYLKGIIKSALKDLDDAPQPKSKAPARWIVVKCNRQKGSTECDYYVMHWMPTIILGTFRNNWEAYFNNPRSLESERLKALWIKWTQFYLRVRDQT

SEQ ID NO: 181556 - protein, 101 aa, Glycine max
  Coding DNA Sequence Number=SeqID_89871
MARISKVVKISAQELDRVKENRNRVVGIPRKHLEEKAKALADQGEWASFIDVLVLLVFRVVLFPNVDGLVDLVAIDAFLVYHQSKESPVVAVLVDAYDTFD

SEQ ID NO: 181557 - protein, 74 aa, Glycine max
  Coding DNA Sequence Number=SeqID_89872
MKEVMREIDLGESDNVERGVVANLVAPTVEEQVLNEEEQRRGSIPLSYPNFVRGPLLDDVRPFFGPREVLGTHH

SEQ ID NO: 181558 - protein, 71 aa, Glycine max
  Coding DNA Sequence Number=SeqID_89873
GYGAYSYLFWAPIKCGSNAFQDYFDDVKESRVKQVPKNQESSKFQESRSRFKIHVKNQDSRFKNQKKTQSR

SEQ ID NO: 181559 - protein, 232 aa, Glycine max
  Coding DNA Sequence Number=SeqID_89874
MSRKACSSLMINISDEPTRNAKRARCAKSECHSDEPELSAPCCAKLQLSLVLKIVDLGWHLRKGRLLLHLPRPDMTDPGSSQEAWERYTDIVVPRKLLPDRNVVVYYTKFDEFKEELERRHWDEKLTDFANNNMDIAIVKEFYANLYDPKDKPPKQVRVRGHLVKFDEDTLNTFLKTVVILEEGEILCSFSRFALLRPDPQELAAKLYILGRGFELNADGQPLKILRKNLTT

SEQ ID NO: 181560 - protein, 326 aa, Glycine max
  Coding DNA Sequence Number=SeqID_89875
  Gene Ontology: Mol. function=binding; Cellular component=protein complex; Biological process=hyperosmotic response
  Homolog annotation: Hit_ID=Q6XJG8; Match level="QueryCoverage=93%, HitCoverage=75%, E-value=2e-99, Identity=62%"; Hit description=26S proteasome subunit RPN1b
MTLLSCVYAKTRNVLKVQNLLGHCSQHLDKGETHQGPVVLGIAMVAIAEELGLEMEIRSLEHLLQYGEQNIRRAIPFALGLLYISNPKGCKMPLTFANFSLNNYRSMCRLSHDTDSEVAMVRIAQGLVHLGKGLLTLNSYHSDRFLLSPTTLAGLITMLHACLDMKAIVLGKYHYVFYFLVLAMQPRMLLTVNENLKPLSVPVRVGQVGRPKTTTGFQTHSTPVLLAAGDRAELTMEKYIPLSPILEGFIILEENPNYREEYLPGPDDMLVLDIAYSIYKKIEEYLNALEIALFMDNAQMVTEMGAMDSSVEQRRLLVRNGGANKF

SEQ ID NO: 181561 - protein, 213 aa, Glycine max
  Coding DNA Sequence Number=SeqID_89876
  Subcellular localization annotation: CTP_CleavageSite=44; ConfidenceScore=5.65e-01
MEKSLKKRKGSSSTTTAVGQRRPNTFGDPPAPNPPSFSSPSVASCSMCFVEFCFLGPPILLWTLQIGRQIDSTHLVWYRMDKALRANATLLYPHLVTLFLHHFNIPLEDEPFVKVKRSFAIGVGAVTSFGYQKDKDGQWVRKQDLSPPIPDERTPSPPPQRDTSSSLLIEVLTELRDLTTFVGDHFDVMDFCITCLEDDMSFIQRCFDPSANS

SEQ ID NO: 181562 - protein, 96 aa, Glycine max
  Coding DNA Sequence Number=SeqID_89877
  Homolog annotation: Hit_ID=A5AMK2; Match level="QueryCoverage=65%, HitCoverage=8%, E-value=8e-07, Identity=40%"; Hit description =Putative uncharacterized protein
  Pfam annotation: Domain name=zf-CCHC; Domain location=43-60; Score =14.7; E_value=0.009; Accession=PF00098.14; Description=Zinc knuckle
MLVNDKLTFKKEEGSSFKSHEKGAALGKNNFNPTPTSSKESSIKCFKCLGKGNIASQCPNKRTMVVLGNGDITSASSSSSSSSFSESEGECHKKGD

SEQ ID NO: 181563 - protein, 95 aa, Glycine max
  Coding DNA Sequence Number=SeqID_89878
MKDIVKEAPKSMIHSDASSIGACRPRIFFINGFLCFLEDEWQRNGERKRERRRHFKEKMSLEEAHHHRRPWIRAWRKKEMNEGSGREEHEILCSK

SEQ ID NO: 181564 - protein, 161 aa, Glycine max
  Coding DNA Sequence Number=SeqID_89879
SEFLIGGYVGAKASLLSTTPLSVTEHQELVARGDTLQLSAPRHSVTPSVIDEQRPMWSFAPFPEMIRRSKSLAFVDRPIIFVILTLSRVRWHAETKFGHSAPFLSSRGGGPDDMRRQNLVIPHPFAIQTQSCPMARRDKIWSFYTLLSSRGGGPDDKQRPM

SEQ ID NO: 181565 - protein, 103 aa, Glycine max
  Coding DNA Sequence Number=SeqID_89880
MLFCENALTIWDQHRLKGALTPGVFTPKAYTPKSPSWSLLPDLGSPQWFPSQYSSPLKGLSINSSPLKGLSINSLPLKGLSINSSPLKGLNINSSPLKGLIIM

SEQ ID NO: 181566 - protein, 64 aa, Glycine max
  Coding DNA Sequence Number=SeqID_89881
MAINGFLKLKELLVGWEAKKERQKESNVPSIRKEGAHHRPICFLARSQERYERRLFFRQGALPI

SEQ ID NO: 181567 - protein, 178 aa, Glycine max
  Coding DNA Sequence Number=SeqID_89882
  Homolog annotation: Hit_ID=UPI00006A2D9E; Match level="QueryCoverage =91%, HitCoverage=84%, E-value=3e-12, Identity=15%"; Hit description =UPI00006A2D9E related cluster
FPTSTVQSFEFGVIDPLDESISCFLIRVDPWVLVPIAFRGLHALDFRGLHVLTFRELHVLDFRGLHTLAFRGLHALDIRGLHVLDSRGLHTLTFRGSHVPTFRGLHALDFRGLHVLNFRGLHVLAFRGLHVLAFRGLHLLDFRELHVLAFRGLHTLAFRGLHVLDVRGMYILFFRGLH

SEQ ID NO: 181568 - protein, 91 aa, Glycine max
  Coding DNA Sequence Number=SeqID_89883
MRRNTTIGEVLTSRNSTRKYLQVNTSPHQLIIKEERHGKHEKALSIIPSLITNTSLATIWKVYPAYMSFMASLAKRRKCKEDVFYVTFMPP

SEQ ID NO: 181569 - protein, 109 aa, Glycine max
  Coding DNA Sequence Number=SeqID_89884
  Gene Ontology: Cellular component=mitochondrion
  Homolog annotation: Hit_ID=A8IFI1; Match level="QueryCoverage=97%, HitCoverage=51%, E-value=1e-52, Identity=98%"; Hit description=S1 ribosomal protein
MQDPGTPRICMQDEPTGVPINRATRFENKVGSLDLVAGESLIKKKILERFFIDLVAGESLIKERAAARFNDLVGSTDVVAGEPLLLLPRRFRQNLAWMELNKIWRTNTK

SEQ ID NO: 181570 - protein, 109 aa, Glycine max
  Coding DNA Sequence Number=SeqID_89885
  Subcellular localization annotation: CTP_CleavageSite=49; ConfidenceScore=5.10e-01
MAFHYSLFLSREGSKISLSPLLPVSILVDSLLPSRKRLLSLLEAPAVVRLRTPRSRISHSPSFFFIFHLSTGRLRADRCLPGEIGAPEVCPSGGLLYSLSISSSVRTAS

SEQ ID NO: 181571 - protein, 109 aa, Glycine max
  Coding DNA Sequence Number=SeqID_89886
  Subcellular localization annotation: CTP_CleavageSite=60; ConfidenceScore=5.63e-01
GSGSNQPYGWKLQNSGPTNTSFVGPSNNSSGGFSNRGPQQHQAQLDRMSKMEDTLTQFMQDNNEKKNKEGIEKENEINDEVVTSEKVEEDEDMAELVDYFIGGDWAPQP

SEQ ID NO: 181572 - protein, 127 aa, Glycine max; identical to SEQ ID NO: 120521
  Coding DNA Sequence Number=SeqID_89887

SEQ ID NO: 181573 - protein, 107 aa, Glycine max
  Coding DNA Sequence Number=SeqID_89888
MGTKHLTRTKEWSHVIEQSLVIDYPPLVIDYQRPYSKYYSRSIAGQPPHKPACFVVFVFLSVDCQELACLGWVGIGQTCVNVCIHDFDDVKEESNKAASNDKHLLQE

SEQ ID NO: 181574 - protein, 172 aa, Glycine max
  Coding DNA Sequence Number=SeqID_89889
  Homolog annotation: Hit_ID=A1G286; Match level="QueryCoverage=100%, HitCoverage=53%, E-value=1e-89, Identity=93%"; Hit description =Putative uncharacterized protein
MDLEHDQAVLLQEPASALVERLADAFERLQLDALTPARLQALAGERPRQPLRPLLWQWAQRSRHWQALDERLRGASVKLLRWPDFRVLGHDHDGFRLCSLLLKRACTVEECAMLLELPAAAVRDFIHAAYLCGYAQLQSAPAAPMTALRGNGTDHGLLARLWRHLRGSERNA

SEQ ID NO: 181575 - protein, 115 aa, Glycine max
  Coding DNA Sequence Number=SeqID_89890
PADAPPPHQAGPAGLFDTEQYLWHLVRQQAANHRAHVQTHDCLYQMSLSLQSQGFTSFSCPTPDQFRAEVAWPGDWPQAQAAEAPAGAPAEAPDEARKDEEMIDLLDFLGGSGAA

SEQ ID NO: 181576 - protein, 79 aa, Glycine max
  Coding DNA Sequence Number=SeqID_89891
  Homolog annotation: Hit_ID=Q9FM79; Match level="QueryCoverage=51%, HitCoverage=10%, E-value=8e-07, Identity=63%"; Hit description =Similarity to pectin methylesterase
MANEKECMCPKMNEREANITANAQNITEIANAIPIITNSTKASDKGNDGQEMGTVSTATVWVESDFFCATALTIEVIED

SEQ ID NO: 181577 - protein, 79 aa, Glycine max
  Coding DNA Sequence Number=SeqID_89892
DCACKTPSGPEEVQQGLGVVKLRVSVSSTECLSPPARASGPLLIEFSSRSTAPPGRHRAKHHSSLGMASSGQQTHCHHL

SEQ ID NO: 181578 - protein, 135 aa, Glycine max
  Coding DNA Sequence Number=SeqID_89893
DHGMYYTPPTFSQYPTQMYQYPFESHQSDTSACEHSLGGVVETYANFSWPTVIPSQQHDVLIETPNAPLGTQWNIPGAIPNMDELLGVDLRHQFSLEANQHEERGHRGKRNPDRQARRWDRPCGTSSRHHRHQDD

SEQ ID NO: 181579 - protein, 51 aa, Glycine max
  Coding DNA Sequence Number=SeqID_89894
MTLRQHGLSLGSSSSMDSFASWKMNGRGMEKEEREETPLQGEDESRRSSPP

SEQ ID NO: 181580 - protein, 102 aa, Glycine max
  Coding DNA Sequence Number=SeqID_89895
MEKARASYVAISPMQKARPSRVSCLANGEGESFSYVALCRQCRRRDLLVACLANGEGETFSYVARVANDNDGTSCNANASGGLSFLASGYGGFHAKTNPLRE

SEQ ID NO: 181581 - protein, 823 aa, Glycine max
  Coding DNA Sequence Number=SeqID_89896
  Gene Ontology: Mol. function=nucleic acid binding; Cellular component= nucleus; Biological process=chromatin modification
  Homolog annotation: Hit_ID=A2Q4K2; Match level="QueryCoverage=97%, HitCoverage=97%, E-value=0.0, Identity=58%"; Hit description=SNF2 -related; Zinc finger, RING-type; ATP-requiring DNA helicase RecQ
  Pfam annotation: Domain name=HIRAN; Domain location=21-116; Score =78.4; E_value=2.4e-20; Accession=PF08797.2; Description=HIRAN domain
  Pfam annotation: Domain name=Helicase_C; Domain location=690-770; Score=69.0; E_value=1.6e-17; Accession=PF00271.22; Description =Helicase conserved C-terminal domain
  Pfam annotation: Domain name=ResIII; Domain location=189-419; Score= -32.2; E_value=0.024; Accession=PF04851.6; Description=Type III restriction enzyme, res subunit
  Pfam annotation: Domain name=SNF2_N; Domain location=195-546; Score =154.9; E_value=2.2e-43; Accession=PF00176.14; Description=SNF2 family N-terminal domain
  Pfam annotation: Domain name=zf-C3HC4; Domain location=581-619; Score= 33.1; E_value=1e-06; Accession=PF00097.16; Description=Zinc finger, C3HC4 type (RING finger)
  Pfam module annotation: Pfam domain module=HIRAN::Helicase _C::ResIII::SNF2_N::zf-C3HC4; Domain location=21-116::690-770::189 -419::195-546::581-619
MDWQEDDRSFESSESSDKYLLGFIMSNIVGLQHHSGTLHGERPLVGLAREPHNPHDPHAIVVLNTHSLSVGYIERSVAAALSPLIDQNLVKVEAIVPTARNAHRIPCQIHVFARVSDFSAVENAVEDAGLKIITGSDASFTLSDSVAVKETRAQKKSSSVDAIFKKVNRSYTGKNPAIQILEPPRTIIRTELLQHQKEGLAWLVHRENSDDLPPFWEENEGKFVNILTDYQSDNRPDPLRGGIFADEMGLGKTLTLLSLIAFDKKSQMGVSKKWRTDRKVVTLEKRRMRESENESESSSPEKGFRTNATLVVCPPSVMSTWITQLEEHTVPGALKTYMYYGERRTDDPFDLNRYDLVLTTYGILAGEHCMPKMPAKNMYWRRIVLDEAHTIKNFNALQSLAVSKLNAQCRWAVTGTPIQSGCIDLFSIMVFLRFQPFSVRQQWRELVQRSLNKGKDKGLVRLQILMEAIALRRTKDMTLVGLPPKTIEICYVELSFDERQMYDQLKQDTKIFLSRYAHDDSLVPHYSAVLSRILRLRQICTDSKLWNVQSLLLTNIEDASNNPELLQALLGQVQDGEDFDCPICLSPPIEIVITRCAHIFCRICILRALQNKNPCCPLCRRRLKESDLFSAPPESSKVDSAGECSSSQTVLPSKVSTLIKLLTESRDQHPAAKSVVFSQFRKLLLLMEEPLNAAGFKTLRLDGTMNAKHRANVIEQFQSQGIDGPTVLLASLRASSAGINLTSASRLYFMEPWWNHAVEEQAMDRVHRIGQKEAVKIVRLIAQNSIEEQILVLQEKKKQLPREPSGTGLKGMGINDIHFLLDH

SEQ ID NO: 181582 - protein, 96 aa, Glycine max
  Coding DNA Sequence Number=SeqID_89897
  Homolog annotation: Hit_ID=A5BSB8; Match level="QueryCoverage=86%, HitCoverage=32%, E-value=4e-07, Identity=37%"; Hit description =Putative uncharacterized protein
MPDVRACIYKLYDESNDDIYNMILMESVTVREVETVPLLASSTAIESLEKVKLEDDAGIKKKKKKKCSICLHEFKDNVEVSSMSFNHVYHQECIIT

SEQ ID NO: 181583 - protein, 163 aa, Glycine max
  Coding DNA Sequence Number=SeqID_89898
MAARLIRDRVEMECLEGAWETLEGNTRCRFRGTIRFTATSLVHPDEPARTLQRTVEWILPTPTPYRLVEPVQVIGVTSSEEDPEEDLEELPPEPAVGALDFLEGDEDPLLEVDSPEEVMSASEADSTEDSGPGEMAISGGSSSYLCDTLSHQDFLGANSFPTG

SEQ ID NO: 181584 - protein, 171 aa, Glycine max
  Coding DNA Sequence Number=SeqID_89899
  Gene Ontology: Mol. function=helicase activity; Biological process =viral genome replication
  Homolog annotation: Hit_ID=Q2A9I1; Match level="QueryCoverage=84%, HitCoverage=10%, E-value=4e-25, Identity=35%"; Hit description =Putative uncharacterized protein
MMLSTAKGAQSYNDIRIVNGVVYPTFRETCFAKGFLGSDQEFISALQEANNWGTAHYLRKLFVKLLFMNTMDRPEYVWQQTWQWIANDIIFNHRKQGIRLTQKETIHLCLTEIENMLQANRRSLRDFPSMPYPIGYARNQGCQVLCNKGCQVSRSGQSKVVYHQIIIPGRN

SEQ ID NO: 181585 - protein, 139 aa, Glycine max
  Coding DNA Sequence Number=SeqID_89900
MAAQLIHDRVEMECLEGAWETLEGNTRCRFRGTIRFTATSLVHPDEPARTLQRMVEWILPTPTPYHLVEPIQVIEVTSSEEDPEDALDFLEGDEDPLPEVDSPEEVMSASEADSTEDSGPGGGDGDQRRLFIIVGSSMD

SEQ ID NO: 181586 - protein, 109 aa, Glycine max
  Coding DNA Sequence Number=SeqID_89901
  Subcellular localization annotation: CTP_CleavageSite=26; ConfidenceScore=5.20e-01
SVSESSSDSEAISAQVFLANFGTLVRPMSSKARRVFDDSGLMVVIWVNDPSSFPFWVDDPVWVGDPEDDAVAFLVIGSGRANRTSFPLVLDLPPLPKELDTLGGIGNLL

SEQ ID NO: 181587 - protein, 65 aa, Glycine max; identical to SEQ ID NO: 152582
  Coding DNA Sequence Number=SeqID_89902
  Subcellular localization annotation: CTP_CleavageSite=26; ConfidenceScore=5.28e-01

SEQ ID NO: 181588 - protein, 137 aa, Glycine max
  Coding DNA Sequence Number=SeqID_89903
  Pfam annotation: Domain name=G-patch; Domain location=2-41; Score =23.4; E_value=0.00029; Accession=PF01585.14; Description=G-patch domain
MARVMLGNGYEPGMGLGKDNGGITSLINAKGNRGKYGLGYGPTQADVKRSIAGRKSGSQSSRLRQEGEGSPPCHISRSFISAGLGDEGQVVAIYVSQPSLRREGDARLAGCVFHERNTRGVATNVYLRKTSEKPEKT

SEQ ID NO: 181589 - protein, 45 aa, Glycine max
  Coding DNA Sequence Number=SeqID_89904
MDETSIVLMQQPHHVHFRVNMGNMFFVSIHKDELVTVAGDPWLQH

SEQ ID NO: 181590 - protein, 116 aa, Glycine max
  Coding DNA Sequence Number=SeqID_89905
MKNDEEFPLNRLPPSPIYREKERCLPPRGFLRKIFKRTTITKFTPLFVLYGKVTEALWKCFGFDFHLFLSSLSAILSEICLPKVFENFTEALGKPQKPRKPFFNNVEELAAQLLPP

SEQ ID NO: 181591 - protein, 68 aa, Glycine max
  Coding DNA Sequence Number=SeqID_89906
MAVTSIRGCGSPSAAQTRFLFIPSQEKKFREEKKGSLQLGGHKTNILINLSSSSSWLIQGLKMERRLM

SEQ ID NO: 181592 - protein, 128 aa, Glycine max
  Coding DNA Sequence Number=SeqID_89907
  Subcellular localization annotation: CTP_CleavageSite=74; ConfidenceScore=5.16e-01
SAKVDVLLSELNARNKSHPLSEASTRLADRRNLEGNLSRRHALRASSARSASRLSPSKLSTSLALSENSLTRTKCENGAKRNYFSIVCLWLDHPYVCTVRGFSIERCIVSLELDRAGLGYCMFGHGVW

SEQ ID NO: 181593 - protein, 403 aa, Glycine max
  Coding DNA Sequence Number=SeqID_89908
  Homolog annotation: Hit_ID=A2EVV1; Match level="QueryCoverage=89%, HitCoverage=53%, E-value=5e-13, Identity=24%"; Hit description =Surface antigen BspA-like
MLSKGDNDLHLHFKDDNIFSRCMLSKGENDPHLHFEDDNVFSHCMLSKGDNDPHLHVEDDNVFSHCMLSKGNNDLYLQFEDNNVFSHCMLSKGNNDPHLHVEDHNVFSHCMLLKGDNGLHPYVEDHNAFSHCMLSKGDNDPYLHFEHDNVFSHCMLSKGDNDLHLHFEDDHVFSHCMLSKGDNGPHLYFKDDIVFSHCMLSKGDNDLHLHFNDDNIFSRCMLSKGDNDPYLHVKDDNVFSHCMLSKGDNDLYLYFEDDHVFSHCMLSKGDNDPHLHVEDDNVFSHCMLSKGDSDLHLHFEDNNVFSHCMLSKGNNDPHLHVEDHNVFSHCMLLKGDNDLHRYVEDHNVFSHCMLSKGDNDPYLHFEHDNVFSHCMLSKGDDDLHLRFRRQRCLHLKTSMSFVL

SEQ ID NO: 181594 - protein, 66 aa, Glycine max
  Coding DNA Sequence Number=SeqID_89909
MTTEEKTSEVSSTPEYSCPATAGYVGGTKKGRLELNVEDQNVSFDLFEAIKHSNMGDACSEEEEVE

SEQ ID NO: 181595 - protein, 51 aa, Glycine max
  Coding DNA Sequence Number=SeqID_89910
MGGGGGKLPGNHITSETSKRVGLRPQKETTPENLAFHGFKQKTQMKHEAET

SEQ ID NO: 181596 - protein, 212 aa, Glycine max
  Coding DNA Sequence Number=SeqID_89911
  Gene Ontology: Mol. function=RNA-directed DNA polymerase activity; Biological process=regulation of transcription, DNA-dependent
  Homolog annotation: Hit_ID=A7QSG9; Match level="QueryCoverage=97%, HitCoverage=32%, E-value=3e-43, Identity=41%"; Hit description =Chromosome chr12 scaffold_159, whole genome shotgun sequence
AVKTDLNGKVISNDDDKEIPDAVNTLIFTIAQHFIGDPSLWKDRSAELLSNLKCRTLADFRWYRDTFLTRVYTREDSQQPFWKEKFLASLPRSLEDKVIDKIHSQSANGDIPYENLSYGQLISYVQKVALKICQDDKIQRQLAKEKAQTKKDLGSFCEQFGLPACPKQKKKQTSRKEIQDHKPANRIRFSKRRYSKKPLTSKEIENPKQKIK

SEQ ID NO: 181597 - protein, 163 aa, Glycine max
  Coding DNA Sequence Number=SeqID_89912
MGDLDEVQEQMKADMSALKEQMDSMMDAMLGMKQLMESNAATTTVVSSAAEADPTLPTVAHHPIPNMVGGEGSTPGHINNPYPRYHRGTYPYGLPPNYTPQPYMKTWVTFLPSSSKGNLLYILTGSTRIIESMLRETSTPTPRYPLRGQRPTHYLNPKSRKSL

SEQ ID NO: 181598 - protein, 82 aa, Glycine max
  Coding DNA Sequence Number=SeqID_89913
  Homolog annotation: Hit_ID=A5B6Z3; Match level="QueryCoverage=54%, HitCoverage=4%, E-value=8e-08, Identity=66%"; Hit description =Putative uncharacterized protein
METNMIPIALTLFIILIILEWAMELLNQLLPRQIMSIFLQNVLRVPSCKVDLMSDLMAGMTIGLGEQRDGLYYLVSMNKTHK

SEQ ID NO: 181599 - protein, 15 aa, Glycine max
  Coding DNA Sequence Number=SeqID_89914
IQTAQNIQQINAKST

SEQ ID NO: 181600 - protein, 134 aa, Glycine max
  Coding DNA Sequence Number=SeqID_89915
MSHFVEHYAGKNPSRCRCVMRTTHGLSYAYELSRYVVGTIPLETIHMFWQRLSFSNQGLFEPEVNITEEMKIISKWFQELDVCSKVTLKSKLQKIAYLDLKFMCHPLEKVNTKVFLQSNIVHHHQAKQFQEGLC

SEQ ID NO: 181601 - protein, 104 aa, Glycine max
  Coding DNA Sequence Number=SeqID_89916
MRADALSAGAFKTQSSYGNAKRSCALSAPYETAKNYKAIRCICPYLASSPYIPAPLLFIAFIYTIQMKALRAAIALSAFIFSIEFSIELAKRGCALSEYCVSDT

SEQ ID NO: 181602 - protein, 146 aa, Glycine max
  Coding DNA Sequence Number=SeqID_89917
MALHDFYVKMGDEDLAMIWLTFLPSSYENFLRLKAYGNGDEASMARLSVIGRGLFKESKEERQRWQDCKESNNWKGTIQRKQRKIMLLLLFRMTPHRKAIWFWILDSSCSYHMSPYRHWFVKNEKKSSVHIFIVVLPASAPGRQVK

SEQ ID NO: 181603 - protein, 82 aa, Glycine max
  Coding DNA Sequence Number=SeqID_89918
  Homolog annotation: Hit_ID=A6FJQ2; Match level="QueryCoverage=46%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGWGVVGGVFVVEVEDNYLVVAVIMAYLSSFNFNNHG

SEQ ID NO: 181604 - protein, 246 aa, Glycine max
  Coding DNA Sequence Number=SeqID_89919
MVISHGDAAEDKGEEYWIYEHFPSVHESVTDKGYDETSPCACRWLTTKAYSKGFAASTYQTCIDALTIPDGKLRWGPIVVTHRPVVHQFVYIHTIPPLPIGATLSFKDMDGRWMHYSDHLVAAGQICLVPGQCVADYMDLFFGISHSFITPTQSTDSPKHPPVPQHETYVEPDIPEVPVAPKAGPSESVDQPRHAVDACEAIAERLEHVLNLRMVTVGTELHDIMEDYQRIARGVTLDGNMYVRVR

SEQ ID NO: 181605 - protein, 91 aa, Glycine max
  Coding DNA Sequence Number=SeqID_89920
MSDQILDSSLVIVDNDLFDTVSIDSPMGCTLSLRPKFNVGPPSRRSDPYLECGINSLTPPFIINHECQPPRCRSYSPPPWGMHLAGDGQST

SEQ ID NO: 181606 - protein, 63 aa, Glycine max
  Coding DNA Sequence Number=SeqID_89921
MELVTSVKGFPGCTKLSCRQRNKLNVLMMPKFHMRLKALFKTKKLKIFKMDDQDKSLVLERVY

SEQ ID NO: 181607 - protein, 89 aa, Glycine max
  Coding DNA Sequence Number=SeqID_89922
  Gene Ontology: Mol. function=NAD(P)H dehydrogenase (quinone) activity
  Homolog annotation: Hit_ID=A7Q5E8; Match level="QueryCoverage=57%, HitCoverage=26%, E-value=6e-11, Identity=60%"; Hit description =Chromosome undetermined scaffold_53, whole genome shotgun sequence
MAPVAGGSSTVIKVEALSAIEVSKGSVEGVQIEYIDISPWPFVNTDLEGDESYPPEVEALRHKILAADSLLSSSLSTIILSKVHLYYHF

SEQ ID NO: 181608 - protein, 62 aa, Glycine max
  Coding DNA Sequence Number=SeqID_89923
MEREEGFKVRRRGSRSWFPRSGVRRHKAREETRLKNQGNHSIHYVNNQGVGMKVNKKHGKDK

SEQ ID NO: 181609 - protein, 163 aa, Glycine max
  Coding DNA Sequence Number=SeqID_89924
  Gene Ontology: Mol. function=transferase activity, transferring glycosyl groups; Cellular component=cytoplasm; Biological process =nucleoside metabolic process
  Homolog annotation: Hit_ID=A7QVF3; Match level="QueryCoverage=33%, HitCoverage=29%, E-value=3e-20, Identity=87%"; Hit description =Chromosome chr2 scaffold_187, whole genome shotgun sequence
  Pfam annotation: Domain name=Pribosyltran; Domain location=31-163; Score=-4.6; E_value=0.0078; Accession=PF00156.18; Description =Phosphoribosyl transferase domain
  Subcellular localization annotation: CTP_CleavageSite=31; ConfidenceScore=5.11e-01
MTRVRHRSRHRHRSRSSGGNFVNKLPFLVPCARHVTHSTTLAVGARLCRQCAGIEARGFIFGSPIALAIGAKFLPLRKSKKLPGKVISQEHILEYGRDCLEMHVGLELLNLDNPENYDIEELTGNESDLMLGVADLHTLEAVATTESAISTFLQSAEFAAAES

SEQ ID NO: 181610 - protein, 243 aa, Glycine max
  Coding DNA Sequence Number=SeqID_89925
MDFFSNESFECIRAFENSNLIPFMSLKLPVYSELVKVFYSNLEIQEGTLIFEVYGIKMVIDQSLFYDLTQLSSEGVPFEGTLNDDWKFDFFVHDACRLVCTNQADMTGRLLAGSLALKAASFIISLFVSCFQDLQTLHKCFLIGAAVIASFGYHKEHDGSWVKKGAQPIDEEGHLPVGEDYSLLQRILDRFDGLQNFVGERFDALELQVDMRFDEMDSRITKVEGDVSYICTCFDLPPPPSSS

SEQ ID NO: 181611 - protein, 55 aa, Glycine max
  Coding DNA Sequence Number=SeqID_89926
MEDTPVSLRVALPPKVPTAAICSSKGMIPLETIKRDMTTLGIIIKRPFGSSRVGP

SEQ ID NO: 181612 - protein, 75 aa, Glycine max
  Coding DNA Sequence Number=SeqID_89927
MKSKWSRPFVIKKVRPYGAIELYDPQSQDPDRIWVANGQSWAEPIGPLSEIIERNQTSLSRSASITRSASASKFA

SEQ ID NO: 181613 - protein, 171 aa, Glycine max
  Coding DNA Sequence Number=SeqID_89928
MTGEWISPYIQTVLLKCQPSRVNEALYLMLEGHALLYRMPQNTTVIGTGCIGIVPSGEERLIDLLEWVKTMREMNFMGEAFVVEWAIFVVRASDWEGFRCRLNNLVDARNIGRWACEGFVGILAMWELKLRHRCLPPSSWLHLFRISYCLYLLKQCNQTSPILSPLQFSCP

SEQ ID NO: 181614 - protein, 245 aa, Glycine max
  Coding DNA Sequence Number=SeqID_89929
  Gene Ontology: Cellular component=integral to membrane; Biological process=toxin biosynthetic process
  Homolog annotation: Hit_ID=P08550; Match level="QueryCoverage=34%, HitCoverage=51%, E-value=2e-35, Identity=91%"; Hit description =Colicin V production protein
  Pfam annotation: Domain name=Colicin_V; Domain location=164-245; Score=-16.1; E_value=0.0078; Accession=PF02674.7; Description =Colicin V production protein
  Pfam annotation: Domain name=SPOR; Domain location=78-154; Score =57.7; E_value=4e-14; Accession=PF05036.4; Description=Sporulation related repeat
  Pfam module annotation: Pfam domain module=Colicin_V::SPOR; Domain location=164-245::78-154
TQPAQNSQPSVVTPPPVHQQQKPAEQVKPKPVEQPKPKPVEQPKPKPAEQPKATEQPKTTEQPKAAETPKQSEPAAPAGQAYVVQLGALKNAAKVNEIVAQLRLSGYRAFTVPSTPVQGQITRIYVGPDASKAKLQGALGELKGISGLGGVVKPAFNRGTHMVWIDYAIIAVIGFSCLVSLIRGFVREALSLVTWGCAFFVASHNYTYLSVWFTGFEDELVRNGIAIAVLFNKTLIDGAIVNYVI

SEQ ID NO: 181615 - protein, 113 aa, Glycine max
  Coding DNA Sequence Number=SeqID_89930
MVMGDSISRLSFPENTETFPSPTSYPELRRSEFLIGGYVGARASLLSTTPPFVVMTQELVACGDTLRLSAPRHSVTPSVINEQRPVWSFAPFPEMSASSGGDFFKSHKLSRTT

SEQ ID NO: 181616 - protein, 118 aa, Glycine max
  Coding DNA Sequence Number=SeqID_89931
  Gene Ontology: Mol. function=oxidoreductase activity, acting on the CH-CH group of donors; Cellular component=integral to membrane; Biological process=electron transport
  Homolog annotation: Hit_ID=A3M4G0; Match level="QueryCoverage=40%, HitCoverage=14%, E-value=1e-18, Identity=91%"; Hit description=Acyl -CoA dehydrogenase
MWITNGGDADVLVVYAKTDPHAGAKGMTAFLIEKDMKGFSHGHHLDKLAHPPFASWRNSEEARTDRPSQQLRSLNGEWDAPCSGALSAAGVVVTRSVTATLASADVRRCFCRYAPPRQ

SEQ ID NO: 181617 - protein, 215 aa, Glycine max
  Coding DNA Sequence Number=SeqID_89932
  Homolog annotation: Hit_ID=Q84VH5; Match level="QueryCoverage=95%, HitCoverage=34%, E-value=7e-94, Identity=77%"; Hit description =Envelope-like protein
MDLIKAAGLMKTVTKLGDCYESLVREFIVNIPSDITNRKSDEYQKVFVRGKCVRFSPAVINKYLGRPTEGVVDIAVSEHQIAKEITAKRVQHWPKKGKLSAGKLSVKYAILHRIGAANWVPTNHTSTVATESFAVKLPIAFPTVLCGIMLSQHPNILNNIDSVKKRESPLSLHYKLFEGTHVPDIVSTSGKAAASGAVSKDDLIANSRTHARCWR

SEQ ID NO: 181618 - protein, 208 aa, Glycine max
  Coding DNA Sequence Number=SeqID_89933
MAASDIAILRDRAHAPTKKSLLELTSQDTLLAHNKLLSKQLEALTETLRCAICGGAHNLAVVSPMKNQLMNMPSHIIHNRDSGGITLETSSTKTRVVSMFNHKSTESAIKNLEVQVGQLAKQLADKLSSSFSANIEKNPKEECKDVMTRSRMAIQLDEGRAEEKAEGHKQQSAAKPALEPVFDFVELEEVVEDEDDQQERERDTNKRK

SEQ ID NO: 181619 - protein, 107 aa, Glycine max
  Coding DNA Sequence Number=SeqID_89934
MGSDSDAILPRKGLVTRAMSKRLQEDWARAAEEGPRVLMNLRGRFLSPWANVGIHDVGYNVQDILPENTGIAKSIEAAGSTMSDTMSRTSCPKILELLKALKLQDPR

SEQ ID NO: 181620 - protein, 37 aa, Glycine max
  Coding DNA Sequence Number=SeqID_89935
MKMLLIPHDMNDSEMEKEEREETPLQGEDESRRSSPP

SEQ ID NO: 181621 - protein, 105 aa, Glycine max
  Coding DNA Sequence Number=SeqID_89936
VEAVNDVVVDDPLHELIKSLVDIYEKPVELVWDATKFGIPNATASLFVTCADTLETKSEGKFGHNTLRWIEVKGHVQSGAYECGYYVMHWMWNIIVGQLKTNWML

SEQ ID NO: 181622 - protein, 97 aa, Glycine max
  Coding DNA Sequence Number=SeqID_89937
MSSVIACLQKAKMSSFAFRRRQCGSNAFQDYFDDAKESRVKQVPKNQESKSFKNQVSKNQDSRIIKFQDLIKFQESRFKNNQDKDSRIKRRLNQDKY

SEQ ID NO: 181623 - protein, 110 aa, Glycine max
  Coding DNA Sequence Number=SeqID_89938
  Homolog annotation: Hit_ID=A5BIS3; Match level="QueryCoverage=100%, HitCoverage=8%, E-value=2e-18, Identity=49%"; Hit description =Putative uncharacterized protein
MDMVRSMLNNSTLPISLWMYALKTVIMRIVKTGNARFIENGEISGSIVPREMKIKEVRVQVPLACASSSKVIAPLVIVTNNNEEAQHNNESMIHNEPIVEEPHEVALRRS

SEQ ID NO: 181624 - protein, 203 aa, Glycine max
  Coding DNA Sequence Number=SeqID_89939
  Homolog annotation: Hit_ID=A7UQU7; Match level="QueryCoverage=43%, HitCoverage=15%, E-value=1e-08, Identity=39%"; Hit description=IMP dehydrogenase/GMP reductase, putative
MTGIKGAPYRARIDALTVIDVCWMPYAEHRGVQGYDLISSCMGQVRWGQIIVYIRPERVVRQMGYIHTVPPPRVRDSLTGTDIDDRWVHFSDHLVSTRELSVVPGQDTTEPRPAPPPPTHDDDFVEPPVPEVLVALDLPTHSVVDCITCVRIGRIAEHLECVINFRMVTEGTDLYDIMDLCLRIARDDDPDDSLRSRQRPRID

SEQ ID NO: 181625 - protein, 342 aa, Glycine max
  Coding DNA Sequence Number=SeqID_89940
  Homolog annotation: Hit_ID=Q6WAY6; Match level="QueryCoverage=75%, HitCoverage=42%, E-value=6e-16, Identity=28%"; Hit description =Putative uncharacterized protein
QAKKKNLSTGSLDGKKEEPTLISCGGFPNVPLIGTRGYISYNPVLAIRQLSYPMRGAPLEEELAPIIARGFNKTNVEALQKVSKAWEMVQKKDKELRGSNNGPIGDYCKWLKAHMQGMDWLPSLRTTKGEEVEAPEEDEEVQALRAKLEQAQTVKERFKSAALKIRKENAKLIDVNIATTKALEQETKRARREEHGRNKFRGALWGSNSELKLRREERDQSRVDSLILKDELKVCLRSKRSLSQRFCETETNMLAIVSKYQEELNLATAHEHKVADEYARVYAEKEARGRVIDSLHQEATMWMDRFALTLNGSQELPQLLAKAKVMADTYSVPKEIHGLLSY

SEQ ID NO: 181626 - protein, 126 aa, Glycine max
  Coding DNA Sequence Number=SeqID_89941
MTNAVTKKEEERAEIEIHQESIRQVTSIHHQLTNEEEKPEVSNTLEYPSLATIGYVGGKDKGRLELSVEDQKISFDLFEAMKHSDIGDACFEKRIGGEGNGTVSLNHGTTVPFGKRTWLWERLFSL

SEQ ID NO: 181627 - protein, 108 aa, Glycine max
  Coding DNA Sequence Number=SeqID_89942
MGEQLDTTQHNQFVAHDSSHSTDNDAVVAEIKLLMDKYAERRKRRQSILQDEKDNVQLLMSNSQCSATINDNNNPATSFQYTPPSHGTLYMNDSRHCSKRHTINVSSI

SEQ ID NO: 181628 - protein, 89 aa, Glycine max
  Coding DNA Sequence Number=SeqID_89943
ACSDLEWAFLVGTKFSRLGIFSGFTSDLSYEVTKFKGSWLNLFNVSPRCLESSNFFPDHGHVWDFGSEDDFIGCLCLLVGLGKFDRGDK

SEQ ID NO: 181629 - protein, 34 aa, Glycine max
  Coding DNA Sequence Number=SeqID_89944
AHENPRAFPWISSPIYLESSTQCPCGKECINRIL

SEQ ID NO: 181630 - protein, 158 aa, Glycine max
  Coding DNA Sequence Number=SeqID_89945
ASSFLLSVPGPPPDIRGQPTVRAHPEREAIMHLLCIPGQDFTRATAKRRVWIMRTNMTNFTWIWTTLLFSNILPGIAPTRRPVDPKKSNRALGFPALVTGLCQSYRVPVPPARSCHRDIEIVPARHPVDPKKSNRVLKFSSSNYGQAQGKTPQQPGDG

SEQ ID NO: 181631 - protein, 153 aa, Glycine max
  Coding DNA Sequence Number=SeqID_89946
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q8MBP6; Match level="QueryCoverage=88%, HitCoverage=28%, E-value=1e-68, Identity=97%"; Hit description=ATP synthase subunit beta
  Pfam annotation: Domain name=ATP-synt_ab_C; Domain location=61-153; Score=145.8; E_value=1.2e-40; Accession=PF00306.18; Description=ATP synthase alphabeta chain, C terminal domain
DVPTQYRFNGIGSPVRFSFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLV

SEQ ID NO: 181632 - protein, 141 aa, Glycine max
  Coding DNA Sequence Number=SeqID_89947
MCVMHMRKAQHGNVHYDNIHKIQAKGYVTLMHGSVKNGTQRVRSVPLFKGPIWEGANKAFSDNSQGGHSMITSLVESPTVATYPSAGGRRVTRGMRVPRKAYARSRHQRLFEENVGKTGKDAIYELLSERFGSCIYARGRY

SEQ ID NO: 181633 - protein, 160 aa, Glycine max
  Coding DNA Sequence Number=SeqID_89948
MPLRGRIASFIFTDINYNKVCWEGKMFYSDQNVFNYPIWSSDGAVKKRLSHEVLKVTVELSSSVGVSASIAKRGSSALSTIEESGRASVSRPRAKREISELSTTVVFSQAQRMTGAKLKSTYSTETDTKREAERDRAHHSAYFGKRALEAAKGAAFVERP

SEQ ID NO: 181634 - protein, 50 aa, Glycine max
  Coding DNA Sequence Number=SeqID_89949
MEDGSLSFNEVLQWQRRRREGRHHPLGNKPRKKELHHQELPWIRSLKMML

SEQ ID NO: 181635 - protein, 256 aa, Glycine max
  Coding DNA Sequence Number=SeqID_89950
  Homolog annotation: Hit_ID=A7UQU7; Match level="QueryCoverage=45%, HitCoverage=20%, E-value=4e-15, Identity=40%"; Hit description=IMP dehydrogenase/GMP reductase, putative
  Pfam annotation: Domain name=DUF1723; Domain location=179-228; Score =46.5; E_value=9.5e-11; Accession=PF08330.1; Description=Protein of unknown function (DUF1723)
  Subcellular localization annotation: CTP_CleavageSite=77; ConfidenceScore=5.12e-01
MYGPKNENGNEKSVFHLKLKSTLLPTPIPSLLFQSLLSHLVAPRCEFPSFIFTIVVVVSPPTIIVAVVIIVRTRGLRRALGRVLGRALGRHVHEEPQEPVTNHVATDTKGFPSGPQDASPLMDYSYHMATRVWAGEERTELKLASHGRKVEQFGRPGLEIEGIVTATGLSSLISYSLDTGDKGLLSAFVERWHKETGSFHLPVMKVSITLDDVAYLLHLPNTGAFLTVDALDVDQVVELLVELLGVSTQEAKDETE

SEQ ID NO: 181636 - protein, 89 aa, Glycine max
  Coding DNA Sequence Number=SeqID_89951
  Pfam annotation: Domain name=zf-CCHC; Domain location=22-39; Score =20.1; E_value=0.0014; Accession=PF00098.14; Description=Zinc knuckle
MDQTRKDPRNYRERKDKDKSSIICYECEKPGHFKLECQTLIGQITRKGTSNQRTRNIFKGNETPKSAPGCQVFKIKRSNPSIELRELVY

SEQ ID NO: 181637 - protein, 147 aa, Glycine max
  Coding DNA Sequence Number=SeqID_89952
MPVRGRSPSFLLEIAMNVLSTPAMLSWLSAPTALSPCCLFERKILPERNVMIYHTEFDEFKAELDRRNWHKELTNFMDGSIDVAIVKEFYANLYDSEDNSPKCFEYFSEDPCDHRGGGRATFILQILSSEARPTRTGNQIMHPWDGI

SEQ ID NO: 181638 - protein, 50 aa, Glycine max
  Coding DNA Sequence Number=SeqID_89953
MAVINLGTPHLCSSRFSHHAKCIVGALNDKRELSPQVSLSATAPFSTSRL

SEQ ID NO: 181639 - protein, 38 aa, Glycine max
  Coding DNA Sequence Number=SeqID_89954
MAFFQCYLDYKAQNAQVSNALGNGNVTHTPDIFSKTAT

SEQ ID NO: 181640 - protein, 77 aa, Glycine max
  Coding DNA Sequence Number=SeqID_89955
QPDGHIDVALVKEFYANLYDPEDKSPRQVRVQGKLIKFDAESLNTFLETPMVLEPGERYTTYPRFSSTHPDPQELAA

SEQ ID NO: 181641 - protein, 53 aa, Glycine max
  Coding DNA Sequence Number=SeqID_89956
FCFRVSCFLLKLFVVLLDGVDSAVSLRFVASSPDSRGRVASPTSGGSCQDIAD

SEQ ID NO: 181642 - protein, 114 aa, Glycine max
  Coding DNA Sequence Number=SeqID_89957
  Subcellular localization annotation: CTP_CleavageSite=48; ConfidenceScore=5.71e-01
MWSFAPFPEMSTSSGRDFFKSHKLSRTTSKSLAFVGRPTRSVILTLRSCDMRRQNLVIPHPFAIQTQSCPMARRDKIWSFRTPLPFRHSRVRWYAETKFGHSAPFVSRGGGPAI

SEQ ID NO: 181643 - protein, 103 aa, Glycine max
  Coding DNA Sequence Number=SeqID_89958
MDNEEGVQEQIKADMSAFKDQMASITEAMLKIQKSIEDNATTTTSNTAREAEPVLQPAMNLGQDRSATGFNRRLHSPYRSRRFEPSPYLRGATPSSCRLSSAG

SEQ ID NO: 181644 - protein, 285 aa, Glycine max
  Coding DNA Sequence Number=SeqID_89959
  Homolog annotation: Hit_ID=Q6UUU1; Match level="QueryCoverage=21%, HitCoverage=40%, E-value=4e-18, Identity=78%"; Hit description =Putative uncharacterized protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSICFGVISIIALYCLSSNSYLASFDNTPKTKFLVPVKYEYVVYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 181645 - protein, 20 aa, Glycine max
  Coding DNA Sequence Number=SeqID_89960
LVVSFKTRTRLKRAIKGINS

SEQ ID NO: 181646 - protein, 147 aa, Glycine max
  Coding DNA Sequence Number=SeqID_89961
QHSAQRPQCRSPPVEVSVGLCRSDIGIAPTKTPSGPEEVQQGPGVSSSGYGPLSALQGIVPAKHFVDPEKSNRECLSPPARSSGPPTNRAFIKKYYAPRQAQGETPHQHWDDAPPSPLEFTSAHPQKGLSIAYTTWPTNRRPSPKPK

SEQ ID NO: 181647 - protein, 248 aa, Glycine max
  Coding DNA Sequence Number=SeqID_89962
  Homolog annotation: Hit_ID=Q6WAY6; Match level="QueryCoverage=93%, HitCoverage=38%, E-value=1e-27, Identity=34%"; Hit description =Putative uncharacterized protein
MGTNQTGKRFYQVKVKSLDITSIKELGRIATVVKDSARGLDRIKQTRNGIAGLPQRYLEDKARGMANQGDWVPFMDVLALLIFGVVLFPNVDGLVDLAAIDAFLAYHHSKESPVVAVLADLFDTFDRRCEKSSARIICCLPALCVWLVSHLFQQDTRHPCPLLSHRSCTEKRRIDWDQLLAGIGGRTISWFPRWKEGKEGVLFSCGRYPNIPLVGTRGCINYNPTLAIRQLGYPMRGAPTEESMSPFL

SEQ ID NO: 181648 - protein, 58 aa, Glycine max
  Coding DNA Sequence Number=SeqID_89963
  Homolog annotation: Hit_ID=A0PAV3; Match level="QueryCoverage=94%, HitCoverage=23%, E-value=6e-08, Identity=61%"; Hit description =Restriction endonuclease
MVKVGTSYVPINVSFSPKVGPGLPGINRDTRIYLFCEVIFRHSGFFKLFNTVASRGGP

SEQ ID NO: 181649 - protein, 301 aa, Glycine max
  Coding DNA Sequence Number=SeqID_89964
MLAIIAKYQEELGLATAHEHRIADEYAQVYAEKEARGRVIDSLHQEATMWMDRFALTLNGSQELPRLLAKAKAMADTYSAPEEIHGLLGYWKNTITKRAARDPYRTRSKSRTMGDQEETQEQMKADMSALKEQMASMMEAMLGMKQLIEKNAATAAAVSSAAEADPTLLATTHHPPSNIVGRGRDTLGHDGSPHLGYNRAAYPYGLPPNYSPPILQEDAGHIASPVHEKEPPQQPDEVHKDPQDYARRDVEFYPPIPEGPAPGTLPQPNIAASPIVLSMEGPPPATEERRKLDLLEERLRA

SEQ ID NO: 181650 - protein, 90 aa, Glycine max
  Coding DNA Sequence Number=SeqID_89965
MGKAEEVQKVKADMEAMKEQMATMMEAMMSMNKIMEADAVAVATTRAVAKANPMPPYAIEGQAVGDIPRKTLWRAPQYHPQPTPLTFHSD

SEQ ID NO: 181651 - protein, 284 aa, Glycine max
  Coding DNA Sequence Number=SeqID_89966
  Gene Ontology: Mol. function=catalytic activity; Cellular component =extracellular region; Biological process=carbohydrate metabolic process
  Homolog annotation: Hit_ID=A4WAW0; Match level="QueryCoverage=99%, HitCoverage=50%, E-value=1e-139, Identity=83%"; Hit description =Alpha amylase, catalytic region
  Pfam annotation: Domain name=Alpha-amylase; Domain location=4-280; Score=-106.1; E_value=0.0024; Accession=PF00128.15; Description =Alpha amylase, catalytic domain
MASDDGFSVIDYHEVAPETGAWRDVAELKQSTSLMFDFVCNHMSAKSKWFANYLKQTPGYDDFFIAVDPQTDLSAVTRPRALPLLTPFTLHDGSVRHLWTTFSDDQVDLNFASPQVLIAMVDVLLHYLIEGARYIRLDAVGFMWKTPGTCCIHLEQTHLLIQLFRAITDVVAPGTVIITETNVPHQDNISYFGNGENEAQMVYQFSLPPLVLHAVHSQDVRVLSEWAASLTLPSTNTTWFNFLASHDGIGLNPLRGILPESEILSLVEKLQHEGALVNWKNNPD

SEQ ID NO: 181652 - protein, 58 aa, Glycine max
  Coding DNA Sequence Number=SeqID_89967
MGVQIATRPTWALQKIPPEGCCFWRKQPCSPGRAGNFAKVSTVLRHSSSVLHHSSIFN

SEQ ID NO: 181653 - protein, 71 aa, Glycine max
  Coding DNA Sequence Number=SeqID_89968
  Gene Ontology: Biological process=transposition, DNA-mediated
  Homolog annotation: Hit_ID=Q1J7G7; Match level="QueryCoverage=47%, HitCoverage=48%, E-value=7e-12, Identity=97%"; Hit description =Transposase
MVKVEPLRADQRLISPKVAQGFPVLQWLLFLSAVPPVQLLTGWCVTAKAPPDISAGKCSGHAARNHHTRRA

SEQ ID NO: 181654 - protein, 238 aa, Glycine max
  Coding DNA Sequence Number=SeqID_89969
MTSIFEDLDTLIIKKASSFADLVFASERIEVGLKRGKFDYVTPTGTSNKRFRAIGAKKKEGDAHAVTSAPTWPKPQHTPHDTYQYTQHHPSFSARAGNPSNLAPIQQRTSVQPQRALAQSSAPTQPRPAGDSNPSMSANPGRNPPMKKLPEFAPILMSYGDLLPSLIANQMAVVTPGRIYRSPFPRCPKLDRCGVANIPRRRSKCKDKFACQSWRIDSKRNRRVWTVEVEANEGRGNL

SEQ ID NO: 181655 - protein, 99 aa, Glycine max
  Coding DNA Sequence Number=SeqID_89970
MVQLSTHCCAKPNIFTVSCTLSIGLSVDDVLSATSSLRKFIIVVLSAPSCAKPQIHSLDVTLSLTSQAKRMLQRNFVLQKALSPASPRCSLDITTSSWA

SEQ ID NO: 181656 - protein, 72 aa, Glycine max
  Coding DNA Sequence Number=SeqID_89971
MSWKRTHYFSMPTEKTMIMRGQDIYSSQDIYSSQDEATTSPSFSESEEAKGEGSSEEIYPQEEGQPLMVREE

SEQ ID NO: 181657 - protein, 90 aa, Glycine max
  Coding DNA Sequence Number=SeqID_89972
DSTSDSPQISASPYQLDLAPYASEPYNAQWNAPGLLRDKHTLRSSRILGEMEVDEPWLGLWLPLNYQVVFVIWKCGRQTFVVDLGMAFCG

SEQ ID NO: 181658 - protein, 273 aa, Glycine max
  Coding DNA Sequence Number=SeqID_89973
MAPRKLASKRSRKDKAAEGTSSAPEYDSHRFRSAEHQQRFEAIKGWSFLRERHVQLRNDEYTDFQEEIVRRQWASLVTPMAKFDPDIVLEFYANAWPTEEGVRDMRAWVRGQWILFDADAISQFLGYPLVLEEGQECEYGQRRNRSDGFDEEAIAHLLCIPGQDFARTTAGRRVRIMRTNMTTLTQIWMTLLLSNIQPSDHNSDLPLPKCQLVYAILTRMSIHVAQLIADAIYLFAGMAPTRHPLNPDKSNRALRFPALITGLLPVVRSPRRT

SEQ ID NO: 181659 - protein, 105 aa, Glycine max
  Coding DNA Sequence Number=SeqID_89974
MLAIISKYQEELSLATTHKHRVAGEYAQVYAEKEARGRVIDSLHQEATMWMDRFALTLNGSQELPRLLAKAKAVANTYSAPEEIHGLLSYCQHMIDLIEHMIRNR

SEQ ID NO: 181660 - protein, 130 aa, Glycine max
  Coding DNA Sequence Number=SeqID_89975
MNLRGRQVEIADPLCPFYNNLDEDAAHLFFNCSKVLPLWWETVSWVKSVGAFPKESKDHFMHHSRSNATQTRLFVSLEDDSNTLTAVPDITQITASDNNSNQEEIMTTNSRGNNRPKRNTHKPKYLSDFV

SEQ ID NO: 181661 - protein, 130 aa, Glycine max
  Coding DNA Sequence Number=SeqID_89976
  Subcellular localization annotation: CTP_CleavageSite=69; ConfidenceScore=5.00e-01
PCKVELKDDSSLLVATYQPLPAAFTKQSSCYTKANSFYITCSKLKYSNQNWRNSVGLGWKRMKERLRDRKMQRVQRPTKHEQRVRNRHMRLHDAKNKGEVVAICCSRGWAMQFPCVYEKSRLEIPMAHNV

SEQ ID NO: 181662 - protein, 46 aa, Glycine max
  Coding DNA Sequence Number=SeqID_89977
MNAKRREDMVGVLPKRRILMQHENDHQCEGRVASSRMGLRELLGGR

SEQ ID NO: 181663 - protein, 107 aa, Glycine max
  Coding DNA Sequence Number=SeqID_89978
MNNSSFFQILPRAQPRSVALSGWLAKPADWLSKRMKINEVRHKTVSQPTHRREGDARAHGCVFQGRKTHGVATNVYSRKMSEKPEKTWSMNFKCERFRSCIYMRGRY

SEQ ID NO: 181664 - protein, 91 aa, Glycine max
  Coding DNA Sequence Number=SeqID_89979
MHTQVGKGGGGCRPAHPGELGCFHLKQGNAQNPLEGPRFENFYLHPQLDKLTPHFVFSFFFPSETSRNFTDSTAMGVKHFEVVKQRSHAIK

SEQ ID NO: 181665 - protein, 137 aa, Glycine max
  Coding DNA Sequence Number=SeqID_89980
  Homolog annotation: Hit_ID=A2Q1D6; Match level="QueryCoverage=64%, HitCoverage=14%, E-value=4e-09, Identity=39%"; Hit description =Ovarian tumour, otubain, related
  Pfam annotation: Domain name=AFT; Domain location=45-126; Score= -47.9; E_value=0.084; Accession=PF08731.2; Description=Transcription factor AFT
  Pfam annotation: Domain name=FAR1; Domain location=47-128; Score= -14.1; E_value=0.0021; Accession=PF03101.6; Description=FAR1 family
  Pfam module annotation: Pfam domain module=AFT::FAR1; Domain location= 45-126::47-128
MDEDQRMYDNIMSEEVDMNEENKEEPGVNEENGEEPSVHQHARSVVYDIGFVGVIMRSDTNTEIGGRTSFVLIGCERSEQYKSRKKDLVRKVTGKYGCPFKLRAKLVVGGEGWMVKLICGNHNHALAKSIVGHPYVG

SEQ ID NO: 181666 - protein, 122 aa, Glycine max
  Coding DNA Sequence Number=SeqID_89981
  Gene Ontology: Mol. function=nucleic acid binding; Biological process= RNA processing
  Homolog annotation: Hit_ID=A7P661; Match level="QueryCoverage=58%, HitCoverage=7%, E-value=1e-18, Identity=66%"; Hit description =Chromosome chr4 scaffold_6, whole genome shotgun sequence
  Subcellular localization annotation: CTP_CleavageSite=24; ConfidenceScore=5.24e-01
MVDGGRPKFCHINMSLWSVVPPQRASLEKFTIALAKNMPRHSAMSLSADARMSSFSITRKKTPFQKHREEEEAKKKRAEDETARLYAEFVESFQGDTTPGSKTFVRGGTINPNDKFKDDSEG

SEQ ID NO: 181667 - protein, 546 aa, Glycine max
  Coding DNA Sequence Number=SeqID_89982
  Gene Ontology: Mol. function=phosphoprotein phosphatase activity; Biological process=intracellular signaling cascade
  Homolog annotation: Hit_ID=A7UQU7; Match level="QueryCoverage=60%, HitCoverage=64%, E-value=8e-47, Identity=35%"; Hit description=IMP dehydrogenase/GMP reductase, putative
  Pfam annotation: Domain name=DUF1723; Domain location=146-195; Score =55.8; E_value=1.5e-13; Accession=PF08330.1; Description=Protein of unknown function (DUF1723)
MSDGFCGTHLQIMVRTRGLGRALGQRVTVTADHVDEPVIPDPDVQDDPMEALAAVEDIHADIPADAGIEAAEDQPQGFPGGPSDPSVLTTYADHVACSVWTGEERPELKLSSHGRKVHSLGWPVPAIEGLIAGTGLSPLIGCSVDTGDRGLLSVFVERWHRETSSFHLPVGELTITLDDVSSLLHLPVIGDFHAFEPLHVDDAVQMLVDLLMVSPESAWAETVQCRGPATNVHVVYLEALRDLNMTDRYAWGVAALVHMYDQLNDASMSHSRQLGGYITLLQCWIYEHFSSVAESTADQDYDETSPRACKWIATKKTVKSIRTPSYRERLDRLRIPDVCWIPYGEHWEVRDFHVRSCYSGLLRWGPVAVYYRPERVVRQFGYTQTIPAPPVDSWVLYDDIHDRWMHYEDHIVPAGEVYVVPGACSSDYIDWFFRISHPFMTPGHTIDPLPHGHAPQPRVVPQAPQTDIPRVPESGASSTSAEEPRHAVEVCDDIVKRLERHLSLGVVTLGSSTHEVIEECLRLARSVTQDHLVYVRCRHRRRTDQA

SEQ ID NO: 181668 - protein, 153 aa, Glycine max
  Coding DNA Sequence Number=SeqID_89983
ALRVGVNGIPGHRTRQFLPPFPLDHCFHQRNSVYVKAFYSNLEILEGTLMSEVYGIKMVTDQSLFYDLTQLPSEGVPFEGALIDDWKFNFSVHDVRRLVCTNQADMTRRLLADSLAFESRILHYLIVHILLPRSSNLAQVFEEDLIVMWAFHK

SEQ ID NO: 181669 - protein, 69 aa, Glycine max
  Coding DNA Sequence Number=SeqID_89984
GKDYGELGFWLKACRTAGHDTCQDLASGSGIKGMMRVPRKEYARSRHQRLFEENVRKTGKDAIYELLSE

SEQ ID NO: 181670 - protein, 179 aa, Glycine max
  Coding DNA Sequence Number=SeqID_89985
MAPKNLSAKRSRRDIAAEGTSAAPEFDSHRFRSDEHQQRFEAIKGWSFHRERRVQLRDDEYTDFQEEIARQHWTSLVTPMAKFDPDIVLEFYANAWPQKRECGTCDALSQFLGNPLVLEEGQECEFSQRRNRADGFDEEAIAQLLCIPGQDFARTDAEEARMDEEMTDLLGFLGGSGAT

SEQ ID NO: 181671 - protein, 83 aa, Glycine max
  Coding DNA Sequence Number=SeqID_89986
VRLETAATPERSLEGTSQPPTLVADLSSPQPTADPSTHLLDIPEDPTTPVLALNTSPPATPVLHLTDEEDAQTQDTQDRSQEF

SEQ ID NO: 181672 - protein, 117 aa, Glycine max
  Coding DNA Sequence Number=SeqID_89987
MIVRSFGFDGPYDVYPPHGKRPRGGHDIQGMWRSIDIVRERLTFMAFPYMGTTITFHIEPVITCSQDLPGHSMPIGMRSTRTLMDFLDHVVCFFGIHASQEGHVMLFSYISMATAHE

SEQ ID NO: 181673 - protein, 325 aa, Glycine max
  Coding DNA Sequence Number=SeqID_89988
  Homolog annotation: Hit_ID=Q6WAY6; Match level="QueryCoverage=78%, HitCoverage=41%, E-value=3e-08, Identity=23%"; Hit description =Putative uncharacterized protein
MGTRGCINYNPILAIRQLGYPMRGAPLEEGLTPIIARDFNSTNAGVLQKVCKAWEMMQKKDKELRGSSNGPISGNHGWLKAYTQDLDWLPNLRTTKGVEVEAPEEDEEVHALKTKLEKARTVKEKFKLAAIRIRKENAELRDVNIATTKALEQETKRARSEEHGRNKFRGALWSSNSELKLRREERDQSRVDSLILKNELRICLRSKRSLSQRLCETETNMLAIISKYQEELNLATAHDHKMADEYARVYAKKEAKGRVMDSLHQEATMWTDQFALTLNGSQELPRLLAKAKAMADTYFAPEEIHGLLSYCQHMIDLMAHIIRNR

SEQ ID NO: 181674 - protein, 52 aa, Glycine max
  Coding DNA Sequence Number=SeqID_89989
MPKVVADRLIQATKIWMMPLPVKEDKSGASASGPLMEACLWSFYGGWIFELQ

SEQ ID NO: 181675 - protein, 140 aa, Glycine max
  Coding DNA Sequence Number=SeqID_89990
LFASRDEVLHWARLVACDIGFVAVLCLYDVLDLFKSASGHGPFKCFMVLVLSCVLITDDMILTRSRSLDTGYEDLDDATRITLISLRLVQQGTQREALTKFYENAKSFFLLKTKTNTYSVSEQKDKNRHGPSKQFGPKLR

SEQ ID NO: 181676 - protein, 215 aa, Glycine max
  Coding DNA Sequence Number=SeqID_89991
MTGPLDESISCFLIKVDPWVLVPITFRGPYVLAIRGLHILACRGLHALAFRGLRVLIFSVLHIHTLEEYKFLGHPPDIGGRPTVRAHPEREAITHLVCILGQDFPRAATKRRVRTMHTNMTTLTWMTLLFSNILPSDHNANLPLQMYQLGSRPQDTPWTRRSPIGPWGFQLWLRASVSPTGCPFPQQGIAPTKTPSGPGEVQQGPGVSSSGYGPL

SEQ ID NO: 181677 - protein, 119 aa, Glycine max
  Coding DNA Sequence Number=SeqID_89992
MAVPLIHDRVVMECLEGVWETLEGNERCRFRGTIRLTATSLVHPEPVQVIEVSSSEEDPEEDPEELPPEPAVDALDLPEDDEDPLLDVDFPEDIMSASEADSTKGSGPGGIANSEDSSS

SEQ ID NO: 181678 - protein, 38 aa, Glycine max
  Coding DNA Sequence Number=SeqID_89993
MRILGCLAAVLSVCPELGKGRRSIGRDPSLYLHPSLST

SEQ ID NO: 181679 - protein, 85 aa, Glycine max
  Coding DNA Sequence Number=SeqID_89994
  Subcellular localization annotation: CTP_CleavageSite=31; ConfidenceScore=5.09e-01
MKHLKTYQGNPCGVYPDLSSFTGSGVYPDLSSFTGSGVYPDLSSFTGSGVYPDLSSFTGSGVIQKLYSLYQAIRPVRFTSSVMRT

SEQ ID NO: 181680 - protein, 26 aa, Glycine max
  Coding DNA Sequence Number=SeqID_89995
MGSKKEMKEKDCTPLRCNLYFRTTHI

SEQ ID NO: 181681 - protein, 223 aa, Glycine max
  Coding DNA Sequence Number=SeqID_89996
MAAAYAEGIARGVPEMKTRRNCGMTVSASPHFGASGAQRFFLTHAGRQLFACQLKLIHLPVTSLGFQQFTNGIGINDGGKTVGNHHQRRMVTHGRQRLLDGLLGTGVNTGCRFIQNQNLRRFNQHPRQGEELFLPDGEIVPLLAQLRIDPLTKPARQIRQLHFFQYLPDLLLRVVPPQGHVRIEGIGQDDRILLHHRDAFTQHVVAKRRERTSVDPDFTVRNR

SEQ ID NO: 181682 - protein, 64 aa, Glycine max
  Coding DNA Sequence Number=SeqID_89997
MQSLKRDVYLGAYLNGALNGLDDDPQPKSKAPARWIVVKYFNDPRPLEPERLKVLQIQWAQYYL

SEQ ID NO: 181683 - protein, 271 aa, Glycine max
  Coding DNA Sequence Number=SeqID_89998
  Pfam annotation: Domain name=Transposase_23; Domain location=150-220; Score=5.8; E_value=0.00028; Accession=PF03017.5; Description =TNP1ENSPM transposase
KEKWAQFCQTRRDPSWEKKLEEAAQSGSVDGVIDPPSPVRRHVKWKMARTKKTGEMTTEAAKEIAEKIATQGSFVPHGRQDVLAAAIGRLEHPGRVRAAGAAADPTNQGLARGVHQRESDEAGHGILQPHAVLASVADAISGTCRNDPETGDSDRCGLYIEVDPTRLVAMGRVYEGSTVVHNTPLLPGQVKVSVKEVTDADAPVPVPTDEVSLVGQTLHTFLAWPTHLVKSLSQHVAVSPEKPPPKLDPEVDDPLYLMTLTIPELFLRPYQ

SEQ ID NO: 181684 - protein, 130 aa, Glycine max
  Coding DNA Sequence Number=SeqID_89999
  Gene Ontology: Mol. function=protein binding; Biological process =defense response to fungus
  Homolog annotation: Hit_ID=Q1SWI6; Match level="QueryCoverage=73%, HitCoverage=44%, E-value=3e-24, Identity=56%"; Hit description =Leucine-rich repeat, plant specific
  Pfam annotation: Domain name=LRRNT_2; Domain location=27-67; Score =47.4; E_value=5.1e-11; Accession=PF08263.3; Description=Leucine rich repeat N-terminal domain
MKNLEMDLMEPAMLWLFSLPCRESVCIPSERETLLKIKNNLIDPSNRLWSWNHNHTNCCHWYGVLCHNVTSHVLQLHLNTTFSAAFYDGYYHFDEEAYEKSQFGGEISPCLADLKHLNHLNLSGNYFLGA

SEQ ID NO: 181685 - protein, 46 aa, Glycine max
  Coding DNA Sequence Number=SeqID_90000
MASSSSSGGFDRACALSTTLNRLVRISEFRLSACFSNSVDGLKRCA

SEQ ID NO: 181686 - protein, 139 aa, Glycine max
  Coding DNA Sequence Number=SeqID_90001
MAENLHGFAYENVSDELRKRLSLDFLHGTDFFSENGGGACHPARPGELGCFLQKQPPSAGTSWKAQVGLVPICTPYLLNTPLPFFADSFLMLRNLTDCVTMLPFDFRHVTELHVLCNNGCQVPLSGQAKVVCHQTMVLG

SEQ ID NO: 181687 - protein, 99 aa, Glycine max
  Coding DNA Sequence Number=SeqID_90002
MTDFVSVEDKTQKVYTDNHSGISSRQRDSKVSMTESCERAEDDVNLRMSTGLSAAIDEGQQKTTLSLRAIRLFRLTDNKNFIRITTRVFPPVSVTQKSV

SEQ ID NO: 181688 - protein, 64 aa, Glycine max
  Coding DNA Sequence Number=SeqID_90003
MEAQTRTPQTPTRQCGCSDGSAAYHRSTGDFDTRRKKKNDRVQAQGERRRTIGFKRAGCAISEL

SEQ ID NO: 181689 - protein, 142 aa, Glycine max
  Coding DNA Sequence Number=SeqID_90004
  Homolog annotation: Hit_ID=O52175; Match level="QueryCoverage=57%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTGRHAKAPLAAALVIDLEELVLKSCALRLN

SEQ ID NO: 181690 - protein, 182 aa, Glycine max
  Coding DNA Sequence Number=SeqID_90005
  Pfam annotation: Domain name=zf-CCHC; Domain location=124-141; Score =22.6; E_value=0.00058; Accession=PF00098.14; Description=Zinc knuckle
MKEISQDEKEKIREEERRKILKELRKEKHASYSSHNSCKRLSEELRDYYEGRHRSHLRPHSHRREKERKPNEANINLPYFHGKDNKYQGQGILGVTPSKPKDDKGKTIEKQPLKANMQEKTSSIKCFKCLGRGHITSQCPTKKTMIMKGQDIYISQDEATTSPSCSESEEAKREESSEEIYP

SEQ ID NO: 181691 - protein, 460 aa, Glycine max
  Coding DNA Sequence Number=SeqID_90006
MGFPRLDGAGRRGHRHAAGAGLPLAGQGKPGLAAAGATHGVENRADLAPGQLPVAQRAGLDRLLPRLLAAAQQRFEQVEIVQQFLQRLVADFLRGAQMVQLAALGAQRRQAETPLEVFHRQRILDVVFRGDTPPQHARHPRADLFQHLRIEVLFGIGNQALFHFIHALDRHFGRHGDRHAFFLLAGALVGHLHAAQQQRQRQHADDQRQQDHPGGDKHQLIARREGGAVAQQQRYRQHTGQGNRPAHPGERRHPQLTRAVVAELQRALFHKAVAGLLHYPQPGETQHQQRGVDGGHVGEQVPGLDGRIQLRLQDGGLKNARQLQAQHDEYHAVEHEFQHRPHAVGAQAHRQRRVADHAGLADCHPRRYRRQDAGNADMFGDQVRSERQQQQEYDLGRRIVAAPAAHHPQRFTVGPGDRHAGQQATDRHFEKLEGCAAHGEHHGAHRHRDGELERHQAGRV

SEQ ID NO: 181692 - protein, 323 aa, Glycine max
  Coding DNA Sequence Number=SeqID_90007
  Homolog annotation: Hit_ID=Q84VI1; Match level="QueryCoverage=100%, HitCoverage=47%, E-value=1e-134, Identity=78%"; Hit description =Envelope-like protein
MATSPKETAASGSPAVPSSPHQEQPEFNIQPIQIIPGQASVPEKLVPRRQQGVKIAENPSPATSPREVDTEMDKKIRSIVSSILKDASVPDAEKDVPTSSTPNVSVPDVKKDVPTSSAPNTEALPSPSEEESTEEEDQASEETPAPRAPEPAPGDLIDLEEVESDEEPIANRLAPGIAERLQSRKGKTPIKRSGRIKTMAQKKSTPVTPATSRRSKAAIPSKKRKEISSSDSDDDVELDVSTSKRAKKSGRKVPGNVPDAPLDNISFHSIGNAEKWKYVYQRRLAVERELGRNALDCKETMDLIKAAGLLKTVTKLGDCYEGL

SEQ ID NO: 181693 - protein, 50 aa, Glycine max
  Coding DNA Sequence Number=SeqID_90008
MEAGSLSFNEVLQWKRRRGEGRHHPLGNKPRKKELHHQELPSIRSLKRML

SEQ ID NO: 181694 - protein, 94 aa, Glycine max
  Coding DNA Sequence Number=SeqID_90009
MRHRIPVIGGIMNVLSSATIFCKITHASNIFMIHIHSDSLGVEGRSPEFQEPLDLRSNPFQGGGNDAILPPQGYWIEDSKKIGPKMQKKALGFS

SEQ ID NO: 181695 - protein, 230 aa, Glycine max
  Coding DNA Sequence Number=SeqID_90010
  Homolog annotation: Hit_ID=Q6WAY6; Match level="QueryCoverage=37%, HitCoverage=15%, E-value=8e-10, Identity=40%"; Hit description =Putative uncharacterized protein
MGTRGCISYNPVLTIRQLGYPMRGAPLEEELAPIIARGFNKTNMEALQKVRKAWEMVQKKDTKLRGNNNGPIGSYRRWLKARMQSLDWLPSLRTTKGVEVEAREEDEEVQAHRAEFEQAQSVKERFKSAALKIRKENAELRDDELKVCLRSKRSLSQHLCETETNMLAIISKYQEELNLVTTHEHKVADEYARVYAEKEARGRVIDSLHQEATMWMDRFAFTLNESQELP

SEQ ID NO: 181696 - protein, 88 aa, Glycine max
  Coding DNA Sequence Number=SeqID_90011
MVAVGDGESAWDIRNGFGRKKGEEMAFFLSYTKAKAELLAHSRYLLKDLNGQIMDNCLVKLQTKFREDPTVNEGWEAFLPRRLHVAFS

SEQ ID NO: 181697 - protein, 212 aa, Glycine max
  Coding DNA Sequence Number=SeqID_90012
  Homolog annotation: Hit_ID=A5AG09; Match level="QueryCoverage=38%, HitCoverage=7%, E-value=8e-10, Identity=41%"; Hit description =Putative uncharacterized protein
MILEDKSMSEFLLRIKAISKALALVKISVSLQEHIDAILEGLLQDYHFVISVIESKFQPLPIEEGKALLLGHEARLLKFRRLLIRQIGKSVVFTFSISQFVGLASIPKRDTQWLSARKKLEEDELSGSLSAPLQVIKRTPLAHPLSETSALSQNTVMHPKQFRFELSVSLAFFLEKPLLARESSLGLKLLHVKEVLERERSKFQKVLRDFAV

SEQ ID NO: 181698 - protein, 143 aa, Glycine max
  Coding DNA Sequence Number=SeqID_90013
MKVHSEVFVLNGNVDSNTELVADETGLHKIVGTPTVNQNNHGFIGDPTQHSVGLWGQGCILMFGNEDEEFRGAMVATGELLVTVEVESSLSAYHHFLRKNGCEEDDDDQPVSLRATRRGLPHASWLRAKQLEPHDESKEISPR

SEQ ID NO: 181699 - protein, 143 aa, Glycine max
  Coding DNA Sequence Number=SeqID_90014
MAAQFIHDRVEMECLEGVWEILEGNARCRFCGTIRLTATSLVHPEEPARTLQRTVEWILPTPTPYRLVEPIQVIKVTSSEEDPEEDPEELPPEPAVDVLDFLEGDEDPLPEVDSPEDVMSASEADSMEESGPGKMATSGGSSS

SEQ ID NO: 181700 - protein, 175 aa, Glycine max
  Coding DNA Sequence Number=SeqID_90015
MRIRATWEYVSSVKGGQLGMVGSCVICGCGELFCTIARSPPSTTCDGVVPRDMSQGSGDLGDVRRAPGSQPIKEQRPQSKEAYVVAGQLLRNGTGMLKGPLVIDYQCCVIDYTEEQLCNSSLASGNRLPRLCNRLLMQSYPARALGRRLQVDWARDPREGPRILMSLRVDFEPMS

SEQ ID NO: 181701 - protein, 122 aa, Glycine max
  Coding DNA Sequence Number=SeqID_90016
MTAPPDSIPSVEQFNEMVAFPGPNLLFIGKTKATIPEPFDIGEEAEETQVRQVAAATPERSLEATSEPSAPVVNPPSPQPAADPSTPLLQMPKDSTTPVLAVDTSPPTTSMLQLTDEEDGQT

SEQ ID NO: 181702 - protein, 134 aa, Glycine max
  Coding DNA Sequence Number=SeqID_90017
MFVPKGAKYLEAVKQRLHAMKQWSPDEIRGPYNQQGQWRTHPGNQFNKDQSGTSNRPIPQGPNIFQRTTKLEEILTQFMQVTMSNHKSTETTLNNLEVQMGQLAKQIADKSSNNFVANTEQNPKEGMQNFDDKE

SEQ ID NO: 181703 - protein, 119 aa, Glycine max
  Coding DNA Sequence Number=SeqID_90018
MDSRDGGYCRGGGGVSVAGCYYWSCPSSFVCLGMQYFSMNDLLMGDKLGYTNTDLGQNSINQLAFRQPEIRVMVVGKDVAEEKHHSDLCLGGHASAHDPHPPWIFFINGVLCFLKFNGN

SEQ ID NO: 181704 - protein, 127 aa, Glycine max
  Coding DNA Sequence Number=SeqID_90019
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPNEDVPYVLKIGLIHLLPKFHGLA

SEQ ID NO: 181705 - protein, 403 aa, Glycine max
  Coding DNA Sequence Number=SeqID_90020
  Gene Ontology: Cellular component=integral to membrane
  Homolog annotation: Hit_ID=A6X690; Match level="QueryCoverage=67%, HitCoverage=99%, E-value=1e-145, Identity=96%"; Hit description =Putative uncharacterized protein precursor
  Pfam annotation: Domain name=Alph_Pro_TM; Domain location=41-274; Score=447.6; E_value=1.7e-131; Accession=PF09608.1; Description =Putative transmembrane protein (Alph_Pro_
MRGLTLSSALIFLLMTGSALAQVDSSGNGNTVPQLQNPADETIEIGLSTETIAITSNFGGTDLTIFGALDNADPTIQRQGRYDIIVVLQGPSRDLVVRKKDRYLGVWVNAVSETFMGVPLSYSLASTRNLQDITDEKTYRQLSVGVRNFYLVPEDPASLSGNIPRFGNELREMKIRQGLYTQRIGGVEFISRTLFRATLNLPANVPVGRHKARALLFRNGVFLREANASLEIVKAGFEQSIYNAAHQNSFLYGLFAVFLAVFTGWFGRILFRSRQRTVLGKRDPKYSAHPCPAISPCPALRDGSCRKVSGPTASSSTQSPGRPHRAIRIMIASDPEPVPMLHKRFQPGWNKATAGVRWPSHRENCHQGLMTGSRLIARNGQRQHVERRRCVIRRDELAAPGKG

SEQ ID NO: 181706 - protein, 148 aa, Glycine max
  Coding DNA Sequence Number=SeqID_90021
MGARCHQTPTREGHAPVWIRLEYSCRGCCFMGVIEEIDDSWMHYSDHLASAGEICLVPGQCAPDYMDWFFVPEPPTTLTHARSDVDQTRHAVDACHAIAERLERLLNLRIVTVGTETHEVMEQCIKIARGVIEDHIVYVRSRRRRRTD

SEQ ID NO: 181707 - protein, 74 aa, Glycine max
  Coding DNA Sequence Number=SeqID_90022
MPISPCESIGWFVPFQHRDRAHNTLGGPGGAQQGPGVSSSSYGPLCQSYRVPVPPTKGSRPQDTLWTRRSPTWS

SEQ ID NO: 181708 - protein, 189 aa, Glycine max
  Coding DNA Sequence Number=SeqID_90023
MAYSELWPSLLENHLVVAIPGKVFQPPYPKWMTLLLNNVLPSDHNSDLPLLKCQLVYAILTRMSVHVAQLITDAIYLFAGMPPTRHPLDPDKSNRALGFPALITGLCQSFGVPVTPSKVIRPPITRAFIEKYCTPRQTQGDAPQAADAPPPPHQANPAGSFGMERYLQYLVRQQAANHRGQVQIHECLY

SEQ ID NO: 181709 - protein, 120 aa, Glycine max
  Coding DNA Sequence Number=SeqID_90024
  Subcellular localization annotation: CTP_CleavageSite=76; ConfidenceScore=5.60e-01
MPISPCRCISWDSAHKTPSGPKKSNRALGFPALVMGLRSPTGCPSPQRGHAIVTYVRSRPQDTQWTRRSPTGPWSCQALITGLCQFYEVPVTPSKVIRPPTNRAFIKKYCALRQAQGETP

SEQ ID NO: 181710 - protein, 95 aa, Glycine max
  Coding DNA Sequence Number=SeqID_90025
MGIAPQDTQWTWKSPTGPWGFQLWLRASISPIGCPYPPDKGSRLQDTQWTRRKYLSPPARASGPQLIVLLSRSVAPPGRRRAKHHSSIGMAGSGQ

SEQ ID NO: 181711 - protein, 128 aa, Glycine max
  Coding DNA Sequence Number=SeqID_90026
MTYDHPFVHPEAAGPMTSRDKIWSFCTLVSSRGGGPDDTRRYLTVICTLVSSRGSGLDDTQRYLMVICTLVSSRGGRPDDTRRYLTVIRTLVSSRGGGPDDTRKYPSGYPYKLSFAICKTERLIACRD

SEQ ID NO: 181712 - protein, 124 aa, Glycine max
  Coding DNA Sequence Number=SeqID_90027
  Homolog annotation: Hit_ID=A0PAV3; Match level="QueryCoverage=30%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVRNGKSTPRTSALASVAVPPARNHHTPPRLMRRYRARPIRHSGCATVGKGDRCGPLRYYASWRKGDVLQGD

SEQ ID NO: 181713 - protein, 219 aa, Glycine max
  Coding DNA Sequence Number=SeqID_90028
  Homolog annotation: Hit_ID=UPI0000E21CD7; Match level="QueryCoverage =70%, HitCoverage=56%, E-value=6e-09, Identity=34%"; Hit description =PREDICTED: similar to coagulation factor V
  Pfam annotation: Domain name=Cornifin; Domain location=9-216; Score= -44.9; E_value=0.041; Accession=PF02389.6; Description=Cornifin (SPRR) family
MSSPSEDYMSSPLEDYTSSPLGDYTSSPLEGCTPSPSRTMRPHLHRATHPHGYTRSPLEDKGYTSSPIEDYTSSPLEGYTSSHSEHNTSSPSEDYTSSPSKGYMSSPLEDYKSWPLEDYTSSPSEGYMPSPSEHYTSLLSNGYMPSPSEDYTSSPFEDYTSSPLEDYTSSPSEGYTSSPSGDYTSSPSEDYSSHLQRVARPRLHRATRPLLQTTTRPRL

SEQ ID NO: 181714 - protein, 238 aa, Glycine max
  Coding DNA Sequence Number=SeqID_90029
  Gene Ontology: Mol. function=sulfate transmembrane-transporting ATPase activity; Cellular component=outer membrane-bounded periplasmic space; Biological process=sulfate transport
  Homolog annotation: Hit_ID=Q1H3Q5; Match level="QueryCoverage=38%, HitCoverage=46%, E-value=1e-27, Identity=64%"; Hit description =Diguanylate phosphodiesterase
  Pfam annotation: Domain name=EAL; Domain location=66-238; Score= -97.8; E_value=0.00039; Accession=PF00563.11; Description=EAL domain
LAENPVALVDKVVDKKGTRKVAQAYLEFHFSPQGQAIAAKHYLRPQEGIIMTQRQPNQEPHHVIQLRAELKQALSLDLEELGLLEASSGEYESTFIGVHLKTAFQPIYDAKQGDIYGYEALIRPSLFGTLGSTPEFAFTYAEQSGKLVQFDRVCRSQHVLNYRAIHQENGLLFLNVHPKLLLEVSAHGKVFEQILHKYSVPTHRVVLEINESLIEQDKHLISAIENYRSLGYRIAFDH

SEQ ID NO: 181715 - protein, 134 aa, Glycine max
  Coding DNA Sequence Number=SeqID_90030
  Subcellular localization annotation: CTP_CleavageSite=52; ConfidenceScore=5.10e-01
MVKVGTSYVPINVSFSPKVAQGFPVSTGTPGFIYFCEVIFRHQVLQWLLFLSAVPPVQLLTGVVRNGQKHRPDISAGKCSGPAARNHHTPPRLMRRYRARPIRHSGCATVGKGDRCGPLRYYASWRKGDVLQGD

SEQ ID NO: 181716 - protein, 81 aa, Glycine max
  Coding DNA Sequence Number=SeqID_90031
FVPYTSRLYRAQWNVLKLLHDMHMLRSSRILEKMEAFCCKIPSLVGVLVCAKGMTFVDDWVVGNEKGRYWLSDDIIGLGIL

SEQ ID NO: 181717 - protein, 63 aa, Glycine max
  Coding DNA Sequence Number=SeqID_90032
MSEEVDMNVKNEKDAGVKVEHVNCSDTFNTSQTFFELCYSCLLPVMKSYIGLEKWLKKLDLLS

SEQ ID NO: 181718 - protein, 157 aa, Glycine max
  Coding DNA Sequence Number=SeqID_90033
MASMMDAMLGMRQLMENNMATAAAVSSVAEADPTLPATAHHPLPNVVRREKTTLGHISKPIWDTTGWLTLMDYHLITCHQSCVMTRVMFLPSSLKGSLLDSRTRFTRIIESMPKETSISTPRSPSRGRHPTYCLSPTSQYNQYSCPQKDHPQQWKKE

SEQ ID NO: 181719 - protein, 90 aa, Glycine max
  Coding DNA Sequence Number=SeqID_90034
EEAKGEESSEEIYPQEEGQPLMVKDECKETLVSIATSLRLEFIPQVKELLDEGVEGRSPEYEEPRDLRSNPFQGVGNDAILPARALVEDS

SEQ ID NO: 181720 - protein, 131 aa, Glycine max
  Coding DNA Sequence Number=SeqID_90035
METCPAVEELLQRLMDWGQLEVSKGDREEPQICMQSEEKKVPPTPKALVICFTRNGTGSRPMYPPIAPKPTPFAYQSNKVIPWKYTPPAFGERVAIEVDSLSAKVTNITGLSGITHSGWVFAPPHSAKLPS

SEQ ID NO: 181721 - protein, 213 aa, Glycine max
  Coding DNA Sequence Number=SeqID_90036
MEASLCIPGKGFILNMEGQPWKLLRKDLTTLAQTWSVFSYSNLAHTSLISDLNTDRARSVYGLITRMDMNIGGLISRQMTMMAQSNSSRLGFPALITSLCRSRGVGSDALTSYENLRLELAQQRPIMSVEQFMKRWPGLEPDLLSIIPEAVEFSKRKLETRSNEVAHPGPVPVPADVPFPGALDTSPPTTSVLHLTDKEDVQAQDTQDQLQEF

SEQ ID NO: 181722 - protein, 73 aa, Glycine max
  Coding DNA Sequence Number=SeqID_90037
MTAKAAEENVSLRRSVGSFAPGAEDDVSLRASMDSFAPGEEDDVGLRASTGSFPLVDDRCGNHKVTQHVTCVH

SEQ ID NO: 181723 - protein, 75 aa, Glycine max
  Coding DNA Sequence Number=SeqID_90038
MAPKHMEQLTQKIRDQLEESITEKVTRQMQSQVLTLPPEPVDFWSFSYSCQTKENVVIWFCSLHNRLDFDKSERN

SEQ ID NO: 181724 - protein, 119 aa, Glycine max
  Coding DNA Sequence Number=SeqID_90039
  Gene Ontology: Mol. function=sequence-specific DNA binding; Cellular component=nucleus; Biological process=regulation of transcription, DNA-dependent
  Homolog annotation: Hit_ID=Q56NI6; Match level="QueryCoverage=79%, HitCoverage=39%, E-value=6e-23, Identity=57%"; Hit description=MADS box protein M3
  Pfam annotation: Domain name=K-box; Domain location=18-113; Score =71.7; E_value=2.5e-18; Accession=PF01486.8; Description=K-box region
MSISIITKIIERYRQCRYSKSHTGDSLEHDSQSAYHEFLKLRAKYESLERTQRHFQGEDLEPLSFKDLQSLEKQLDITLALTRQHQTKKLMARADELREKDLNMLHFSHGSSPCGTFYT

SEQ ID NO: 181725 - protein, 80 aa, Glycine max
  Coding DNA Sequence Number=SeqID_90040
  Subcellular localization annotation: CTP_CleavageSite=46; ConfidenceScore=5.16e-01
MASSVRNGCVTGKPLVRLATSPLVDLATSTGESASGFTNRWFDWRLASAGGAVVGLLFQRKGSCNSHWRVKAKLQLPLTS

SEQ ID NO: 181726 - protein, 97 aa, Glycine max
  Coding DNA Sequence Number=SeqID_90041
MNQIEEIFRKGGRGKTRSPTTLMTLSTSNPSEVERINAGGWWRGSLLVDGGEDRCKGQRCRENGCSHLEQHQRLQLQGATLVMREERKGFGEKGLDV

SEQ ID NO: 181727 - protein, 140 aa, Glycine max
  Coding DNA Sequence Number=SeqID_90042
MKQLKREEARKHDAELYLNRLRIAQGLALSIECGPCVVTAEARGFSQQLLRRDVLLGPPPLLRNYVPPKSPARISMSSSLTVAVRGNDHSINGWAMAEQGLVLDMHAIMVLDTLASEPRRNTAQREKGRFGIEKTLGGAR

SEQ ID NO: 181728 - protein, 382 aa, Glycine max
  Coding DNA Sequence Number=SeqID_90043
  Gene Ontology: Mol. function=oxidoreductase activity; Cellular component=cytoplasm; Biological process=response to gibberellin stimulus
  Homolog annotation: Hit_ID=O04280; Match level="QueryCoverage=99%, HitCoverage=99%, E-value=0.0, Identity=94%"; Hit description =Gibberellin 20-oxidase
  Pfam annotation: Domain name=2OG-FeII_Oxy; Domain location=226-325; Score=166.3; E_value=8e-47; Accession=PF03171.11; Description=2OG -Fe(II) oxygenase superfamily
MAIECITNIQSMSQPQKHHQEHKEDEAPLVFDASLLRHQLNLPKQFIWPDEEKPCMNVPELGVPLIDLGGFLSGDPVATMEAARIVGEACQKHGFFLVVNHGIDANLISNAHSYMDDFFEVPLSQKQRAQRKTGEHCGYASSFTGRFSSKLPWKETLSFQYSAEENSSTIVKDYLCNTLEKEFEQFGRVYQDYCDAMSNLSLGIMELLGMSLGVGKACFREFFEENNSIMRLNYYPPCQKPDLTLGTGPHCDPTSLTILHQDQVGGLQVFVDNEWHSISPNFNAFVVNIGDTFMALSNGRYKSCLHRAVVNSKTTRKSLAFFLCPKGDKVVSPPSELVDDLTPRIYPDFTWPMLLEFTQKHYRADMKTLEAFTNWLLQRKMS

SEQ ID NO: 181729 - protein, 205 aa, Glycine max
  Coding DNA Sequence Number=SeqID_90044
MESLLRCRFLHAKRNKFGLDRARVWWHDKMAWGGWAGPHEEERLHRKIMDYPRNYLNFGPDLTQNEVGMLLHEEVNLRWKTTWCGIAWSLWNVGNNKVFRGKAFNKDEALQKIMFHAWEWLRTYNSSFLYSFSQWSSNPGACIKNRSTLAPTVVWLGFGTALVWFGKANVIRACGGVIRMLCALISAGYVILPLIDKYVHVVGVA

SEQ ID NO: 181730 - protein, 114 aa, Glycine max
  Coding DNA Sequence Number=SeqID_90045
MSGYHVVIHTFLLSRDGKSDDVRGDDKYDGMRGYRMVIRTFGHLETASPMTCGDGEFDDMRGYRMVIRTFHQPGANKPVDAQGLTSSSAQFIIQGASKPVDVQGLTSSSAPFFI

SEQ ID NO: 181731 - protein, 82 aa, Glycine max
  Coding DNA Sequence Number=SeqID_90046
MKLASTKDGPAISTKLMKLDFALVSFNLKIRNSVSDGKTWHFGCREVTCVIDQNVKLNKEEFRYDDGFNYYKKSDFDASLSK

SEQ ID NO: 181732 - protein, 56 aa, Glycine max
  Coding DNA Sequence Number=SeqID_90047
  Subcellular localization annotation: CTP_CleavageSite=26; ConfidenceScore=5.24e-01
MDVLCLVGTSVKPTKHRGRARKASIAARSIKPSTFGKRTTPKISKANTSINGTQSP

SEQ ID NO: 181733 - protein, 142 aa, Glycine max
  Coding DNA Sequence Number=SeqID_90048
  Subcellular localization annotation: CTP_CleavageSite=49; ConfidenceScore=5.17e-01
PAHPGNGSAGGRGQRAGRAPHVAWCPVRPRRPLKIRRTECLPRPVVLITASGLQGEQPLVDGTIPEPVGCRWTARAASAARAGRRVPVGGRIGNGPFGASSPGVEQSTQNCALNVKVKKFNQARVNGGSNYDSLKVAKCLVI

SEQ ID NO: 181734 - protein, 70 aa, Glycine max
  Coding DNA Sequence Number=SeqID_90049
MWYHPQENSLSVSTRHSHLGKLGSKCRGHPMMQSYPPRALDSRLQEDWAKDAREGPRVLMSLRVDFGPMG

SEQ ID NO: 181735 - protein, 242 aa, Glycine max
  Coding DNA Sequence Number=SeqID_90050
  Subcellular localization annotation: CTP_CleavageSite=57; ConfidenceScore=5.78e-01
ACASGGGLSAFAGCPAPFVGCRTASRGWFRRRWSSRSPLPAGRPRSALVRGRAAAVAASAAGSSGHAQSARRAPAPGADGGAGRQHPQRVAVGHLVQHEEAGGFFGYHHVRARLQLIEARAQFAFWHGDQIELQIGVVGGIDVGVGALHPFAVDLQRQLGELPGGERIDGGIDHQAEQPVGPLFYLRNLAAVKQLQLGIAQATAAGAGHADRAVVFHQQRAVRVVEQFSHVTVMLPQAHQSG

SEQ ID NO: 181736 - protein, 78 aa, Glycine max
  Coding DNA Sequence Number=SeqID_90051
MSEIGRFGGLRMEERRKEEGAAQGFLKNVIFIDQDAWWRQPTGNRLHEDCNRLQAICSSVIDYSIHVIDYQNKTIAFS

SEQ ID NO: 181737 - protein, 75 aa, Glycine max
  Coding DNA Sequence Number=SeqID_90052
MGQLQRQAFRKAYGVRPRKASRKWGGWGTKKIFGSKGKILGKSRRMGPIHGHPGTFDIRGGPLSKCGWVGGPGSD

SEQ ID NO: 181738 - protein, 149 aa, Glycine max
  Coding DNA Sequence Number=SeqID_90053
MSDQEEVQEQMKVNMSALKEQMTSIMDAMLGMKQLLESNAVTAAAVSSAAEADPTLPTAAPHPIPNMVGREKSMPRHVSNPHLQYNQGAYPYGLPPNYTPPVIRDDAGHIPSLILEGEPPRHPDMVHEDHREHAQGDIDSYSSFPTEGP

SEQ ID NO: 181739 - protein, 120 aa, Glycine max
  Coding DNA Sequence Number=SeqID_90054
  Homolog annotation: Hit_ID=Q5XM22; Match level="QueryCoverage=85%, HitCoverage=57%, E-value=1e-25, Identity=56%"; Hit description =Resistance-like protein HAAS-2
MLMLVDLLLVSGEVDRAETAHCHGPYIRLSWLRDIYQRRCQAGHWTAIARAYLFHLLGCTLFANKSATHVHVVFLDALCDLGQTGRYAWGVAALVHMYDHLNDACISTSRQLVGYITLLQ

SEQ ID NO: 181740 - protein, 151 aa, Glycine max
  Coding DNA Sequence Number=SeqID_90055
  Homolog annotation: Hit_ID=Q6WAY6; Match level="QueryCoverage=64%, HitCoverage=16%, E-value=3e-08, Identity=37%"; Hit description =Putative uncharacterized protein
NGVVGIPRQCLEERAKALADQGKWTSFVDILALLVFKIVLFPNVDGLVDLAAIDAFLAYHYSKESPDIAILADAYDIFNLRCEKSNARIVCCTPALYVWIPKHPFDGNKGVSVKAMQKCFRESKKHEIQWKEKIKSLGEAATVSSGAIING

SEQ ID NO: 181741 - protein, 47 aa, Glycine max
  Coding DNA Sequence Number=SeqID_90056
MEVEEPWLGLWLLLNYRVDMGSSLAYDNGTWGGLRHWKCGRQALWLI

SEQ ID NO: 181742 - protein, 24 aa, Glycine max
  Coding DNA Sequence Number=SeqID_90057
HVAPHATRLLGHGNKKWGGQQGIL

SEQ ID NO: 181743 - protein, 73 aa, Glycine max
  Coding DNA Sequence Number=SeqID_90058
HLSGPHESSLQGLKKNWPRGELAVASHPLEPHQGTTIHIKRSNGQAFMGYMFLKALFKTRKSKIFKMDDQDSL

SEQ ID NO: 181744 - protein, 16 aa, Glycine max
  Coding DNA Sequence Number=SeqID_90059
MATQRTRDGTIEIAPK

SEQ ID NO: 181745 - protein, 290 aa, Glycine max
  Coding DNA Sequence Number=SeqID_90060
  Homolog annotation: Hit_ID=UPI00006A2D9E; Match level="QueryCoverage =37%, HitCoverage=85%, E-value=3e-09, Identity=19%"; Hit description =UPI00006A2D9E related cluster
RVHALTFRGLARPRLQRAARPRLQRTARPHLQRATRPHLQRGLHALAFRGLHVLAIRGLHVLAIKGLHVLAIRGLHTLAFKGLHTLSLRRLHALAFRGLRVLTFRGLHALAFRGLHALTFRGLHVLTFIGLHTFSFSGLHALAFRGPDAPAFKGSVPGPPADPGGGPTVRAQLEEEAIVSTTMHTGERFTRAVTKRRGSRPQDTQWTRRSPQGPGVSRCPSPPARSYHRDIGIAPARHPVDPKKSSRVLGFLALITGLCQFYEVPVAPNKVTRPPIKRAFIKKYCAPRQA

SEQ ID NO: 181746 - protein, 157 aa, Glycine max
  Coding DNA Sequence Number=SeqID_90061
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=54%, HitCoverage=71%, E-value=1e-24, Identity=69%"; Hit description=LacZ protein
MVPQTQTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSGTATLASADVRGVLLPLRTTPSVAEQGGTADRNRSHWSTSKTPSYTKS

SEQ ID NO: 181747 - protein, 73 aa, Glycine max
  Coding DNA Sequence Number=SeqID_90062
MLLSSNVIHICVRVVKLVRMIHTRLFAVARVKSCPGMHSNCVIASLFGCARTVGRPQLSGGGLGTDKRKLLAP

SEQ ID NO: 181748 - protein, 231 aa, Glycine max
  Coding DNA Sequence Number=SeqID_90063
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
LAQGFPVSQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLKVFNWNMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 181749 - protein, 49 aa, Glycine max
  Coding DNA Sequence Number=SeqID_90064
  Gene Ontology: Mol. function=electron carrier activity; Cellular component=integral to thylakoid membrane; Biological process =electron transport
  Homolog annotation: Hit_ID=P49161; Match level="QueryCoverage=100%, HitCoverage=15%, E-value=1e-14, Identity=88%"; Hit description =Apocytochrome f precursor
TGSIIEIVANCLANKPVDIEVPQAVLPDTVFEAVVRIPYDMQVKQVLAN

SEQ ID NO: 181750 - protein, 143 aa, Glycine max
  Coding DNA Sequence Number=SeqID_90065
MAAQLIHDRVVMECLEGVWETLEGNERCRFRGTIRRTATSLVHPAEPARTLQKPVEWILPTPTPYRLVEQVQVIEVSSSEEDPEEDPEELPPEPAVDALDLPEDDEDPLIDVDSPEDIMSASEADSTEESGLGGTANSDNSSS

SEQ ID NO: 181751 - protein, 72 aa, Glycine max
  Coding DNA Sequence Number=SeqID_90066
DRSTGQQRPSTAAGPQAYANLLGQVLFHPSFLGAHLHLLKGIREGHNAGWRSSGKENPQALDSLEGLGNEPG

SEQ ID NO: 181752 - protein, 783 aa, Glycine max
  Coding DNA Sequence Number=SeqID_90067
  Gene Ontology: Mol. function=aspartic-type endopeptidase activity; Biological process=DNA integration
  Homolog annotation: Hit_ID=A5BZB2; Match level="QueryCoverage=5%, HitCoverage=6%, E-value=5e-14, Identity=82%"; Hit description =Putative uncharacterized protein
  Pfam annotation: Domain name=RRM_1; Domain location=160-230; Score =9.1; E_value=0.021; Accession=PF00076.13; Description=RNA recognition motif. (a.k.a. RRM, RB
TPGKGILFKQNKSVSLEAYADADYARSVVDRRSTTGYCTFLGGNLATTEEYADVTGRGGETEIGGKRNIPHVVGAIPESCGMKETNGSSKGGNQEHNRHYEECWNKNVNDDRLGTKEEWTKVISRREAKTVKKIIPENRTTHNLSSKRPNWRDKEDITSFYFTNFTDDVNEVWLWEKFKTWGDVREVFIAKRCNKEGRRFGFGRFKGVSDVKILETHLDNIFIDDHKLFVNLPRFTRLASNLQTHTRVDKGGKQNKEDVKGLPVVGQKGVSGGTMTGADGTPTITIEPTKGRDFWCKGAWVGKLKKPMKMEKMEDYISWELGYNISTRFLGDDMVLLIGLSEDQAQQLINSEINGGNTLFYSLERWRPGYRSSNRVVWLQLWGFPIEAWEVDHMKHIVSTIGDVIEADEDTEDRRRLDRARLLVRTPLPPAISKEVKVRCGGEDHRVWLVEEVGVDGDAWRTKTSMSEEWTEEITSEEEGVDAEEDDDDTSFSYSSELSATNNKASSNHQSNDLPSGFYGQSRNRVDPVDNNPFFDACKHSAGDAARHVQDSTLAKVDQRTAGAEKKQGNISSEVITLDPVIVGPRKAEEDQDGKFLNSEEAARNQINIQGAYKTCATDTRYYHDISQTQGQKEIGPSSISGPIKILEECKKKKHIILTQASKRNMDWFPKVYARQRHAPSKGCLLMPVAEENTSLMEDKADPGLKDNLFKGTNRSNTVEMEEINSVDGNSLEEFEEANQQWILAKSLGLQHESDQDGIHSFKNMEIRDRKEALQLGNKNIHR

SEQ ID NO: 181753 - protein, 151 aa, Glycine max
  Coding DNA Sequence Number=SeqID_90068
MPTQTLTPSSPPPTTTGGHHEPPLLAAEPPHLEECFNRSGILRIHLKDSVENNPSNPFFGSFSEEEYLYLEACHSVWNSFETQAEHHGGGGSFLCTQGDLDTYYLVFLSESVVWTHLGYFLKDGTTLHLNVEKDNSRVREVGFFCGAAKPM

SEQ ID NO: 181754 - protein, 96 aa, Glycine max
  Coding DNA Sequence Number=SeqID_90069
IPEHKGWVVPVWFRLCNGFYKDSGNLKPQGPTPPTGESGGSTASPVGELGGATVSPDGKSEMIIRGGDGGTTSSIGEEGGFTTGDCGSVGYGSTRA

SEQ ID NO: 181755 - protein, 95 aa, Glycine max
  Coding DNA Sequence Number=SeqID_90070
  Gene Ontology: Mol. function=motor activity; Cellular component=cell projection
  Homolog annotation: Hit_ID=A2FDT0; Match level="QueryCoverage=86%, HitCoverage=17%, E-value=3e-09, Identity=38%"; Hit description =Putative uncharacterized protein
GLHALTFRGLHVLTFRGLHVLTFRGLHVLTFKGLHVLPFRGLHVLAFRGLHVLHFKGLHVLPFRGLHVLAFRGLHALAFSGLHIRTLREFEVFYP

SEQ ID NO: 181756 - protein, 131 aa, Glycine max
  Coding DNA Sequence Number=SeqID_90071
  Subcellular localization annotation: CTP_CleavageSite=64; ConfidenceScore=5.16e-01
MERCTWFYNGEAFTSAAIPSATATTMLTKYTILNPKSTISSTNAFITPVSQPTLRREGDTGLTGASSKGGRCSESPPMFIRGKCQKNRNVWSTNFKCERALDGRLQEDWAKDAREGPRVLMSLRVDFGPMG

SEQ ID NO: 181757 - protein, 80 aa, Glycine max
  Coding DNA Sequence Number=SeqID_90072
MPLRDDDDDDYYHHHHHHHHHHHHHHHHHHHHHHYYYYYYYYYYYYDDVLGTLFFLSYEYKFKDPIETKNCKSENTDLQR

SEQ ID NO: 181758 - protein, 148 aa, Glycine max
  Coding DNA Sequence Number=SeqID_90073
MAPKKLLAKTARKDATGEGSTIKGWSFLKERQVQLREGEYAKFQEEISRRQWTQLAEPMAKYNPEIVMEFYANAWPTEEGGQHCEFSQRSQTSGFDEEAIGQLLDHAFQTPSGPREVQQSTEVFSLDHGPLPVLWGASYSLKAYPAPH

SEQ ID NO: 181759 - protein, 244 aa, Glycine max
  Coding DNA Sequence Number=SeqID_90074
DNPNVKTNPLTGHGGSAVNAVEEWEPRGPKRMEDMLTSRRFILEALCEAGMIRLDGNKGDSCLIHLGASHDVETCPMAGELLQGMMDRGLIEVCSARKGEGDVCMQSIHKSSSKPKPLVIHFTRDVATHKPRGFQSVPVKKPTPSPYKSDKDDLSSTKVTNIFSTSGMTCSGRIFAALEPLVRSKDPKGKVKANVEESGKVGLILNNEVLVGRFAKEEDDFSKKELYAEEEIEFLRIIQQSEFK

SEQ ID NO: 181760 - protein, 86 aa, Glycine max
  Coding DNA Sequence Number=SeqID_90075
MGSNQAPSFKRRFYHVKIKSLEVASLRELGQRMDQVQRQAFHKTYGKIWDLAMIEVSVEAIASLTQYYDQSLRCFTFGHFQLVPII

SEQ ID NO: 181761 - protein, 146 aa, Glycine max
  Coding DNA Sequence Number=SeqID_90076
MVSKLSSGNRLHCLVIDYQSLDLLETFVLRQKLDLELILKQCLTFECLLNDQGVPMDPKRIKAIPDWPTPPSIREIWGCHDLTNFYKRRRGERRRHPLGNKPWKKELHHQDEPWIKSLEGCFNGGKERGRERERGEHEIEGIKEGE

SEQ ID NO: 181762 - protein, 89 aa, Glycine max
  Coding DNA Sequence Number=SeqID_90077
MHNHHGSIGVYKCGSNDFKDYFDDAKESRVKQVPKNQESKSFKNQVSKNQDSRTIKFQDLIKFQNQDSRIIKIKIQDSRFKNQEKTQSR

SEQ ID NO: 181763 - protein, 76 aa, Glycine max
  Coding DNA Sequence Number=SeqID_90078
  Gene Ontology: Mol. function=histone serine kinase activity (H3-S10 specific); Cellular component=chromosome, pericentric region; Biological process=protein amino acid phosphorylation
  Homolog annotation: Hit_ID=A7PY12; Match level="QueryCoverage=56%, HitCoverage=21%, E-value=7e-12, Identity=60%"; Hit description =Chromosome chr15 scaffold_37, whole genome shotgun sequence
MRGCKCIPSLTCRSATVHDYAIDNWTLGILCYELLYGAPPFEVESQVDTLKEAKNLISRVTEIWMTPLPVKEDKSG

SEQ ID NO: 181764 - protein, 159 aa, Glycine max
  Coding DNA Sequence Number=SeqID_90079
MSAFSDGDFPSLTSYPELRRSEFLIGGYVGARASLLSTTPPFVAMTQELVARGDTLRLSAPLCHSDTVVSDGTQRPKTKFGHSAPMIRGDTVIRTPLPFRHSRVRWHAKTKFGHSAPMIRGDTLWLFAPFCHPEAAGPDDKQRPSLVILHPMIRGDTLM

SEQ ID NO: 181765 - protein, 83 aa, Glycine max
  Coding DNA Sequence Number=SeqID_90080
MKLMRIMKLAKYRLKAQVEKDEGPSGEGQSPRVEKDEGPSNPCGVYPDLSSFTGSGVIQTSVACIKRSAPTQVHIIWYQSFGS

SEQ ID NO: 181766 - protein, 270 aa, Glycine max
  Coding DNA Sequence Number=SeqID_90081
MIGQIGGVHQRARLFIKRRDQLAQQLHRVVEVVIELGVVLQLALLVAVKFLRQRRRHHGFLQTLLELQFPAWQIAIQRPAKGRKLFKEHRQLRRRQHADDHLLDHFAFGDRQQQIERLQTEHGYWPRICCSCCLTCSATCSRLASILARPAAGAALLRQALGQRVHFVQQRLRRGGGLFARQRQQRRLAADVQHRQVQLVVDLQIDRLREADAVQLGAHIAAFLQPVVQHAAFDAQMVDLNVMQLQRLLQQQGEGAAGERRGPARNAGYG

SEQ ID NO: 181767 - protein, 118 aa, Glycine max
  Coding DNA Sequence Number=SeqID_90082
MGTNQIGKRFYQVKIKDLDVTSLKELGRLMGPLQMQAFRKAYENILDLTIAEGFGKRVRSCKANSKRRSGPTAEVLGRQGKGYGESRGVGPVCGRISFANLWGGPLSKHGRFDGPSRD

SEQ ID NO: 181768 - protein, 23 aa, Glycine max
  Coding DNA Sequence Number=SeqID_90083
MEMKRKTKEKRLGSFLEKLSGVL

SEQ ID NO: 181769 - protein, 294 aa, Glycine max
  Coding DNA Sequence Number=SeqID_90084
  Gene Ontology: Mol. function=nucleotidyltransferase activity; Cellular component=cytoplasm; Biological process=thiamin biosynthetic process
  Homolog annotation: Hit_ID=A4W5B5; Match level="QueryCoverage=53%, HitCoverage=62%, E-value=1e-64, Identity=75%"; Hit description =UBA/THIF-type NAD/FAD binding protein
  Pfam annotation: Domain name=MoeZ_MoeB; Domain location=89-163; Score= 90.1; E_value=7.1e-24; Accession=PF05237.4; Description=MoeZMoeB domain
  Pfam annotation: Domain name=ThiF; Domain location=1-84; Score=18.0; E_value=3.9e-08; Accession=PF00899.12; Description=ThiF family
  Pfam annotation: Domain name=ThiG; Domain location=212-294; Score= -88.0; E_value=1.8e-10; Accession=PF05690.5; Description=Thiazole biosynthesis protein ThiG
  Pfam annotation: Domain name=ThiS; Domain location=159-207; Score =13.2; E_value=0.0027; Accession=PF02597.11; Description=ThiS family
  Pfam module annotation: Pfam domain module=MoeZ_MoeB::ThiF::ThiG::ThiS ; Domain location=89-163::1-84::212-294::159-207
DVNQPKARITRQRLNQLNPDITLIARQERLSGEHLQREVALADVVLDCTDNMATRQAINAACVATHTPLVTASAVGFGGQMMVLTPPWAQGCYRCLWPDDAEPERNCRTAGILGPVVGVMGTMQALEAIKLLSGMETERNTLRLFDAPAARYAEATMRILFNDEPMKCDDGLTVAVLLDKLRQLRPGTALALNQQILPREQWEHQQGAEMLRIADKVFDSHLFTGTGKFASPQLMVDAIRESGSQLVTLALKRVDLRHHSDAILAPLLEAGVTLLPNTSGAKTAEEAIFAAQLA

SEQ ID NO: 181770 - protein, 418 aa, Glycine max
  Coding DNA Sequence Number=SeqID_90085
  Homolog annotation: Hit_ID=Q6WAY6; Match level="QueryCoverage=89%, HitCoverage=82%, E-value=5e-21, Identity=24%"; Hit description =Putative uncharacterized protein
MGQLQWQAFRKAYGKIWDLARVEVSTESIASLAQYYDHPLRCFIFGDFQLSPMVEEFEEILGCPLGGRKPYLFSGPPKASRKWGGRNTEKIFGVLFSNVDGLVDLAAINAFLAYHDHTRKARLVSHLFNQEVRHACPLEGHRSCTEKGGANWDQLLANKEGSSISWFPRWKEGRVRVLISCRGFPNVPLMGTRGCISYNPVLAIRQLAYPMRGAPLEEEIAPVRKAWEVVQKKDKELRGSNNGPIGGYRKWLKPRAASPTVKERFKSAALKIRKENAELRDINIATTKALEQETKRARREEHGRNKFRGALWGSNSELKLRREERDQSRVHSMVLKEELVACSRSKKSLAQHLEATEQSMLAIIGQYKEELNQSLTHEQKLVEDFAQAYAEKEARGRVIDALHREATMWMEVKTSRDY

SEQ ID NO: 181771 - protein, 182 aa, Glycine max
  Coding DNA Sequence Number=SeqID_90086
MAPTRHPLDPDKSNKALGFPALIIGLCQSFGVPVAPSKVIRPPITRAFIEKYCMQRQAQGDAPQAADVPPPHQAGPAESFDTEQCLRHLVRQQAANHRAHVQTHDCLYQMSLILQSQGFTSFPCPTPDQFRVEVAWPGDWPEARAGEAPAEAPAEDPDEADEAREDEEMTDLLDFLGGSGAT

SEQ ID NO: 181772 - protein, 126 aa, Glycine max
  Coding DNA Sequence Number=SeqID_90087
  Subcellular localization annotation: CTP_CleavageSite=72; ConfidenceScore=5.24e-01
MPISPCKSISWSVSSRRGITPTKTPSGPEEVQQGPGVSSSGYGPLSALQGTRSPPARSCHPDIGIAPVGHPVDPKKSNRVLGFPALITGLCQFYGVPVAPTRSLGPALTGLSSEYCAPDGRRRDTQ

SEQ ID NO: 181773 - protein, 161 aa, Glycine max
  Coding DNA Sequence Number=SeqID_90088
MEERMKNVEERLNLCEIPHGKRYGNVSEAPRLRFSSRKQFFQANSKEREVPKGLDPFFFTSSPIYSKIGEVVAAQLAQASSARPGEQGCFLQKQPPSGGIFWRAQMGLGAICTPIFTKLPFSTSDIPPHMNKEEKTETPSFFSKNTTLEKILLVRDRTFNL

SEQ ID NO: 181774 - protein, 213 aa, Glycine max
  Coding DNA Sequence Number=SeqID_90089
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=38%, E-value=4e-94, Identity=66%"; Hit description =Photosystem I P700 chlorophyll a apoprotein A1
  Pfam annotation: Domain name=PsaA_PsaB; Domain location=1-207; Score=- 290.1; E_value=0.042; Accession=PF00223.10; Description=Photosystem I psaApsaB protein
MSALGRPQDMFSDTAIQLQPVFAQWIQNTHALAPGTTAPVGGKVALLPIPLGTADFLVHHIHAFTIHVTVLILLKGVLFARSSRLIPDKANLGFRFPCDGPGRGGTCQSDVWGSISDQGIVNHITGGNLRRVPLPLMGGSVISYGHRHPSGRGYWQELIESIVWAHNKLKVAPATQPRALSIVQGRAVGVTHYLLGGIATTWAFFLARIIAVG

SEQ ID NO: 181775 - protein, 132 aa, Glycine max
  Coding DNA Sequence Number=SeqID_90090
MKTNMEALKDQMTSMMEAMLSMNRMIESNMAAIAATSAAAEVDSTHPPAINQANQPIPNVLGQGGEGQQPQPIRGAREEPQEHAQGDFYPYLTFTTEGPAFNAICLDPNTAGAPQPRPLQPLHFLVGGRLRY

SEQ ID NO: 181776 - protein, 72 aa, Glycine max
  Coding DNA Sequence Number=SeqID_90091
PSRMEVEEWKVVTFVAKAEAYNVAPYRACRPWIFFITIVLHYLKINGSRKEKEERETEKGEQNLDKEKRENE

SEQ ID NO: 181777 - protein, 393 aa, Glycine max
  Coding DNA Sequence Number=SeqID_90092
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=100%, HitCoverage=54%, E-value=3e-35, Identity=38%"; Hit description=CTV.20
  Pfam annotation: Domain name=zf-CCHC; Domain location=204-221; Score =21.0; E_value=0.001; Accession=PF00098.14; Description=Zinc knuckle
MVATAYQTSHECLEETIVDILVAGFSVWKDRSAELLYNLKCRTLADFRWYRDTFLTRVYTREDSQQPFWKEKFQAGLPRSLGDKVRGKIRSQSINGDIPYDNLSYGQLISYVQKVALKICQDDKIQRQLAKEKAQTKKDLGSLCEQFRFPACPKQKKKQNPKKEFHENKNFNKKRFPNRKYSHKASISRDTNMPKPVMKPRTKVVCYNYGKQGHISKYCRLKKKLRNLNLDPSIEEKINNLLIETLEEETGEVSSEENLNQIQQDDQDLLFEAINSIPDPQEKKVFLNKLKKSLEAKPKPIEFITNNKFDVSNILNRLENTSVKPTPIQDLQTEINNLKQEVKELKQQEIHQIILSHFEEHSDSNNEVKEEKDEGQDDEMFMGLINKIKIQKF

SEQ ID NO: 181778 - protein, 68 aa, Glycine max
  Coding DNA Sequence Number=SeqID_90093
MILEMIREDRSVLRMVRGGDGQQQRWWRMIPFSSSMILPFEEVFVNFNRWNRKRSENEEDWALRDVFW

SEQ ID NO: 181779 - protein, 36 aa, Glycine max
  Coding DNA Sequence Number=SeqID_90094
EGLAKRFRNVFREEFAKVSTVLRRSSFVLHRSSIFN

SEQ ID NO: 181780 - protein, 169 aa, Glycine max
  Coding DNA Sequence Number=SeqID_90095
  Subcellular localization annotation: CTP_CleavageSite=41; ConfidenceScore=5.37e-01
MVESSKKRKGSSSTTAVVGHRRHGPFEVPTTPIHPSLSSPRSSTVFSSDDQRVWYLSQFSSRIILNPKYLDIDFFNDETFDCYQVFQNSGLIDFMSLKLPYYPELVKVFYNNLKIQDGIISSEVHGISMIIDQSLFFSLTKLPSQGAPFEGTIVDDWKFDYSSHDARRM

SEQ ID NO: 181781 - protein, 79 aa, Glycine max
  Coding DNA Sequence Number=SeqID_90096
MGVERYENEGIRIRRQKVKTQDKEESNRKTKEETKEFIVAQEKNKEAKAEGKSEAKDMRVIVEEFLSKAHYKQLHMFNP

SEQ ID NO: 181782 - protein, 139 aa, Glycine max
  Coding DNA Sequence Number=SeqID_90097
KVMEDISFSPEGIYPIPSPINEPHPPSPIDQTPSPIQVDLAPSPSPINVDHTPSPHEDEAEWKYCKKLLGGKSKNGTKHLWQHNEICVQYKIFMRGMKGQTFLAPKVVQGKQELEQPEESQELVRDVSIAVRRHVSPLR

SEQ ID NO: 181783 - protein, 250 aa, Glycine max
  Coding DNA Sequence Number=SeqID_90098
  Gene Ontology: Mol. function=transferase activity, transferring glycosyl groups; Biological process=metabolic process
  Homolog annotation: Hit_ID=A7R173; Match level="QueryCoverage=72%, HitCoverage=86%, E-value=3e-32, Identity=63%"; Hit description =Chromosome undetermined scaffold_340, whole genome shotgun sequence
FGHLIPSLELAKLIAQKGHHISFVSTPRNIECLPKLSPNLVSFIKFVKLALPKVDNLPENVEATIDVPYDVVQYLKKAYDDLEEPLTCFLKSSKVDWHFYDPYMLQLPKRFKEKTKWCGIVSPDHGLNSRVLEVKKMGYSIPKDEQDGSFTSDAVANLIRLVMVVEKGRIYREKVKKVRHVFIIPNGDNVQKCVSNLVLKFHDDPTVNDFEIALFPRQVWWYAGKDRVFRGGEGKTKLKGKGGVGSIVKN

SEQ ID NO: 181784 - protein, 155 aa, Glycine max
  Coding DNA Sequence Number=SeqID_90099
  Gene Ontology: Mol. function=transferase activity, transferring glycosyl groups; Biological process=metabolic process
  Homolog annotation: Hit_ID=Q8S342; Match level="QueryCoverage=34%, HitCoverage=11%, E-value=2e-10, Identity=58%"; Hit description =Putative anthocyanidine rhamnosyl-transferase
GEGANTLNAKAKTLEEGESKPTPNVDGLEFVLVNTRFEGDKDNVTWQWMKEWLDNQECGSVLYVAVQNEKPVFLLMFLEDQGLNTKLLEEKKMRYLIPRDELDGSLTSDAVIDSIRLARKALNLLHQWNPLLLEDEWQRNGEGRKMIGDATSRRR

SEQ ID NO: 181785 - protein, 59 aa, Glycine max
  Coding DNA Sequence Number=SeqID_90100
MSVKILVGRLGVHDKTNHTLASQVTLTRLKGALKPGIFTPKAYTPKSALGPLPPDSGPT

SEQ ID NO: 181786 - protein, 268 aa, Glycine max
  Coding DNA Sequence Number=SeqID_90101
  Homolog annotation: Hit_ID=UPI00006A2D9E; Match level="QueryCoverage =50%, HitCoverage=75%, E-value=7e-08, Identity=21%"; Hit description =UPI00006A2D9E related cluster
ARPRPQKKCNVLAFRRVACPAPEELHVLTFRGLHILVFKGLHALSLKGLHGLTSRGLRALTLGGPHVLPFRGLHAPAFRGLHVLHFRGLHVLDVRGLRVLTFIRLHALTFKGLHVLALRTTGPHLQTTTRPRLQRATSPRLQRTTRPHLQRTTRPSLQRAAHPFLQRTTSPRLLKATGSHLQWTTCPRIKDYVSSSSEGYTLSPSEDYRLLHALAFKGLHALTIKGLHALSFRGLQALTFRGLQALTFRGLQVLSFRGLHVLAFRGLH

SEQ ID NO: 181787 - protein, 157 aa, Glycine max
  Coding DNA Sequence Number=SeqID_90102
  Homolog annotation: Hit_ID=A7QL08; Match level="QueryCoverage=39%, HitCoverage=90%, E-value=2e-10, Identity=59%"; Hit description =Chromosome undetermined scaffold_116, whole genome shotgun sequence
MVGAGLKKDLRVSRVVPGGSLNAFLFLLIGVISQRLAMAGNDSILYPEPGGSLFLSNGKEDRNMPLKDSTETKTGCQERRGGRMGSWSDLGFLIWDPGEEDQAGPCEQLDALSPFNPLSEMWQKEKESMDRPHRLHPVGTTRSPQGRLRHPGVADRP

SEQ ID NO: 181788 - protein, 108 aa, Glycine max
  Coding DNA Sequence Number=SeqID_90103
  Homolog annotation: Hit_ID=A7PD81; Match level="QueryCoverage=79%, HitCoverage=36%, E-value=3e-17, Identity=54%"; Hit description =Chromosome chr17 scaffold_12, whole genome shotgun sequence
MEEEKAAAYYDKVTRKGERAARFKQGLEFSSSAPNDDVAKPSSSFLSKFIKASSESKMEAQLQSIHDRLKEKPSFESRVSSRDRDRKHEDEAGVEKDIRIVKEGDRKL

SEQ ID NO: 181789 - protein, 258 aa, Glycine max
  Coding DNA Sequence Number=SeqID_90104
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPEFDLLVKANLKETSIFNLAKKLDVDPLALTAFYNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 181790 - protein, 150 aa, Glycine max
  Coding DNA Sequence Number=SeqID_90105
  Subcellular localization annotation: CTP_CleavageSite=46; ConfidenceScore=5.24e-01
MATPPASPPQSNQQSEAMSRNTRRSTQLRILTRRTLDQPQPIVTVYAAIGRGSSPYKERFHNYLGVIAREKVPIVHNNWKDVPDTLKELVWNDILAKFDIPEAIHAKKKVMSTVATRWRQFKSSFTSKFVFSNFEDQHKEDPSVKYGFDA

SEQ ID NO: 181791 - protein, 118 aa, Glycine max
  Coding DNA Sequence Number=SeqID_90106
MRFGSQELKSLFFVGAQDSDQGVPMNPKRIKVIPEWPTPPTPLIELVRNHVPSWEDAQEMGFQTLPYFNIPNTTNTNVFVLFTGVQGRNPEYEEPQDLRSNPFQGGGNDAILPCKGIG

SEQ ID NO: 181792 - protein, 196 aa, Glycine max
  Coding DNA Sequence Number=SeqID_90107
  Homolog annotation: Hit_ID=A2XIJ1; Match level="QueryCoverage=58%, HitCoverage=46%, E-value=5e-10, Identity=33%"; Hit description =Putative uncharacterized protein
MEALENVGDIYQEEILKAPVPLVEHFAMVLGRKLNHSSGVGSAPIAKKFSHKQIIRNQLENAQNRANNLELKVQQLTNITKKQEDVITQLHIEVQSQREQMKQNLENKVKRQIVGLLELNHLLTQVLRLVIRVEAMFSKFILMMPKTQVKNQESSKFQESNSRSIKASFKNQRVVQSKQVSRIKIKVKIQEKTQLR

SEQ ID NO: 181793 - protein, 201 aa, Glycine max
  Coding DNA Sequence Number=SeqID_90108
MADTYSAPEEIHGLLGYWKNTITKRAARDPYRTRSKSRTMGDQEETQEQMKADMSALKEQMASMMEAMLGMKQLMEKNAATAAAVSSAVEADPTLLATTHHPPSNIVGRGRDTLGHDGSPHLGYNRAAYPYGLPPNYSPPILQEDAGHIASPVHEKEPPQQPDEVHKDPQDMLGGMSSFIPRSPKGRHRARCLNPTSQHRQ

SEQ ID NO: 181794 - protein, 192 aa, Glycine max
  Coding DNA Sequence Number=SeqID_90109
MGETHEIPHQNLADFEPWLGYATEGQAVGGVPFENTLESPQGLPTTTNIAFLRWEEPLMTMAGMGKLDHLEERLRAIEGGEDYAFANLEELFLIPKHGHSQVQGAGRGQVQGDYSLQEPSKDDLMVAFVRQCQYNSDMAPDRMQLQKVCKKGAQIFQGIRPKMERLGNSSSTPKNRERDYHNDSRHVTGVLL

SEQ ID NO: 181795 - protein, 48 aa, Glycine max
  Coding DNA Sequence Number=SeqID_90110
MWTTTGEKLAAQLAQASKVASSRSNSLLEESSGGPKWAWLLFTPPLFN

SEQ ID NO: 181796 - protein, 352 aa, Glycine max
  Coding DNA Sequence Number=SeqID_90111
RVPFAIQAAQLLGRAIGAGLFAITPAGERGMCCKAIKLGNARVFPEFDVGAVLTLVLVGEVHRHLLDRVRVGQLARHHARARGEQRAFDIAPAHLQEFQRADAVGLVDGAGVAPFEQRLLRQRRRRAGAGDQHGIGLGGDHLEHLAHHRRVGALEAFLRHDLDVVAGGRGELLPPAVAVGIGEADEGHILEALFLHVLDQHGRHQRIVLRHLEGPGALGVGQRLDDHAGGRQGDHRRAGLGQHVQRGQRRGGGVGTDDGVDLVFRGQLAQVLDRAADVRAVVQHHVARRLAAQRAGPQADGVVGLDADRRGRAGGGDIHADHDLGLDGQGGNRQRDSAGVAKEETGHDEGIL

SEQ ID NO: 181797 - protein, 100 aa, Glycine max
  Coding DNA Sequence Number=SeqID_90112
MENCLVKLSTKFREDPTVNEGWEAFLPRQLHMASRKHKSIGSRPTTQYDTRRFHSLDAWNWYTDNVLGRNILPVELYHIEFDDFKTELERRNLHKCLTNL

SEQ ID NO: 181798 - protein, 86 aa, Glycine max
  Coding DNA Sequence Number=SeqID_90113
MVAITLAKVPQPLFFRGYDSNATCAYHGGVPRHSIEHCMTSKHKECGCKPLVCLLKRHTLLSLDFQDCSIRNYSCYTFGEDVVKTE

SEQ ID NO: 181799 - protein, 441 aa, Glycine max
  Coding DNA Sequence Number=SeqID_90114
MPTRPRPEHPSGEERQLYITEFDEFRRELERRNLHKRLTNSTDGSIDVAVVKEFYANLYDPKDNSPKQVRVRGHLIKFDADTFNTFLGTPVVLEPGETIPTYSRFCRLRMDPQEIAARLCIPGRGFVLNVEGKLWKLLRRDLTTLAQTWSVLSYSNLAPTSHTLDLNLDRARLVYGLVMRMDMNIGALFSGQISLIAQSNSSRLGFPALITALYKAMGVTSDSLSYESLSPAINLEYIKKNCWNLDEPSFYFPMTCKARARAAKIPSSSTPLDPPVPTYAPRPAPAHPGPSIDLIMTFQNLAQHQPFISLEEFTGQVVWPRAQPSPIGGGEASAAQKPQPHQDESSSSSNSETIPPEPFIYEEDPGTTLEETQKAATPKTTPQQAVEPSIPVLDLSSPQPSQEPSTPVLGLSSPTTSPAGTSVLHLIDEKEDIMDQDQPKD

SEQ ID NO: 181800 - protein, 374 aa, Glycine max
  Coding DNA Sequence Number=SeqID_90115
  Homolog annotation: Hit_ID=UPI0000ECBAF8; Match level="QueryCoverage =10%, HitCoverage=48%, E-value=7e-16, Identity=100%"; Hit description= UPI0000ECBAF8 related cluster
PGWIRGRKKSGGIRDVDKGHIKAVVLRQPVAQRLHAAALGGVVAGGEEMHAHFARAVNGLLRHFTADERIDAEARRAVDKALAATGAPGHPANVLRRVIAAVQHRAPQPAFDTLLQRFAGQRLFKFAVRHQRLDVANHPNAQRLRQLRVVAQHRMRVQRQVVAIQVDIMGQQRFQAVALHAAHRRRLVFPEIAVVHDNRVGLMHHRGVQQRLTGGDAGHDALHVRAAFYLQSVGGVVLKRRGVQFRVDQLFQIEAGLDVADHHRQTVQRAIAAAVLRQVLQLLQQPGRRQMAVQMFILHPVRVRGFDNHALELLLLDKRPQRAPDGMQAWHWPSFYNVVTGKTLALPNLIALQHIPLSPAGVIAKRPAPIALPN

SEQ ID NO: 181801 - protein, 154 aa, Glycine max
  Coding DNA Sequence Number=SeqID_90116
  Subcellular localization annotation: CTP_CleavageSite=38; ConfidenceScore=5.38e-01
MPISPCGSISWACTHKTPSGLGGAQQGPGFPTLVTGLCQSYRVPVPPNKVMPSDHARKTPSGPKEAQQGPGVSSSDYGPLSVLRSARRPQQGHQAPINRAFIEKYCAPRQAQGETPQQPGDGRQRATDASSPPPKPHSSSTKRLERCLRHMADQ

SEQ ID NO: 181802 - protein, 203 aa, Glycine max
  Coding DNA Sequence Number=SeqID_90117
MWVFLTSRQIDWAHLVRYRMHKALRSNAPLPYPHLITLFLQHFNVPLDSKPFVKVKRSFSIGANVVSSFGYRKERDGSWVKKDAPAQAAEDHSPSPPPERDDSSSLMHNILDRLDGLHTFVGERFDSLDSHIDAIDARFAGMDTCITQLEEDCHHQKRGDCGSNVFQVYFDDAKDSSEESRVKQVSRIKESFNQSMFQESRLK

SEQ ID NO: 181803 - protein, 51 aa, Glycine max
  Coding DNA Sequence Number=SeqID_90118
MGTFPLPSLRRCESASLYKNGAFRGDLPYSIVTAVEFNHQVRDGLVWFLYA

SEQ ID NO: 181804 - protein, 78 aa, Glycine max
  Coding DNA Sequence Number=SeqID_90119
  Pfam annotation: Domain name=Ins_element1; Domain location=3-71; Score=-14.2; E_value=0.0029; Accession=PF03811.4; Description =Insertion element protein
  Subcellular localization annotation: CTP_CleavageSite=32; ConfidenceScore=5.40e-01
APVASVSISCPSCSATDGVVRNGKKHRRTSALASVAAAQLLGRAIGAGLFAITPAGERGMCCKAIKLGNARVFPVTTL

SEQ ID NO: 181805 - protein, 50 aa, Glycine max
  Coding DNA Sequence Number=SeqID_90120
MGVQIAPRPTWALQKIPPEGGEEEQERGSAPEALFSLSNLLGKIVSVKKI

SEQ ID NO: 181806 - protein, 187 aa, Glycine max
  Coding DNA Sequence Number=SeqID_90121
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=91%, HitCoverage=35%, E-value=7e-64, Identity=74%"; Hit description=ATP synthase subunit alpha
  Pfam annotation: Domain name=ATP-synt_ab_C; Domain location=53-154; Score=78.7; E_value=1.9e-20; Accession=PF00306.18; Description=ATP synthase alphabeta chain, C terminal domain
MTALPIVNSNREMFPAYIPTNVISITDGQIFLSADLFNAGIRPALNVRYFRFPELDRRLQIKAMKQVAELEAFAQFASDLDKATQNQLARGQRLRELLKQSQSAPLTVEEQIITIYTGTNGYLDSLEIGQVRKFLVELRAYLNTNKPQFKEIISSTKTFTGEAEVLLKEAIQEQMELFLLQEQVEKN

SEQ ID NO: 181807 - protein, 111 aa, Glycine max
  Coding DNA Sequence Number=SeqID_90122
MTVWQLKKAMIMKGQDIYSSQDEVTTSPSSSESEEAKGEESSEEIDSQEERDLLMVRRLLGGQSCDLVHLSIHKKLNLANNLYYRKLIIFKNQLVPRQSDVLDCNCYSQTT

SEQ ID NO: 181808 - protein, 159 aa, Glycine max
  Coding DNA Sequence Number=SeqID_90123
  Gene Ontology: Mol. function=transporter activity; Cellular component= intracellular; Biological process=transport
  Homolog annotation: Hit_ID=Q9LRX7; Match level="QueryCoverage=86%, HitCoverage=28%, E-value=3e-33, Identity=47%"; Hit description =Phosphatidylinositol/phosphatidylcholine transfer protein-like
MLTRKAVNSFRQVLLTRDLLPDSHDDYHEMLRFLKARKSTLIKSPDVGRYVALEEEYGVDSIYRNLYIRSMKRYSVIILMATMGFEKMFKEKFPACSIAAKRHIDKTTTILDVHGVNWVSFSKVAHDLVMRMQKIDGDNYPEEKGGKLFMTGEGEFSTK

SEQ ID NO: 181809 - protein, 292 aa, Glycine max
  Coding DNA Sequence Number=SeqID_90124
  Gene Ontology: Mol. function=RNA-directed DNA polymerase activity; Biological process=RNA-dependent DNA replication
  Homolog annotation: Hit_ID=Q9C6L3; Match level="QueryCoverage=47%, HitCoverage=16%, E-value=4e-09, Identity=25%"; Hit description =Putative uncharacterized protein F2J7.11
MWNCCLKNNQVSSQDEDKEGEKVEKIIKTISCGMKKKVRLKTEDGEGSHHGDSASGPVRIRLVVTKEELKRMLRNRNENDPQHTSLEQLLSDMVLRDKRVFEVEKYGGSVNSWRPGLFISFDKSVIYSVGIRPHELSHIQQLTGFSLGDFPFRYLGKLELIRAVIQGIVNFWMEIFPLPQSVLDRINASCRNFLWGKVDIGKNKPLVAWSVKDSLWVRWVQHYYFRGSDVWNYNTSSSDSVLIKKIIQLSTKEVKKRIQSWSTNEQLLVGKVYEYIRGVKPIEISPSLGSHS

SEQ ID NO: 181810 - protein, 350 aa, Glycine max
  Coding DNA Sequence Number=SeqID_90125
  Gene Ontology: Mol. function=oxidoreductase activity; Cellular component=cytoplasm; Biological process=metabolic process
  Homolog annotation: Hit_ID=A7PX31; Match level="QueryCoverage=98%, HitCoverage=95%, E-value=1e-125, Identity=64%"; Hit description =Chromosome chr12 scaffold_36, whole genome shotgun sequence
  Pfam annotation: Domain name=ADH_zinc_N; Domain location=158-307; Score=97.6; E_value=3.8e-26; Accession=PF00107.17; Description=Zinc -binding dehydrogenase
MGSVVESREWYLAAYSPHGVPNSDNLKLRTVALSLSSDSIPDGHVSLQILFLSVDPYLRTRLTGTLDGLYIQQYPLNEVITAYGVGRVIGSKDSKYTEGDLILTPSAPVAEYCILPSSRVIRKIDAASGISLPDYLSALGVPGFAAWVGIVVLGDPKPGSNVFISAASGAVGMSAGQLAKIRGCRVIGSTGSDEKVKLIKEEFGYDDGFNYNKESDFDAALSKYFPDGIDVYLDNVGGKMLESVLNHVNKYARIPLCGMISQYNKVWTEREGVRNLLNMVGKEVRMEGFMLESYWHRFEDFAKEMEGYIKEGKVTSKNKINIGIESFLDSLASLFSSSNIGKVVVQVNKA

SEQ ID NO: 181811 - protein, 362 aa, Glycine max
  Coding DNA Sequence Number=SeqID_90126
  Gene Ontology: Mol. function=oxidoreductase activity; Cellular component=cytosol; Biological process=metabolic process
  Homolog annotation: Hit_ID=A7PX31; Match level="QueryCoverage=96%, HitCoverage=96%, E-value=1e-128, Identity=65%"; Hit description =Chromosome chr12 scaffold_36, whole genome shotgun sequence
  Pfam annotation: Domain name=ADH_zinc_N; Domain location=170-319; Score=98.6; E_value=2e-26; Accession=PF00107.17; Description=Zinc -binding dehydrogenase
MGEEVKSLVVEEEMGVVESKEWYLVSYAPHGVPTTDHLKLRKVRLSIAPESIPDAHVAIEMLLFSVDPYLRGRFTGTLDGLYFPQFELNQVITIFGIGRVKRSNDSKYEEGDIVLSASFPVAEYCVMPSSEIDAKIDAASGISLPDYLSTLGVPGFAAWLGIEVVADPKPGSNVFISAASGGVGMIAGQLAKIRGCRVIGSTGSDEKVRLIKEEFGYDDGFNYKKEEDLDAVLSKFFPNGIDVYLDNVGGKMLESVLNHVNKFARIPLCGMISQYNQAWTEREGVRNLLNLVGKEVRMEGFLLKTHFNRFGDFAKEIEGHIKEGRLKPKTKINFGIESFLDSLNSLFSSSNIGKVVIQVNKA

SEQ ID NO: 181812 - protein, 75 aa, Glycine max
  Coding DNA Sequence Number=SeqID_90127
  Subcellular localization annotation: CTP_CleavageSite=17; ConfidenceScore=5.20e-01
MAMLSTFMLCSFPKNSRQMRRAYTKLFYCCNVPQYSSRFMFLQGFDLNPLQTRQPNIRCFQWNEDVTHQGTEMPS

SEQ ID NO: 181813 - protein, 377 aa, Glycine max
  Coding DNA Sequence Number=SeqID_90128
  Gene Ontology: Mol. function=aspartic-type endopeptidase activity; Cellular component=lysosome; Biological process=sphingolipid metabolic process
  Homolog annotation: Hit_ID=Q9FRW9; Match level="QueryCoverage=94%, HitCoverage=86%, E-value=1e-122, Identity=53%"; Hit description =Aspartic proteinase 1
  Pfam annotation: Domain name=Asp; Domain location=40-376; Score =247.4; E_value=3.2e-71; Accession=PF00026.14; Description=Eukaryotic aspartyl protease
  Pfam annotation: Domain name=SapB_2; Domain location=224-258; Score =54.2; E_value=4.4e-13; Accession=PF03489.8; Description=Saposin-like type B, region 2
  Pfam module annotation: Pfam domain module=Asp::SapB_2; Domain location=40-376::224-258
MLKRNTDSEGATLTEARPFGGYENSDDTSIIRLKNYMNAQYFGEIGIGTLPQKFTVIFDTGSSNLWVPSSKCYFSGHQLKSIMELGIFQVSLPRTMSRFEIWLFMTRILLRQLDVGFQEISVGNAAPIWYNMLNQHFLTQPVFSFWLNRNTNEEQGGQIVFGGIDSDHYKGEHTYVPVTQKGYLAGLCAAKCLAIVDSGTSLLAGPTGVIAQINHAIGAVGIVSQECKALVAQYGKTILDKLINEALPQQICSQIGLCTFDGTQGVREHLVVGMMPDAQLLCDLVPSPKGESVVECNTLSEMPNVSFTIGGEVFELSPEQYILKVGKGATAQCISGFIALDIAPPRGPLWILGDIFMGSYHTVFDYGNMKVGFAESA

SEQ ID NO: 181814 - protein, 274 aa, Glycine max
  Coding DNA Sequence Number=SeqID_90129
  Gene Ontology: Mol. function=nucleoside-triphosphatase activity; Cellular component=DNA replication factor C complex; Biological process=defense response
  Homolog annotation: Hit_ID=Q9C587; Match level="QueryCoverage=26%, HitCoverage=7%, E-value=3e-19, Identity=68%"; Hit description =Replication factor C large subunit-like protein
  Pfam annotation: Domain name=RFC1; Domain location=1-84; Score=-42.1; E_value=0.0082; Accession=PF08519.3; Description=Replication factor RFC1 C terminal dom
MGKNLRLLDDLHVHILASRESSSGRDTIRMEYLTLLKEMTEPLPTLPKVAEAVQQVVELMNTYSISQEDFDTISLFHIGREPKNPTLSYYILFFSFLSLLYSSSSPKTIISLHQHTTPYLKSLTHFVAHRHYKPLFPLTNTLLLPFVLYSHRLKAPPSPPLLTTNTSSYLAVATPPQGCSATNLNCGPSHSGVLTLLQRRDRDRVPLPPQRRPPPLPSDRHSPTLNLRQFLHSLPRLNLQHLVPATRVQSWLLCLHTLHHLIFNIILRILLHLF

SEQ ID NO: 181815 - protein, 539 aa, Glycine max
  Coding DNA Sequence Number=SeqID_90130
  Gene Ontology: Mol. function=protein binding; Cellular component =nucleus; Biological process=mitotic cell cycle
  Homolog annotation: Hit_ID=Q2HT10; Match level="QueryCoverage=94%, HitCoverage=82%, E-value=0.0, Identity=62%"; Hit description=Barren
  Pfam annotation: Domain name=Barren; Domain location=5-529; Score =103.6; E_value=6.2e-28; Accession=PF05786.5; Description=Barren protein
MVDFLPTAVDNLRRKACHGSAISCTLEAGVKIYSLRVDSVHSEAYKVLARMNRAGQDTEEVAFAVDPLYRQMSAQFDEGGAKGLLMNNLGIYGKCRLLFDSLEVPGKCITSQNESDISDTIDLSFARDCVEQMILDIHTKGEISPTLRVIVNQFDENNKRPSDFQSSTEKSGEEFDAAIDSELATEKEYENFPSWSNDHDSEAFPAEWGSDDADPTFPSYHQEKEPFHSQDPPDMDDIFENVDGYLFLSLGFRSKKNAWAGTDHWKFQKAKGSESEVHRASEDVLVQKTRQPGTKRQVEVDLDFTSFVEKKISDIFSPPRNPKSLQLPENIPPSITKLPEDCHYEPEDLVNLFLLPYVKCIGRKARKLSGEFADVSGEQCNNYESFPSWDNGSVCDDDVTDVHSEMDDSTSLISQPRQLEHKYDYFQITQINKVEVQYDKTFKQVNVQALKITLWDHIQESVQVPIQGKKEVVSFKHMLTNFPSKCNAAATISDISPHLCFICLLHLANEKGLNIQSCPNLDDLGICLPDDGATITGTV

SEQ ID NO: 181816 - protein, 192 aa, Glycine max
  Coding DNA Sequence Number=SeqID_90131
  Gene Ontology: Mol. function=peroxidase activity
  Homolog annotation: Hit_ID=A7P0L0; Match level="QueryCoverage=71%, HitCoverage=82%, E-value=2e-50, Identity=70%"; Hit description =Chromosome chr19 scaffold_4, whole genome shotgun sequence
  Pfam annotation: Domain name=DUF212; Domain location=18-156; Score =101.1; E_value=3.5e-27; Accession=PF02681.5; Description=Divergent PAP2 family
  Subcellular localization annotation: CTP_CleavageSite=9; ConfidenceScore=5.24e-01
MADVTANLQAATTASTPYALPTNLPLLSAFLSFALAQFLKIFTSWYKEKRWDSKRLLDSGGMPSSHSATVSALAVAIGLQEGAGSTAFAVAVVLACIVMYDASGVRLHAGRQAELLNQIVCELPPEHPCSNVRPLRDSLGHTPLQIEDSNRIPPHQDGELTRERLKCLKRYFDDDNERRQVNAKFANFSGGR

SEQ ID NO: 181817 - protein, 402 aa, Glycine max
  Coding DNA Sequence Number=SeqID_90132
  Gene Ontology: Mol. function=strictosidine synthase activity; Cellular component=endoplasmic reticulum; Biological process =biosynthetic process
  Homolog annotation: Hit_ID=A7PGB4; Match level="QueryCoverage=96%, HitCoverage=97%, E-value=1e-115, Identity=55%"; Hit description =Chromosome chr6 scaffold_15, whole genome shotgun sequence
  Pfam annotation: Domain name=Str_synth; Domain location=221-294; Score=19.3; E_value=1.7e-05; Accession=PF03088.7; Description =Strictosidine synthase
MPYMTLPRGFSIVFLLLALYCALDPFEPSPIVGFPPFDVHKIDMPAWSEVPTDRDKDNSLLKSELLFVNQVQGPESIAFDPLGRDPYTGVADGRILFWNGQSWTDFAYTSPNRSHFSSFLLTLPTQLLNITILTSQTKKLGFNSSKHVSEQYNPKASASPMSYVKTEHICGRPLGLRFDKKSGDLYIADAYFGLMKVGPQGGLATSLATEAEGVPLRFTIDVDIDTEGNLYFTDSSTNFQRSNFIQLVLSGEASGRVLKYKLPLRNHCSHEERSISKRHLLKQGWLRKYWLKGDKAGTSEILAILPVFLTTRYMYSYLNSLYPKMRKVILKLPIPTRIQYMFHIGGRFHAVAVKYSPEGKLLRILEDSEGKVVRAVSAVEEKDGKLWVGSVLMPFMAVHNLT

SEQ ID NO: 181818 - protein, 423 aa, Glycine max
  Coding DNA Sequence Number=SeqID_90133
  Gene Ontology: Mol. function=metal ion binding; Cellular component =intracellular
  Homolog annotation: Hit_ID=A7PXJ7; Match level="QueryCoverage=98%, HitCoverage=98%, E-value=3e-87, Identity=44%"; Hit description =Chromosome chr12 scaffold_36, whole genome shotgun sequence
  Pfam annotation: Domain name=CCT; Domain location=367-411; Score =81.1; E_value=3.7e-21; Accession=PF06203.5; Description=CCT motif
  Pfam annotation: Domain name=zf-B_box; Domain location=1-47; Score =24.9; E_value=0.00029; Accession=PF00643.15; Description=B-box zinc finger
  Pfam module annotation: Pfam domain module=CCT::zf-B_box; Domain location=367-411::1-47
MDPLCEFCGVVRAVVYCKSDSARLCLHCDGCVHSANSLSRRHSRSLLCDKCNSQPAMIRCMDHKLSLCQGCDWNPNDCSALGHRRVALNCYTGCPSLAEFSRIWSFVFDANSSLGGWESVGTLPKSESCTSQCLEQTDHNGGSFGLVSDKLDEIESCVIYEPWMGQSQIIPSNPNYTPFCKDEAFFFPQDSNQPKECPNLGIHDGSELCEGFNVDNLQLNFESADEIFGCSQDATRYHLEDGGMDCLLMDKNISVTESNSLIESALEASSSIQQDCVAFQSSRAGGSASVMQVINSNTNSALMNPSCTRNISLGFPQGVHSKMPLQFPNIVGENNSTEYQDCRFSQVFLPGESPWESNLEGTCPQARDKAKMRYNEKKKTRMFGKQIRYASRKARADTRKRVKGRFVKAGEAYDYDPLGTRDI

SEQ ID NO: 181819 - protein, 144 aa, Glycine max
  Coding DNA Sequence Number=SeqID_90134
  Gene Ontology: Biological process=protein modification process
  Homolog annotation: Hit_ID=A7PXI1; Match level="QueryCoverage=99%, HitCoverage=78%, E-value=4e-40, Identity=46%"; Hit description =Chromosome chr12 scaffold_36, whole genome shotgun sequence
  Pfam annotation: Domain name=ubiquitin; Domain location=70-138; Score= 16.8; E_value=0.0054; Accession=PF00240.14; Description=Ubiquitin family
MEDYPIVTEGTKVDLTIKPVEPHPNKMQITEKFSARKFDIEVDRTDTPLNRSREEPPTRKLSLVVQTSSSLLNAATIPLEMRDASTVGDLKQLLISRKILPVDDYLFIHKQRIMRDSCSLRWHGIENGDCLYVFKGTVSRSGYA

SEQ ID NO: 181820 - protein, 207 aa, Glycine max
  Coding DNA Sequence Number=SeqID_90135
  Gene Ontology: Mol. function=protein serine/threonine kinase activity; Cellular component=extracellular region; Biological process=response to abscisic acid stimulus
  Homolog annotation: Hit_ID=A5C4D2; Match level="QueryCoverage=94%, HitCoverage=80%, E-value=7e-70, Identity=64%"; Hit description =Putative uncharacterized protein
  Pfam annotation: Domain name=DUF26; Domain location=151-205; Score =76.8; E_value=7.3e-20; Accession=PF01657.8; Description=Domain of unknown function DUF26
  Pfam annotation: Domain name=DUF26; Domain location=40-94; Score =79.5; E_value=1.1e-20; Accession=PF01657.8; Description=Domain of unknown function DUF26
  Pfam module annotation: Pfam domain module=DUF26::DUF26; Domain location=151-205::40-94
MGEMGVRSATNLNQLFDLLHTKVPPTGYGYGSIGQGMDQVNGLALCRGDVNATNCMACVNEATKKLQERCSKKKGAIVWYDYCLLKYSNEYFFGEIDEKNKFYMVNIYDVDDPSTFSDKVNELLSGLSYNASQTPMLYAVGELQLQESKTLYGLAQCTRDLLGPGCKKCLDDAISDLPNCCDGKQGARVVGGSCYVRYELYPIVEDP

SEQ ID NO: 181821 - protein, 200 aa, Glycine max
  Coding DNA Sequence Number=SeqID_90136
  Gene Ontology: Cellular component=integral to membrane
  Homolog annotation: Hit_ID=A7PXJ6; Match level="QueryCoverage=80%, HitCoverage=32%, E-value=2e-51, Identity=60%"; Hit description =Chromosome chr12 scaffold_36, whole genome shotgun sequence
MGRTSTGVNAPANSPHLRKSGSRPVVYDLDEHEVENGVEEGLLHPVEASDSKGGVIPVSAAAMMPSPVLLWRFKIEIMGPDLKDFIIFLQTGGLQVGWDSVMRMSADKRELFLYEAFLYFNPLLLAALMVWLWGINLWFFSQGGVNYAKIFDLDQNHLTHREIWKVSTHHFDLCLVWHIKSAFARSEGNKNGSVMTWEQE

SEQ ID NO: 181822 - protein, 388 aa, Glycine max
  Coding DNA Sequence Number=SeqID_90137
  Gene Ontology: Mol. function=protein binding
  Homolog annotation: Hit_ID=Q9C581; Match level="QueryCoverage=83%, HitCoverage=89%, E-value=1e-121, Identity=64%"; Hit description =Putative uncharacterized protein At5g22070
  Pfam annotation: Domain name=Branch; Domain location=99-317; Score= -89.1; E_value=0.1; Accession=PF02485.12; Description=Core-2I -Branching enzyme
  Pfam annotation: Domain name=DUF266; Domain location=66-378; Score =491.9; E_value=8.1e-145; Accession=PF03267.5; Description =Arabidopsis protein of unknown function, DUF266
  Pfam module annotation: Pfam domain module=Branch::DUF266; Domain location=99-317::66-378
MCYCLSRKSSGGGGGGGGSRSESKIMFSSPFVLTLSLLISLPILFLVAPRILPPPPPPQSFHISPSDEVDDIKLFNRAISLSSPHSHFHLSSKNPSLKIAFLFLTNSDLHFSSLWDQFFSNTPSNLFNIYIHADPSVNLTRPLSPLFINKFISSKRTFRSSPTLISATRRLLATALLDDPSNAYFALLSQHCIPLHSFSYTYKSLFLSPTFDSQDPESSSSTRFGLRLKYKSFVEILSHAPKLWKRYTSRGRYAMMPEIPFEAFRVGSQFFTLTRRHALVVVKDRTLWQKFKIPCYRDDECYPEEHYFPTLLSMADPDGCTKYTLTRVNWTGTVNGHPYTYRPTEVSPELILRLRKSNHSESYLFARKFTPDCLEPLMRIAKSVIFRD

SEQ ID NO: 181823 - protein, 704 aa, Glycine max
  Coding DNA Sequence Number=SeqID_90138
  Gene Ontology: Mol. function=phosphoprotein phosphatase activity; Cellular component=nucleus; Biological process=lipid transport
  Homolog annotation: Hit_ID=A7QVR2; Match level="QueryCoverage=91%, HitCoverage=68%, E-value=0.0, Identity=81%"; Hit description =Serine/threonine protein phosphatase
  Pfam annotation: Domain name=Kelch_1; Domain location=169-217; Score =0.9; E_value=2.4; Accession=PF01344.16; Description=Kelch motif
  Pfam annotation: Domain name=Kelch_1; Domain location=222-270; Score =13.9; E_value=0.066; Accession=PF01344.16; Description=Kelch motif
  Pfam annotation: Domain name=Kelch_1; Domain location=301-350; Score =13.2; E_value=0.08; Accession=PF01344.16; Description=Kelch motif
  Pfam annotation: Domain name=Kelch_1; Domain location=373-419; Score =7.3; E_value=0.41; Accession=PF01344.16; Description=Kelch motif
  Pfam annotation: Domain name=Kelch_1; Domain location=98-164; Score =8.7; E_value=0.28; Accession=PF01344.16; Description=Kelch motif
  Pfam annotation: Domain name=Kelch_2; Domain location=169-217; Score =2.7; E_value=22; Accession=PF07646.6; Description=Kelch motif
  Pfam annotation: Domain name=Kelch_2; Domain location=222-270; Score =8.2; E_value=4.6; Accession=PF07646.6; Description=Kelch motif
  Pfam annotation: Domain name=Kelch_2; Domain location=301-350; Score =40.4; E_value=6.3e-09; Accession=PF07646.6; Description=Kelch motif
  Pfam annotation: Domain name=Kelch_2; Domain location=373-416; Score =7.8; E_value=5.2; Accession=PF07646.6; Description=Kelch motif
  Pfam annotation: Domain name=Kelch_2; Domain location=86-164; Score =12.1; E_value=1.5; Accession=PF07646.6; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=169-217::222-270::301-350::373-419::98-164::169 -217::222-270::301-350::373-416::86-164
MDVDSSMVPETDHDPAVQNHAADDPAPDAAEGEQLGEPPSSGGGSPEQTQPAPASAPQSPVVGPRLAPSYTVVNAILEKKEDGPGPRCGHTLTAVAAVGEEGTPGYIGPRLILFGGATALEGNSAATGTPSSAGNAGIRLAGATADVHCYDVLTNKWSRITPFGEPPTPRAAHVATAVGTMVVIQGGIGPAGLSAEDLHVLDLTQQWPRWHRVSVQGPGPGPRYGHVMALVGQRYLMAIGGNDGKRPLADVWALDTAAKPYEWRKLEPEGEGPPPCIAYGLAKHRDGRWEWAIAPGVSPSPRYQHAAVFVNARLHVSGGALGGGRMVEDSSSVAVLDTAAGVWCDIKSVVTSSRTGRYSADAAGGDAAVELTRRCRHAAAAVGDLIFIYGGLRGGVLLDDLLVAEDLAAAETTAAASHAAAAAAASASNVQAGRLPGRYGFADDRTRETMPEAAADGSVVLGNPVAPPMNGDIYTDISTENAMLQGPRRTAKGVEYLVEASAAEAEAISAALAAAKARQENGEVELPDRDRGAEATPSGKQTSSLIKPDSAGSNNITPGGVRLHHRAVVVAAETGGALGGMVRQLSIDQFENEGRRVGYGTPENATAARKLLDRQMSINSVPKKVIAHLLKPRGWKPPVRRQFFLDCNEIADLCDSAERIFSSEPSVLQLRAPIKIFGDLHGQFGDLMRLFDEYGAPSTAGDIA

SEQ ID NO: 181824 - protein, 452 aa, Glycine max
  Coding DNA Sequence Number=SeqID_90139
  Gene Ontology: Mol. function=diacylglycerol kinase activity; Cellular component=nucleus; Biological process=activation of protein kinase C
  Homolog annotation: Hit_ID=A7Q618; Match level="QueryCoverage=98%, HitCoverage=93%, E-value=1e-154, Identity=61%"; Hit description =Chromosome chr14 scaffold_54, whole genome shotgun sequence
  Pfam annotation: Domain name=PPR; Domain location=262-296; Score =26.9; E_value=7.4e-05; Accession=PF01535.11; Description=PPR repeat
  Pfam annotation: Domain name=PPR; Domain location=297-331; Score =21.9; E_value=0.0023; Accession=PF01535.11; Description=PPR repeat
  Pfam annotation: Domain name=PPR; Domain location=333-367; Score=5.8; E_value=1.6; Accession=PF01535.11; Description=PPR repeat
  Pfam module annotation: Pfam domain module=PPR::PPR::PPR; Domain location=262-296::297-331::333-367
MKQIHAQLITNGLKYPTFWAKLIEHYCGSPDQHIANNARLVFQYFDKPDLFLFNTLIRCVQPNDSILIFRNEFSRGLMFFDEYTYNFVLGACARSPSASTLWVGRQLHALIVKHGVESNIVVPTTKVYFYASNKDIISSRKVFDEMPRRSTVTWNAMITGYSSLKEGNKKYALNALYLFIDMLIDVSGIKPTATTIVSVLSAVSQIGMLETGACIHGFAEKTVCTPEDDVFIGTGLVDMYSKCGCLDSALSVFWRMNQKNIMTWTAMTTGLAIHGKGKQSLEVLYKMGAYGVKPNEATFTSFLSACCHGGLVEEGLQLFLEMKRTFGVMPQIQHYGCIVDLLGRAGKLEEAYDFIMQMPINPDAVIWRSLLAACNIHGDVVMGEKVGKFLLQLEEWSSAESPKSEDYIALSNVYALAEKWDDVETVRIKMKAKSILNKAGSSAVQTVSMAVL

SEQ ID NO: 181825 - protein, 960 aa, Glycine max
  Coding DNA Sequence Number=SeqID_90140
  Gene Ontology: Mol. function=transcription regulator activity; Cellular component=nucleus; Biological process=regulation of transcription
  Homolog annotation: Hit_ID=Q2HVX8; Match level="QueryCoverage=98%, HitCoverage=100%, E-value=0.0, Identity=59%"; Hit description=Helix -loop-helix DNA-binding
MGFMLKEALRTLCGRNQWSYAVFWKIGCHNSKLLIWEECYYEPLPCPPHMFGMPDLPYQNGEGCWFSLEYRSSQLGIQEDDQVSSLINKMTVNNSVIIAGEGIVGRAAFTGSHQWILLNNFTKDAYPPQVYAEVHHQFSAGIQTVAVIPVLPHGVVQLGSFFPIIENMGFVKDVKSLILQLGCVSGALLSADYSEKLSNERLAGPPIAGVPVSVDRPVITSNCPPSVTTGSNQQNNSSHASMPCPLMEDTNTCQGSALTPLTRKLSQISNKPCQPKVIRMSKTSFASQQENRAVEAEVIPSDLDSCLQQHSVSYNARSAFSNITGLGSLGQSGLSVDNLALMEQQILSGIGNRDNVNPCVNASSSLNMSQLKTDGDHLLGHNMSFDSTSLVGGVPLHGGMSTLLSSTLITSSGSKSPRASTAVLSGVGVGIGPQNCVSSTKARVCSLANLTSQPGTFPKHVEGSDQKILPVDLKCASTNQKIDYDMLQAPNLPSFQVEEHVPINSQIPGFAHDCLLKDGSSQSMMTMDPKHKLDCAKPPSGDDLFDVLGVDLKNQLLNGNWDNLFTYESDANAENMDKKIAPMNMQGATTNPDIYSVKEAISDCGIFSGMGTDHLLDAVVSKAKSVVKQDSDDMSCRTTLTRNSTSSVPSPARRTVVSGHFQGGLFDLPKNDGKTGATETSFLRSGCNKDDAGNCSQTSSVYGSQLSSWVENSGSVKCENSASTRYSKRPDEACKPNRKRLKPGENPRPRPKDRQMIQDRVKELREIVPNGAKCSIDALLERTIKHMLFLQSVTKHADKLKQTGESKLKQTGESKIINKEGGLLLKDNFEGGATWAYEVGSQSMVCPIVVEDLNPPRQMLVEMLCEERGFFLEIADLIRGLGLTILKGVMEAHNDKIWARFAVEANRDLTRMEIFMSLVRLLEKTVKGNTSPSNAIDNMVYHSFPQAAQIPVTGRPSSLQ

SEQ ID NO: 181826 - protein, 127 aa, Glycine max
  Coding DNA Sequence Number=SeqID_90141
MAKTKTKRNLPRQCRREDATTPPSTPIEDERSTRLEGHEEDQRRSRRRRTRRRSQAFSKGRRRIRRRMRRSPMKVTKKQQWRGRRGRSNRNREEEEMAEMNPIMLGAPSSTQSKEANNRSTGFNFSH

SEQ ID NO: 181827 - protein, 332 aa, Glycine max
  Coding DNA Sequence Number=SeqID_90142
  Gene Ontology: Mol. function=SNAP receptor activity; Cellular component=integral to membrane; Biological process=intracellular protein transport
  Homolog annotation: Hit_ID=A7PXH5; Match level="QueryCoverage=97%, HitCoverage=98%, E-value=6e-98, Identity=60%"; Hit description =Chromosome chr12 scaffold_36, whole genome shotgun sequence
  Pfam annotation: Domain name=SNARE; Domain location=225-301; Score =54.1; E_value=4.7e-13; Accession=PF05739.10; Description=SNARE domain
  Pfam annotation: Domain name=Syntaxin; Domain location=37-156; Score =70.7; E_value=4.7e-18; Accession=PF00804.16; Description=Syntaxin
  Pfam module annotation: Pfam domain module=SNARE::Syntaxin; Domain location=225-301::37-156
MNDLLTDSFVGEASNGQPARQSDVEMGQVPRSNSDMGMEAFNKQIHEADKQIDKLSVLLQKLKEANEESKAVTKASAMKGIKSVAKASAIKAIKKRMEKDIDEVGKIAHGVKTKIEAISRDNLSNRQKPGCEKGTGIDRARMNMTNALTKKFKDLMTEFQTLRQRIQDEYREVVERRVITVTGTRPDDETIDRLIETGNSEQIFQRAILEAGRGQVVNTVEEIQERHDAVKEIEKKLLDLHQIYLDMAVLVDAQGEILDNIESQGTFSLICVNERLVQVNNAVDHVQRGTSALQNAKKLQKNSRKWMCIAIIILLIIVAIIVVGVLKPWKSS

SEQ ID NO: 181828 - protein, 314 aa, Glycine max
  Coding DNA Sequence Number=SeqID_90143
  Homolog annotation: Hit_ID=Q3C0H8; Match level="QueryCoverage=17%, HitCoverage=3%, E-value=3e-10, Identity=55%"; Hit description =Putative uncharacterized protein
MMREMEQKLAKVDALSDKVEGISNQLDKRCLQQHGTLSEINNAFDAISCKFCLSEDYLVDAYLAGLQDEYVNPVRLFKLRTMRGACSLAQEINLRQHDERKMATKNMSYMAPGSNNTIESTQDNRKSIKNAIVESESQPKEKSAAGTINRIVFPPKNSSRTLKALTVEELIELDEEEVTIVEEAECDNEDNPNISLLAIEVSWNKKIEGVWYVEEIEGVWYVSFNLDGRKKGKLLIGNDVELRHQLLEWMHSSIQGGHSGDTIWVVIDRMSKYVDFVALSQPYTVATLARHFMDQIYKLRGALVEIISDRDLFS

SEQ ID NO: 181829 - protein, 444 aa, Glycine max
  Coding DNA Sequence Number=SeqID_90144
  Homolog annotation: Hit_ID=A7QF54; Match level="QueryCoverage=20%, HitCoverage=33%, E-value=1e-08, Identity=41%"; Hit description =Chromosome undetermined scaffold_87, whole genome shotgun sequence
MERVAEPHHVLYVVNVVPEKRPQHVQELLQPARQAPPGQDLNQVPEIVRAVKRHPTHRVVADESRGHHEFGEQVGVDALRRVAAEVDSLAAEEIDGVRRVGVTLHVEVTEVEFPDEAVGGSEVGEISVGIRESETDLDQVKCINVGLEKAVVDGRWEVGFCGVYSVGTENDAGEFGVHGNERVIIDDLTNQLEFGFEVGCPDLADQDGLGMIRVRVWARVKRWGVDKFSQSINRSNGSSEVRVLLSMRHDAFYVRTSTTVAKNRRKSTWQPPEWADEYTKTVVCINTSSSSSFSYEDGHAQDLSSYCWWLHVDDTFFNASTYKDGFILRAVVDPSLYPKLYHVYGTCSLLSLTLARRITSLLDFSTTYPYFGALATQSFFSDKDLRLRQTASRVRCLLFRLQPPPTKCLRKIRWFHKWGLKSKDELREQPAAILHQWCHPVPHH

SEQ ID NO: 181830 - protein, 238 aa, Glycine max
  Coding DNA Sequence Number=SeqID_90145
MAHLAHVHRAADLPAARDLYDALDCLHGHGVEHLELRREPVAPRRNRAAAGEVRGAFSGRVDDDPAEGEILHEVVEQFDFVVGLGEFQGSGDHLGGVEEVHPEGGAEEPPLVGFGSDDAGKDGFALVVYVHGGDELRRRRCRWLCWDGIGRGVVEGGEGVGEDGAVGGGEGGDGGRGEGIVERRPRGGADVTPEVVFGAEAAEVRGGGSGGSEGGAVEAIKDVGLKDVGVDGGDVRRG

SEQ ID NO: 181831 - protein, 90 aa, Glycine max
  Coding DNA Sequence Number=SeqID_90146
MTEKQGERQEALTVNRGNDERAVCESGSFYKENDQMDQRTRACGITNMKESSGDGDIDEAGSTGARSKLGIGVKCFHCEEQFFSQAHVSE

SEQ ID NO: 181832 - protein, 444 aa, Glycine max
  Coding DNA Sequence Number=SeqID_90147
  Homolog annotation: Hit_ID=A7QF78; Match level="QueryCoverage=99%, HitCoverage=99%, E-value=1e-174, Identity=67%"; Hit description =Chromosome undetermined scaffold_87, whole genome shotgun sequence
  Pfam annotation: Domain name=DUF1022; Domain location=38-437; Score =659.3; E_value=3.1e-195; Accession=PF06258.2; Description=Protein of unknown function (DUF1022)
MRMKPIQLPEPPSPTAARGTPDIFESGVHTLVRRAVVIGNGFPSSENHSIGLLRALGLSHNHLLYRVTRPRGGINDWLHWLPLSVHRKFHYLISMFRAFSSKSHYLPLTSHPNGLSSILEADANHIVNLARETCEKEGPLLVVASGRDTISVASSIKRLAPDLVFVVQIQHPRSHLNRFDMVITPHHDYYPLTPEGQKQVPKFLRRWITPREPPDSHVVLTLGALHRIDFASLRSAAITWQDVFANVPRPLLVVNIGGPTSCEKEGLTVYPQKKKRIMLMIQLQGNCRYGVDLAKQLATCLLSVLGSCGSVRISFSDRTPQKLSNIIVKELGNNPKVYIWDGQEPNPQMGHLAWADAFVVTADSVSMISEACSTGKPVYIMGAERCRWKFTEFHKSLRERGVVRPFTGSEDISENWSYPPLDDTSDAAKRVHEALAARGWKLKI

SEQ ID NO: 181833 - protein, 37 aa, Glycine max
  Coding DNA Sequence Number=SeqID_90148
MHSAEEHCRRDKKEEEEEASKREGVNLSEQEKSLMTT

SEQ ID NO: 181834 - protein, 110 aa, Glycine max
  Coding DNA Sequence Number=SeqID_90149
CGRCGQTHHNIRSCKNIGVPIRPKKYVAPPTSNEDDDLLAQDEQALNEAEEAAAHVQEGPVEINLSQLNLSQDSDMKFMVLATIVPLVAKNKLNITRPKQRKVADKDDAV

SEQ ID NO: 181835 - protein, 191 aa, Glycine max
  Coding DNA Sequence Number=SeqID_90150
  Subcellular localization annotation: CTP_CleavageSite=34; ConfidenceScore=5.49e-01
MDINTHLALGGLLGTSGSNSTGKPKKPLNLSKVTCATWRTFVGEPMSIMEPMFLRGSWKDFLRRVRRSAKRGRRRKALGEENEEVVGVVVLVFVVVVVVVVLVFVGGDEATKRGGEEWRTSVMAGNERGLYLEYKKRKHKDFVSENAKVVTWSWIEGKCSSVSRVWDVRIINSVFLFNFHIFYVMLRAVER

SEQ ID NO: 181836 - protein, 66 aa, Glycine max
  Coding DNA Sequence Number=SeqID_90151
MSIGHMPFWKYKFLAGVQFEKEFKLLSEVFHGLIRMIDLNLQEELDGLKLEVAQLQAALDGLKPLK

SEQ ID NO: 181837 - protein, 471 aa, Glycine max
  Coding DNA Sequence Number=SeqID_90152
  Gene Ontology: Mol. function=structural constituent of ribosome; Cellular component=ribonucleoprotein complex; Biological process =translation
  Homolog annotation: Hit_ID=A2X451; Match level="QueryCoverage=42%, HitCoverage=68%, E-value=5e-86, Identity=81%"; Hit description =Putative uncharacterized protein
  Pfam annotation: Domain name=Ribosomal_L1; Domain location=142-335; Score=155.9; E_value=1.1e-43; Accession=PF00687.12; Description =Ribosomal protein L1pL10e family
MEESKLSHNIPTGSSRKLVTSQSPPSLSLEPNEKLKNNSQECKSPNTNDKAKDPEKGHSENIGKVDDDVEETGRERLKRLREEVTMEKVNIPENWGQEPKLKDWMDYTMFDAFFPHSLIVTARDALIANTRKANKLQSDALREAISGIMTDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGKFPTLVTHQESLESKVNETKAMVKFQLKKVLCMGVAVGNVSMEEKQIFQNVQLSVNFLVSLLKKNWQNYRVTVMQAWSIIAAVYSYMIGLRRIIGANSEINVWRVEATMAGNHGLEQLPISRLQAKDRVIWRLSPNGVYLAKSGYQAIESSHRNKLSTISTVELHHQMVVKTKIIYSVHHLRRERKSSRFHHQVKGDNTMGQKGKKLVMRGSS

SEQ ID NO: 181838 - protein, 84 aa, Glycine max
  Coding DNA Sequence Number=SeqID_90153
MDEDQWMYDSMMSEEVDINIKNEEDVGVKVEHVDCSDAFNTSQLFACRDEVLQWAQSLAHDIGFVVVIMRSDNNTGVQGRVDSL

SEQ ID NO: 181839 - protein, 354 aa, Glycine max
  Coding DNA Sequence Number=SeqID_90154
  Gene Ontology: Mol. function=protein dimerization activity; Cellular component=nucleus; Biological process=regulation of transcription, DNA-dependent
  Homolog annotation: Hit_ID=A7PPE8; Match level="QueryCoverage=92%, HitCoverage=95%, E-value=1e-38, Identity=34%"; Hit description =Chromosome chr8 scaffold_23, whole genome shotgun sequence
  Pfam annotation: Domain name=bZIP_1; Domain location=276-335; Score =36.5; E_value=9.5e-08; Accession=PF00170.12; Description=bZIP transcription factor
  Pfam annotation: Domain name=bZIP_2; Domain location=272-326; Score =42.0; E_value=2.1e-09; Accession=PF07716.6; Description=Basic region leucine zipper
  Pfam annotation: Domain name=bZIP_Maf; Domain location=251-334; Score= -30.3; E_value=0.074; Accession=PF03131.8; Description=bZIP Maf transcription factor
  Pfam module annotation: Pfam domain module=bZIP_1::bZIP_2::bZIP_Maf; Domain location=276-335::272-326::251-334
MVVSETKAVAYDRLFQELAPLSTHMSLQQPNQEVPLQEPEATFSQLSKQNSILSLTLDEFYCKNGKSLGSMNMDEFLSSIWNSDDNNQVNPSLPTLDEAAKGKSVVATEPTTISQPLSVPPPICKKTVDEIWSQIHKSQPHYNEANNSLARNEPLLKRQQTLGEMTLEDFLVKAGVVQESSSLFKSSLLYQNQIGNIASNGPLSASYRFRHVIGTGSSVSCNGLETQNMLAQNNNLVIKDVTTNGAVEKCPSLGESSGKGNRKRIIDGPPEVVVERRQRRMLKNRESAARSRARRQAYTVELEAELNLLKEENEKLKQTLADAERKRKQEKAHNNGSKEDRKIEVNEEASKRIL

SEQ ID NO: 181840 - protein, 177 aa, Glycine max
  Coding DNA Sequence Number=SeqID_90155
  Gene Ontology: Mol. function=protein binding; Cellular component =cytoplasm; Biological process=multicellular organismal development
  Homolog annotation: Hit_ID=Q9XH43; Match level="QueryCoverage=96%, HitCoverage=97%, E-value=1e-77, Identity=77%"; Hit description=CEN -like protein 2
  Pfam annotation: Domain name=PBP; Domain location=22-169; Score =238.7; E_value=1.3e-68; Accession=PF01161.11; Description =Phosphatidylethanolamine-binding protein
MAMNMISSDPLVIGKVIGDVVDHFTPTVKITVSYNNNKQVYNGHEFFPSSVTTKPKVQIHGGDMRSFFTLVMTDPDVPGPSDPYLREHLHWLVTDIPGTTDATFGNEVVEYEIPRPNIGIHRFVFLVFKQKRRQGVLKTPTTRDLFNSRSFAEENELGPPVAAVFFNAQRETAARRR

SEQ ID NO: 181841 - protein, 189 aa, Glycine max
  Coding DNA Sequence Number=SeqID_90156
MALVRLVKAQVLVVILVLAAPELAQGRLQNLFAGMPMEAGMMWDGNMQFQLKATTKLQRKLSQKVVAGLKKMMKKPGMTKESIGAEKRKGNEVDDIDNVGIGNIFKRRAVSSQDTNNPMFKKDLHDVFSDNEWTMENNDGIEGLDVANLDLDAPIQDENLVEDQEIEDRDEDLVQDQVGEETLGDHDMI

SEQ ID NO: 181842 - protein, 75 aa, Glycine max
  Coding DNA Sequence Number=SeqID_90157
MSDIKVKNENKLKFIGECATRNDFRYMSLGSKKCKRWSRKPINFFETLVKVEESKGYMEEMRSFYEEKKTKTKSE

SEQ ID NO: 181843 - protein, 141 aa, Glycine max
  Coding DNA Sequence Number=SeqID_90158
  Homolog annotation: Hit_ID=A7PQF4; Match level="QueryCoverage=85%, HitCoverage=71%, E-value=7e-49, Identity=78%"; Hit description =Chromosome chr6 scaffold_25, whole genome shotgun sequence
MDETILVGDDLMTGPPSPVVPPEIASHVLQGVDLCDGILRNLFLCLQINDIEPFCQDEIALYKQCAERRDKEIRKRLQDSEFKLGSSMPLDEAKGRASQLEAEVTSLESAFVGGSLVSSLIIVELFFWSGRPVIFTLAFFP

SEQ ID NO: 181844 - protein, 67 aa, Glycine max
  Coding DNA Sequence Number=SeqID_90159
  Gene Ontology: Mol. function=cytochrome-c oxidase activity; Cellular component=mitochondrial respiratory chain; Biological process =electron transport
  Homolog annotation: Hit_ID=A9PB26; Match level="QueryCoverage=98%, HitCoverage=97%, E-value=2e-27, Identity=86%"; Hit description =Putative uncharacterized protein
  Pfam annotation: Domain name=COX7a; Domain location=9-62; Score =107.8; E_value=3.2e-29; Accession=PF02238.6; Description=Cytochrome c oxidase subunit VIIa
MTEPPFRPREKLIEKQKYFQNIHKHTYLKGPYDKITSVAIPLALAATSLYLIGRGIYNMSHGIGKKE

SEQ ID NO: 181845 - protein, 626 aa, Glycine max
  Coding DNA Sequence Number=SeqID_90160
  Gene Ontology: Mol. function=oxidoreductase activity; Cellular component=integral to membrane; Biological process=potassium ion transport
  Homolog annotation: Hit_ID=A2Z469; Match level="QueryCoverage=68%, HitCoverage=92%, E-value=1e-167, Identity=67%"; Hit description =Putative uncharacterized protein
  Pfam annotation: Domain name=Aldo_ket_red; Domain location=143-456; Score=207.6; E_value=2.9e-59; Accession=PF00248.12; Description =Aldoketo reductase family
  Subcellular localization annotation: CTP_CleavageSite=37; ConfidenceScore=5.81e-01
MAAIVSHHHHRLFSASTRFNSTSRDSRRRRSGSNSVRCADVSTATSENRRVTVSNRNDSLEICRVLNGMWQTSGGWGRIDRDDAVEAMLRYADAGLTTFDMADHCTFSSYSQLLLLTWSFPIGLLFLLPPLLPDNRSIAVKNGNDSLVICRVVNGMWQTSGGWGRIDRDDAVDAMLKYADAGLTTFDLADIYGPAEDLYGIFIDRVRRERPPELLEQVRGLTKWVPPPVKMTSSYVRDSINVSRKRMDVESLDMLQFHWWDYSNPGYLDALKHLTDLKEEGKIKTVALTNFDTERLQIILENEIPVVSNQVQHSLVDMRPQQRMAELCQHTGVKLITYGTVMGGLLSEKFLDTNISIPFAGPAINTPSLQKYKRMVDAWGGWSLFQGLLRTLKQVASKHGVSIATVGVKYILDQPAVAGSMVGVRLGLAEHIQDTNAIFSLVLDEDDMNSIREATAKGKDLLKVIGDEKKGGDKGKVFEPNFVSVEEFYWNNEDIIVVDSSASHGINIHQISESGEVPSSNDNEGINGANNIREVNRGERVIGAVEIGARERNDEVLAHIRVGNGVSLAELVGGDEADVDGVGDGGGRQRAASCRRASRGECGAPRRVRDIDDVHSEKRNGIDLEE

SEQ ID NO: 181846 - protein, 149 aa, Glycine max
  Coding DNA Sequence Number=SeqID_90161
  Gene Ontology: Cellular component=anchored to membrane; Biological process=cell wall catabolic process
  Homolog annotation: Hit_ID=A7NVC3; Match level="QueryCoverage=71%, HitCoverage=25%, E-value=1e-32, Identity=68%"; Hit description =Chromosome chr18 scaffold_1, whole genome shotgun sequence
  Pfam annotation: Domain name=LysM; Domain location=103-145; Score =32.4; E_value=1.6e-06; Accession=PF01476.11; Description=LysM domain
  Subcellular localization annotation: CTP_CleavageSite=61; ConfidenceScore=5.78e-01
MPSTSLTSTWSTTFSPRSSSSKSPSPAPALRTFANPSLLTTRPAPLTPSSIVDVAYVGLVSSDQLREANSISDPDVGQNLVVPLPCTCFNGSDNSLPAIYLSYVVRPVDTLAVVAVRYFTTFTDLMNVNSMGSTAINDGDILVIPILDN

SEQ ID NO: 181847 - protein, 715 aa, Glycine max
  Coding DNA Sequence Number=SeqID_90162
  Gene Ontology: Mol. function=transporter activity; Cellular component= integral to membrane; Biological process=transport
  Homolog annotation: Hit_ID=A7PQI8; Match level="QueryCoverage=96%, HitCoverage=91%, E-value=0.0, Identity=68%"; Hit description =Chromosome chr6 scaffold_25, whole genome shotgun sequence
  Pfam annotation: Domain name=Xan_ur_permease; Domain location=166 -634; Score=134.9; E_value=2.3e-37; Accession=PF00860.11; Description= Permease family
MSDSVPKTRNRPGPWPPAPDAKAMPPASWAKKTGFKPKFSGEANASDSGQISLQPKPREPDANVDLEAGRPGAPANGVTHQNKAPPLPPSKDQVVKKRKDSDGLPKSSVPITNGQAVTAPPPPPPPPPRRTARHEEVVDAPPQEDDGFVSRHSHMKYELRDSPGLVPIGVYGIQHYFSILGSLILIPLVIVPAMGGSHEDTSAVASTVLFVSGVTTLLHTSFGSRLPLIQGPSFVYLAPVLAIINSPEFQGLNANLFVRCHGLLYYVYCEVFDGKFKHIMKELQGAIIIGSAFQTFIGYSGLMSLLVSMVIFTSEYPRVPDVSTLWLINPVVVSPTIAAVGLSFYSYGFPLVGTCLEIGAVQILVVIVFSLYLRKISVLGHRIFLIYAVPLGLAITWAVAFLLTEAGVYNYKGCDINIPASNMVSEHCRKHVSRMKHCRVDTSNALKSSPWFRFPYPLQWGTPIFHWKMALVMCVVSLISSVDSVGSYHASSLLVASRPPTPGVLSRGIGLEGLSSVLAGLWGTGTGSTTLTENVHTIAVTKMGSRRAVQLGACFLIVLSLVGFRRIFWWGKVGGFIASIPEVMVAGLLCFMWAMLAALGLSNLRYSEAGSSRNIIIIGLSLFFSLSIPAYFQQYGISPNSNLSVPSYFQPYIVASHGPFHSKYGGCTSANNKHEYWGVVITHNLVSFLIYGTGMLATSIFKRKFNIVGLHVRLF

SEQ ID NO: 181848 - protein, 166 aa, Glycine max
  Coding DNA Sequence Number=SeqID_90163
  Gene Ontology: Mol. function=aspartic-type endopeptidase activity; Biological process=DNA integration
  Homolog annotation: Hit_ID=A5BP26; Match level="QueryCoverage=44%, HitCoverage=8%, E-value=6e-15, Identity=49%"; Hit description =Putative uncharacterized protein
MESRNDGSSFGEEQGGLHRRFPPDANHKSTTDPTYAAWTREEAQREIIVNCIPSLNSNIMAFAVNSTTKNTTNGKSRNPKKERPQCAHCNLLGHTKDKCYKLVGYPPNYFKNKPQHTVNQVIDYDESSSQGATNNLSTAQCQQLISFLTNQLKTENSVDTLATNVS

SEQ ID NO: 181849 - protein, 1590 aa, Glycine max
  Coding DNA Sequence Number=SeqID_90164
  Gene Ontology: Mol. function=metal ion binding; Biological process =proteolysis
  Homolog annotation: Hit_ID=Q53PX0; Match level="QueryCoverage=97%, HitCoverage=90%, E-value=0.0, Identity=31%"; Hit description =Expressed protein
  Pfam annotation: Domain name=C1_2; Domain location=1542-1569; Score =13.1; E_value=0.11; Accession=PF03107.7; Description=C1 domain
  Pfam annotation: Domain name=C1_2; Domain location=390-415; Score =5.6; E_value=0.73; Accession=PF03107.7; Description=C1 domain
  Pfam annotation: Domain name=C1_3; Domain location=1541-1569; Score =4.1; E_value=0.17; Accession=PF07649.3; Description=C1-like domain
  Pfam annotation: Domain name=C1_3; Domain location=389-415; Score =5.2; E_value=0.13; Accession=PF07649.3; Description=C1-like domain
  Pfam annotation: Domain name=DDT; Domain location=182-242; Score =42.8; E_value=1.2e-09; Accession=PF02791.8; Description=DDT domain
  Pfam annotation: Domain name=PHD; Domain location=1269-1319; Score =2.6; E_value=0.0066; Accession=PF00628.20; Description=PHD-finger
  Pfam annotation: Domain name=PHD; Domain location=390-435; Score =41.0; E_value=4.3e-09; Accession=PF00628.20; Description=PHD-finger
  Pfam module annotation: Pfam domain module=C1_2::C1_2::C1_3::C1 _3::DDT::PHD::PHD; Domain location=1542-1569::390-415::1541-1569::389- 415::182-242::1269-1319::390-435
MEEPPVVRSRGRPRKRRREDDATVTGDAKTLPEAKKMMPIALVGRYVLKEFRRNTVLLGKVARYASGLYRVVYESGGFEDLDSSEIRRILLLDSYFDDDLIRRKVELEESVLPKIAAEEPEKGSSELQGELSVENEEERAKTDDDESFGEARDSSSGSEMPETQIPPPLTLPPSSGTIGVPEPCVLNLFSVYGFLRSFSIRLFLSPFTLDEFVGALNCKVSNTLLDAIHVSLMHILKRHLENISPDGSRPATKCLSFISFVFDHAYRVIDRSVYLAIFGYTKGPEWKGFYDEIFYGEYYLLPASRKLTILQILCDEVLASEELKAEMNMREESEVGINYDNEDSLPAENGPRRVHPRYSKTTACKDAETKKYVSELNAEDDGDVDGNGDECRLCGMDGTLLCCDGCPAVYHSRCIGVMKMHIPEGAWYCPECKINLIGPTIARGTSLKGAEVFGKDLYGQVFMGTCDHLLVLNVKSDDFCLKYYNQNDIPRVLQVLYASEQHRPVYNGICMAMLEYWNISENFLPLCVSKLPPMIEEEHKAVSSVKADYSLTFGNGICSDNLVPSLDASLVTTRSPAPGSSGNARTTVNLKLHEETAMDSSVSTNHQSDPKCRNYVNRSAAVSPAKCSLVSSQFSNYGDANDIGLPMNLSLQTKGDQSGFGKCKSSLINDFVYMGCSYKPQSYINYYMHGDFAASAAANLAVLSSEDSRSEGHVSGNLGKATSGNTYLLAKAFSQTASRFFWPSSEKKLVEVPRERCGWCISCKAPVSSKKGCMLNHAAISATKSAMKILSGFAPVRSGEGIIPSIATYVIYMEESLHGLIVGPFLSEWYRKHWRKQVERAKSFSDIKPLLLKLEENIRTIAFCGDWVKLMDDWLAEFSTMQSAACTLGTTQKRATCGRRKKQLSINKVTAGGCQENFAWWHGGKFTKSVFQKAVLPKSMVRKGARQAGGLRKISGIFYADGSEIPKRSRQLVWRAAVQMSRNASQLALQVRYLDFHIRWSDLIRPEHNLQDVKGQDTEASAFRNANIRDKKIAEGKILYRVAFGSQKHLPSRVMKNVEIEQGPEGMEKYWFSETRIPLYLLGNDFYLVTVLFMCLCAIPSFFSRQFFLRPQFFSWFNFRNALKCSACQGYCHTGCSVSSTVSTCEEVEFLATCKQCHHAKLLTQKESCNESPTSPLLLQGQERSTLAVLKGPRPKCDGQGLISTRTKNSRLDMKLVASDFPLETKGRSRSCSWGVIWKKKNNEDTGFDFRLKNILLKGGSGLPQLDPVCRLCHKPYRSDLMYICCETCKHWYHAEAVELEESKLFDVLGFKCCKCRRIKSPVCPYSDLYKMQEGKKLLTRASRKEHFGADSDSGTPIDTRTCEPATPIYPAGDVSRQDNDPLLFSLSSVELITEPQLNADVAGNTVSGPGLLKLPKRGRENNGSFRGNLHAEFSTSNENEMVSKSVKDLSPVEYGSADCNLLNNSEIVKFDALVDFEPNTYFSLTELLHTDDNSQFEEANASGDLGYLKNSCRLGVPGDCGTVNLASNCGSTNSLQGNVNNCRLCSQKELAPDLSCQICGIRIHSHCSPWVESPSRLGSWRCGDCREWR

SEQ ID NO: 181850 - protein, 150 aa, Glycine max
  Coding DNA Sequence Number=SeqID_90165
  Gene Ontology: Mol. function=signal transducer activity; Biological process=response to light stimulus
  Homolog annotation: Hit_ID=Q6JJ40; Match level="QueryCoverage=26%, HitCoverage=6%, E-value=1e-10, Identity=67%"; Hit description =Putative non-phototropic hypocotyl 3-like protein
MECWEGGTSLGDRGELGGEGGSGVPGVAPAAGAPPVAPSPKALADASASGALPAAPSCAAPTPHVACTAEAHIWEALCNKKTDPQSKVEKRGSFLPSPMAPAGKLSGFRREGSDWFCNGGLPSDITVSIDGVTFHLHKKLSIPLQIRELD

SEQ ID NO: 181851 - protein, 630 aa, Glycine max
  Coding DNA Sequence Number=SeqID_90166
  Gene Ontology: Mol. function=sequence-specific DNA binding; Cellular component=nucleus; Biological process=regulation of transcription, DNA-dependent
  Homolog annotation: Hit_ID=A7PXH2; Match level="QueryCoverage=91%, HitCoverage=78%, E-value=0.0, Identity=81%"; Hit description =Chromosome chr12 scaffold_36, whole genome shotgun sequence
  Pfam annotation: Domain name=Homeobox; Domain location=109-165; Score= 84.5; E_value=3.5e-22; Accession=PF00046.20; Description=Homeobox domain
  Pfam annotation: Domain name=START; Domain location=303-522; Score =306.5; E_value=4.9e-89; Accession=PF01852.10; Description=START domain
  Pfam module annotation: Pfam domain module=Homeobox::START; Domain location=109-165::303-522
MPAGIMIPARNMPSMIGRNGTVGGFGLSSGLSLGHIENHKASESQRSVEMFQPNLMEAGQLHPLDMPQNTSESDVPRIREDDFDSATKSGSENLEGASGEDQDPRPNKKKRYHRHTQHQIQEMEAFFKECPHPDDKQRKELSRELGLEPLQVKFWFQNKRTQMKTQHERHENTQLRTENEKLRADNMRFREALGNASCPNCGGPTAIGEMSFDEHHLRLENARLREEIDRISAIAAKYVGKPVVSYPLVSPSSVPPRPLELGVSGGFGGQPGGIGGDMYGGAAGDLLRSISGPTEADKPIIIELAVAAMEELIGMAQMGEPLWLTTLDGTTVLNEDEYIRSFPRGIGPKPVGFKCEASRETAVVIMNHVNLVEILMDVNQWSTVFSGIVSRAMTLEVLSTGVAGNYNGALQVMTAEVQVPSPLVPTRESYFVRYCKQHGDGTWAVVDVSLDNLRPSPSARCRRRPSGCLIQEMPNGYSKVIWVEHVEVDDRGVHNLYKQLVSSGHAFGAKRWIANLDRQCERLASAMATNIPTVDVGVITNPDGRKSMLKLAERMVISFCAGVSASTAHTWTTLSGTGADDVRVMTRKSVDDPGRPPGIVLSAATSFWLPVSPKRVFEFLRDENSRSEVT

SEQ ID NO: 181852 - protein, 133 aa, Glycine max
  Coding DNA Sequence Number=SeqID_90167
  Homolog annotation: Hit_ID=Q1SN17; Match level="QueryCoverage=57%, HitCoverage=16%, E-value=3e-11, Identity=45%"; Hit description =Transposase, putative
MSQKVDMDYENEQECGVNEPHVDCLDAFNTSQWARSVAHENEFVAVIMRFDTEEEDEKIIIVDMTKSMVKPRNILLTLKEHNVNSCTTIKQIYNARSAYHSSIRGSDTEMQHLMTLLEHDQYIHWHRLKDEFV

SEQ ID NO: 181853 - protein, 518 aa, Glycine max
  Coding DNA Sequence Number=SeqID_90168
  Homolog annotation: Hit_ID=A7UQU7; Match level="QueryCoverage=49%, HitCoverage=51%, E-value=1e-26, Identity=31%"; Hit description=IMP dehydrogenase/GMP reductase, putative
  Pfam annotation: Domain name=DUF1723; Domain location=134-183; Score =38.3; E_value=2.7e-08; Accession=PF08330.1; Description=Protein of unknown function (DUF1723)
ANDVSQQCRPTVSARRQREAFPVAEDVFEMIEDVPAPGAEGLVGDGAEGLAGDGAKGVAGDDAEGFPGGPRDPSVLTSFADHVAHSIWNGEERPKLKLAFHGRKVEKFGSPALEIEGLVVAIELTPLIACSVDTGDRGDISAFFEKWHKETSSFHPPVGELTITLDDVASLLHLSIIGTFHSFEPLHVDEAVIMLVELLEVSARAYLLHLVGCTFFANKSATHVHVVHLDAFGDLARSGSYAWGVAAPVHMYDQLNDASQSTGRQLAGYITLLQQFPSVHESVTNDGYDETTPHVCQWLTTKDYMKGLTTSSYRTRIDALTIPNFGYIQTILPLPISATLSSEDIDDRWMHYSDHLVAAGQICLVAGQHPLVPQHEAYVEPDIPEVLVAPEAGPSQATDLPKHAVDACEAISERLERVFNLSMVTEGTELHDLMEDCLRIVLRKEWIIKAKNVERKGRVQAWNAKRSALRPGTQHVLILDCALGACLALSACLVLSARNESCFFMLNGSLSACATLHA

SEQ ID NO: 181854 - protein, 235 aa, Glycine max
  Coding DNA Sequence Number=SeqID_90169
  Gene Ontology: Mol. function=serine-type peptidase activity; Cellular component=lysosome; Biological process=proteolysis
  Homolog annotation: Hit_ID=A7PQM2; Match level="QueryCoverage=87%, HitCoverage=44%, E-value=1e-65, Identity=59%"; Hit description =Chromosome chr6 scaffold_25, whole genome shotgun sequence
HRYYGKSVPFGSREEALKNASTIGYFNSAQAIADYASVLIHIKKTLHAQKSPCLLHGLGSNIPTWLLVLWPHQLQSSTSIILPHKTEASETCYQTILKSWSEIDRVASQPKGLSILSQRFNTCRPLNESSELKDYLINMYASSAQYNHPPRYPVTVICGGIDRASFGSDILSKIYAGLVALRGNTTCKVNGPIIVSETTLGWRWQIESSIKGTHNIYTAEMEGFGLSLPYLVTKD

SEQ ID NO: 181855 - protein, 99 aa, Glycine max
  Coding DNA Sequence Number=SeqID_90170
MYMMMIPVDQSGHSLGLNSTLESDGFATRLMGVKVLVLDEEAINIPALPAATSSQSSSSSTTVLQKHVIEQSFPVLPLRFWEAPSLTIPSFSHVKAFPP

SEQ ID NO: 181856 - protein, 276 aa, Glycine max
  Coding DNA Sequence Number=SeqID_90171
  Gene Ontology: Mol. function=aspartic-type endopeptidase activity; Biological process=proteolysis
  Homolog annotation: Hit_ID=A7QMM5; Match level="QueryCoverage=73%, HitCoverage=34%, E-value=3e-16, Identity=28%"; Hit description =Chromosome chr19 scaffold_126, whole genome shotgun sequence
MGRRMMQWNTITKASILITITLHLILPVAVNSMRLELVHRHHERFSGGGGDVDQVEAVKGFVNRDGLRRQRMNQRWGVSNYDRRRKGLETTTTTEVEMPMRAGRDDALGEYFTEVKVGSPGQRFWLAADTGSEFTWFNCVMRNATTTATTKKTRKNKTKKKHHHHSKRNRTRTTRRTKKKKAKSNPCKGVFCPHRSKSFQAVTCASQKCKIDLSQLFSLSLCPKPSDPCLYDISWKKMNWMREGEWMKVEGERREKSMAVFLGLKFSLCFVGDGDG

SEQ ID NO: 181857 - protein, 1628 aa, Glycine max
  Coding DNA Sequence Number=SeqID_90172
  Gene Ontology: Mol. function=nucleotide binding; Cellular component =myosin complex; Biological process=protein amino acid phosphorylation
  Homolog annotation: Hit_ID=B0CN60; Match level="QueryCoverage=99%, HitCoverage=99%, E-value=0.0, Identity=67%"; Hit description=Myosin XI-F
  Pfam annotation: Domain name=DIL; Domain location=1440-1547; Score =201.9; E_value=1.6e-57; Accession=PF01843.10; Description=DIL domain
  Pfam annotation: Domain name=IQ; Domain location=707-727; Score=23.3; E_value=0.00089; Accession=PF00612.18; Description=IQ calmodulin -binding motif
  Pfam annotation: Domain name=IQ; Domain location=730-750; Score=26.9; E_value=7.5e-05; Accession=PF00612.18; Description=IQ calmodulin -binding motif
  Pfam annotation: Domain name=IQ; Domain location=755-775; Score=23.5; E_value=0.00077; Accession=PF00612.18; Description=IQ calmodulin -binding motif
  Pfam annotation: Domain name=IQ; Domain location=778-798; Score=21.4; E_value=0.0035; Accession=PF00612.18; Description=IQ calmodulin -binding motif
  Pfam annotation: Domain name=IQ; Domain location=803-823; Score=14.8; E_value=0.34; Accession=PF00612.18; Description=IQ calmodulin-binding motif
  Pfam annotation: Domain name=IQ; Domain location=826-846; Score=22.5; E_value=0.0015; Accession=PF00612.18; Description=IQ calmodulin -binding motif
  Pfam annotation: Domain name=M; Domain location=1032-1052; Score =10.5; E_value=5.3; Accession=PF02370.7; Description=M protein repeat
  Pfam annotation: Domain name=M; Domain location=860-880; Score=5.8; E_ value=22; Accession=PF02370.7; Description=M protein repeat
  Pfam annotation: Domain name=M; Domain location=949-969; Score=2.1; E_ value=70; Accession=PF02370.7; Description=M protein repeat
  Pfam annotation: Domain name=Myosin_N; Domain location=10-51; Score =34.2; E_value=4.7e-07; Accession=PF02736.10; Description=Myosin N -terminal SH3-like domain
  Pfam annotation: Domain name=Myosin_head; Domain location=64-691; Score=892.9; E_value=1.5e-265; Accession=PF00063.12; Description =Myosin head (motor domain)
  Pfam annotation: Domain name=Pox_A_type_inc; Domain location=1032 -1054; Score=3.0; E_value=31; Accession=PF04508.3; Description=Viral A-type inclusion protein repeat
  Pfam annotation: Domain name=Pox_A_type_inc; Domain location=892-914; Score=0.5; E_value=72; Accession=PF04508.3; Description=Viral A-type inclusion protein repeat
  Pfam annotation: Domain name=Pox_A_type_inc; Domain location=956-978; Score=15.4; E_value=0.21; Accession=PF04508.3; Description=Viral A -type inclusion protein repeat
  Pfam module annotation: Pfam domain module=DIL::IQ::IQ::IQ::IQ::IQ::IQ ::M::M::M::Myosin_N::Myosin_head::Pox_A_type_inc::Pox_A_type_inc::Pox_ A_type_inc; Domain location=1440-1547::707-727::730-750::755-775::778- 798::...
  Pfam module annotation: Domain location=803-823::826-846::1032 -1052::860-880::949-969::10-51::64-691::1032-1054::892-914::956-978
MGTPVNIIVGSQVWVEDPEDAWIDGEVTQIKGKNATIIATNGKTVVAEISSIYPKDTEAPPAGVDDMTKLAYLHEPGVLHNLATRFSLNEIYTYTGNILIAVNPFRRLPHLYDIHMMEQYKGAAFGELSPHLFAVADTCYRAMINENGSQSILVSGESGAGKTETTKMLMRYLAFMGGRSATEGRTVEQQVLEVYAVTFSLLQSNPVLEAFGNAKTVKNNNSSRFGKFVEIQFDKNGKISGAAIRTYLLERSRVCQVSDPERNYHCFYMLCAAPPEDVKKYKLGDPRQFHYLNQSNCYQVSNVDDAKEYLETRNAMDIVGISQEEQDAIFRVVAAILHLGNVDFVKGKEVDSSKLKDDKSLFHLQTAADLFMCDAKALEDSLCERVIVTPDGNITKPLDPDAAALSRDALAKTVYSKLFDWIVDKINSSIGQDSNAHVFKMEQEEYTKEEINWSYVEFVDNQDVLDLIEKKPGGIIALLDEACMFPKSTHETFAQKMYQTYKGHKRFSKPKLSRTNFTINHYAGDVTYQADYFLDKNKDYVVAEHQALLCASKCSFVANIFPPLPEETSKQSKFSSIGSQFKQQLQSLMETLNTTEPHYIRCVKPNTVLQPGIFENFNVLNQLRCGGVLEAIRISCAGYPTKRTFEEFLDRFGMLVPDVLDGSDEKKASMAICDKMGLKGYQMGKTKVFLRAGQMAELDARRAEVLAKAAKLIQRQIRTHLTRKEFITLRKATIHIQKIWRAKLARKLYENMRREAASIRIQKHVRAHRARMNYTTLQASAIVIQSGLRALAARNEYRYRRRTKASTKIQTQWRRAQALSGYKQQKKATVALQCLWRAKVARKELRKLRMAARETGALKEAKDKLEKRVEELTWRLDIEKHMRTDLEEAKGQEIAKLQNALQEMQGQLDEAHAAIIHEREAAKIAIEQAPPVIKEVPVVDNTKLDLLTNKNEELETEVEELKNKIKDFEERFSEVENENQERLKEAEEAQLKATQLQETIERLELSLSNLESENQVLCQKALEESKNEELFEEIKILKDQIANLESENESLRRQAAAVAFEQKVHPEKIESDHSAASLEQKVQPEKIEPGHSATALEQKVNPEKIEPVHSATALEQKVHPEKIEPDHSAAALEQKVHPEKIEPDHEVAVAEKMQVQPRVIADNMTSQIKNLDNGSSTEEEWQARKEPRAPVFLLTKQRSLTDRQQESHDALLKCLTEDKRFEKNRPAVACIVYKSLLHWRSLEAEKTHIFDKITHAIRSSIESQEGIHDLAYWLSTTSTLLFYLQCTMKASNTTKAVSRNRNSPASLFGKMAQGLRSSSMGLGISSGYSGMVDKTNGQSKVEAKYPAILFKQHLTAYVEKIYGMIRDSLKKEISPFLNLCIQAPRSIRTRSIRGSSRNIHSNIVAKQQALHMYWKGIVDKLDTALRILSDNYVPPIITRKIFSQVFSFMNVQLFNSLLLRRECCSFSNGEYLKAGLHELELWCLKATDQFAGSSWDELKHIRQAVGFLVLHQKTQKSLEEITNELCPVLSIPQIYRIGTMFWDDKYGAHGLSAEVISRMRVIMTEDSINIHNSSFLLEVDSSIPFLMEEMFRSMSDIRLSDMDVDPPPILRQRSDFQFLLQQMDSDSQ

SEQ ID NO: 181858 - protein, 168 aa, Glycine max
  Coding DNA Sequence Number=SeqID_90173
  Homolog annotation: Hit_ID=A5BKB8; Match level="QueryCoverage=46%, HitCoverage=22%, E-value=4e-36, Identity=94%"; Hit description =Putative uncharacterized protein
MGGGAWPFLVGGAICLVNSVNERDLSLLNSYVEIIAIVGLQRGIPSKRESSARVDYVPALCTHRPSLLPIEWSGEVFGLRDVSVRCPRRVRSPLNLSFRGRRSRNKVSVGEPAEGSLSMPHNQIDPRTCLFIYRREGGDDHGAPCARPPRPRDKHKPRRFVRQGTQIC

SEQ ID NO: 181859 - protein, 258 aa, Glycine max
  Coding DNA Sequence Number=SeqID_90174
  Homolog annotation: Hit_ID=Q6WAY6; Match level="QueryCoverage=36%, HitCoverage=16%, E-value=1e-11, Identity=38%"; Hit description =Putative uncharacterized protein
EGKEGVLFSCGDYPNVPLIGTRGCINYNPALAIRQLGYPMRGAPTEESLSPFLVRDLGAQSLKVMQRVHKAWRSPLRKDKELRGIRNGVISGYHGWLRVHTRGLDWLSKLKVINEENFEAPEEDEEVQALKLELGKARLAKEKFKSAATHIRKEYARVQEETQPLQEPLNKKPKGPQGGIWPREIPRSIMGSKRSLAQHLEATEQSMLAIIGQYKEELNQSVTHEQKLAEEFAQVFALTLNGSQDLPRLLAKAKAMAE

SEQ ID NO: 181860 - protein, 132 aa, Glycine max
  Coding DNA Sequence Number=SeqID_90175
  Homolog annotation: Hit_ID=O52175; Match level="QueryCoverage=62%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEE

SEQ ID NO: 181861 - protein, 155 aa, Glycine max
  Coding DNA Sequence Number=SeqID_90176
MENEEGVQEQMKADLSPLKDQMASISEVMLKLQKNIEDKATTTASSTVREVEPVLQPALNLGRDRNTAVFGRRYSSQAYPYGLPPNFAPRAAPEDLSQAPTFEGQLPPYDDYPGQDDEEGDTHLGPLLHLKDPSPHELPQPNIVRHIPASPTPVK

SEQ ID NO: 181862 - protein, 247 aa, Glycine max
  Coding DNA Sequence Number=SeqID_90177
  Gene Ontology: Mol. function=phosphoprotein phosphatase activity
  Homolog annotation: Hit_ID=A7UQU7; Match level="QueryCoverage=53%, HitCoverage=23%, E-value=2e-19, Identity=41%"; Hit description=IMP dehydrogenase/GMP reductase, putative
  Pfam annotation: Domain name=DUF1723; Domain location=164-213; Score =64.3; E_value=4.1e-16; Accession=PF08330.1; Description=Protein of unknown function (DUF1723)
MARTRGLGRAIGRVVGRDRAADEDAGDVPERRRPTASARRLRVHQMTTEGRDMAEDVADMTDDVPEQPTEAPEMRADAQGADSGEGSDGDDAAEGFPGGPRDPSVLTSFAEHVAHAVWSGQERPDLKLVSHGKKVTLIGRPVPEIEGLVAATGLSPLIDCSVITGDPGLISAFVERWHSETSTFHLPVGELTITLDDVSSILHLPITGALHSFHALSTEEARFLLTELLEVSAEEARAETALTRGAY

SEQ ID NO: 181863 - protein, 100 aa, Glycine max
  Coding DNA Sequence Number=SeqID_90178
MEKSEKKNHSEKKLKKAYITWDENDLESSDDSENEEINLCLMAKSYESDEEVSLRKKWYIDSGCSKHMTGDASNFTPYLQRKAGICRTGCHDITLQNMQI

SEQ ID NO: 181864 - protein, 134 aa, Glycine max
  Coding DNA Sequence Number=SeqID_90179
MEPIASLSQYYDLPLRCFTLEDFQLVPTVKEFEEILGCPLGGRKPYLFSGSIPPRQELPRKDRELRGSSNGIIGGYHKWLRVRTQGLDWLPNLKTVRDDEVKASEESDEVQALKAELERARVVEEKFKSIAIKV

SEQ ID NO: 181865 - protein, 181 aa, Glycine max
  Coding DNA Sequence Number=SeqID_90180
  Homolog annotation: Hit_ID=A5BGH9; Match level="QueryCoverage=56%, HitCoverage=21%, E-value=3e-10, Identity=35%"; Hit description =Putative uncharacterized protein
MTRGNPGDLQTFDPEIDRTFHRLVRHSVHPDHSVHFEHSEHFVHSVHSEHSVAGDSEHSDFEHSAANFHTENMTQSPPRERTLREMAAPDFTYESLCIQYPDEDVPYVLKTGLIHLLPKFHGLAGEDPHKHLKEFHIVCSTMKPPDVQEDHIFLKAFLHSLEGVAKDWLSSFILHLKKKMS

SEQ ID NO: 181866 - protein, 200 aa, Glycine max
  Coding DNA Sequence Number=SeqID_90181
MERSMIDAASGGALGDMTPTEARNLIEKMASNSQQFSAINDAIVIRGVHEVATNSAASSETKKLEGKLDALVNLVTQLALNQKFVPVARTFALSMQQPGAIEQPEAYAANIYNRLLNFSSKINHSRTIMTSPATNTTLDGGITLISDGPALSNNNSSLLLPSKMLLAQADHTFLHQSNNSNNPRNSQRLRPLHNLPSKNL

SEQ ID NO: 181867 - protein, 68 aa, Glycine max
  Coding DNA Sequence Number=SeqID_90182
HLDDTLTSSVGPECVELISIVCGVDLYCSESNLCNMERSMIDAVNGGALGDMTPAEARNLIEKMPSNS

SEQ ID NO: 181868 - protein, 83 aa, Glycine max
  Coding DNA Sequence Number=SeqID_90183
  Subcellular localization annotation: CTP_CleavageSite=21; ConfidenceScore=5.02e-01
MECLSPPARSSGTLLTELSSRSIAPSGRRRARHHSSLGMAGSGQQTHRHHLQSPSAHLQKLERCLRPVVDQQATKSKAKVGHT

SEQ ID NO: 181869 - protein, 117 aa, Glycine max
  Coding DNA Sequence Number=SeqID_90184
  Gene Ontology: Mol. function=protein dimerization activity
  Homolog annotation: Hit_ID=Q9XG69; Match level="QueryCoverage=70%, HitCoverage=35%, E-value=2e-10, Identity=36%"; Hit description =Putative uncharacterized protein
  Pfam annotation: Domain name=zf-C2HC_plant; Domain location=35-89; Score=73.7; E_value=5.9e-19; Accession=PF07567.3; Description =Protein of unknown function, DUF1544
MSGSGSNSSGGDTTAGSSSSVARSKYKNAPGNRTDIGWKHGIDVDGNGKKVKCKYCSKIVSGGVFRFKHHLAGTREDFEPCATVRDEINLLMMKIVAESKATKEKKRRLNSIYEDEE

SEQ ID NO: 181870 - protein, 67 aa, Glycine max
  Coding DNA Sequence Number=SeqID_90185
MGFYEFQRGQCEFFGSVGDFVASTDDNVGVEGAVSGRFQAGGERGAISRRRMTKRRGRTRFSSARDL

SEQ ID NO: 181871 - protein, 112 aa, Glycine max
  Coding DNA Sequence Number=SeqID_90186
MEDYQMGFLPREKVITPIDLTLGDNIKFKGKRLPIEPTFNMSSLLLNIGSIDPQLLPNYIEQWTFTVMRDYRVNHGSHVSNSQDMIARVKTYLGDIARACWDSFKQTFPEQI

SEQ ID NO: 181872 - protein, 175 aa, Glycine max
  Coding DNA Sequence Number=SeqID_90187
MERSMIDAASGGALGNMTPAEARNLIEKMASNSQQFSARNDVIVIRGVHEVATNSSSSAETKKLKGKLDALVNLVQPRVGDHPNLRWSNPSQQQQQQQHQQPQKQQIVEAPLQPSLEELVRQMTMQNMQFQQETRASIQSLTNQMGQLKRERRRHFKEKISLEEAHHHRRPWIRA

SEQ ID NO: 181873 - protein, 25 aa, Glycine max
  Coding DNA Sequence Number=SeqID_90188
MVFRKDIIAKIRRKIITFLIHRALR

SEQ ID NO: 181874 - protein, 70 aa, Glycine max
  Coding DNA Sequence Number=SeqID_90189
  Gene Ontology: Biological process=transposition, DNA-mediated
  Homolog annotation: Hit_ID=Q1J7G7; Match level="QueryCoverage=42%, HitCoverage=42%, E-value=2e-10, Identity=100%"; Hit description =Transposase
LAQGFPGINRDTRIYLFCEVIFRPQWLLFLSAVPPVQLLTGWCVTAKAPPDISAGKCSGHAARNHHTRRA

SEQ ID NO: 181875 - protein, 147 aa, Glycine max
  Coding DNA Sequence Number=SeqID_90190
METCPMVEELLQRLMDWGQLEVSEGDREEPHICMQSAKRKIPPTPKALVICFTRNVTGSRSKYPPAAPKPTSFSYQSNKVVPWKYTPPAFGERAAIEVDSLSAKVTNITDLSGVTRSGRVFAPPHSAEFPSKGKAPMIQEPADVATP

SEQ ID NO: 181876 - protein, 97 aa, Glycine max
  Coding DNA Sequence Number=SeqID_90191
  Gene Ontology: Mol. function=chitin binding; Cellular component =extracellular region; Biological process=chitin metabolic process
  Homolog annotation: Hit_ID=UPI00006A17C9; Match level="QueryCoverage =82%, HitCoverage=97%, E-value=1e-09, Identity=35%"; Hit description =UPI00006A17C9 related cluster
  Subcellular localization annotation: CTP_CleavageSite=85; ConfidenceScore=5.22e-01
DFTYCATKGAKYFEAACSPLKVRVCSPLMARTCSPLKARACSPLKIRTCSPLKARACGPLKARACSPQKARTCSPLKVRTCSPLKAMAEQSSEAQGV

SEQ ID NO: 181877 - protein, 51 aa, Glycine max
  Coding DNA Sequence Number=SeqID_90192
MVFHLRLAMSFKIKKGKHRLKGLSKELIQGSINKNLAKAIVRAIHGAKHTK

SEQ ID NO: 181878 - protein, 284 aa, Glycine max
  Coding DNA Sequence Number=SeqID_90193
  Homolog annotation: Hit_ID=Q84VH5; Match level="QueryCoverage=83%, HitCoverage=47%, E-value=3e-83, Identity=86%"; Hit description =Envelope-like protein
MSRHQTTAKKSGRKVPGNVPDAQLDNILFHSIGNAERWKFVYQRRLALERELGRAALDCKEIMDLITAAGLLKTVTKLGECYESLVREFIVNMPSDITNRRSDEYQKVFVRGKCVRFSPAVINKYLGRPTEGVVDIAVSEHQIAKEITAKQVQHWPKKGKLSAGKLKCEVCNLHRIGAANWVPTNHTSTVATGKAAASGAVSKDALIAELKDTCKVLEATIKATTEKKMELERLIKRLSDSGIDDGEVAEEEEGAAEEEDEAAEEEEDAAEDTESDDDDSEATP

SEQ ID NO: 181879 - protein, 63 aa, Glycine max
  Coding DNA Sequence Number=SeqID_90194
  Subcellular localization annotation: CTP_CleavageSite=27; ConfidenceScore=5.52e-01
MCNFRLSAHPPLSATSARLGRQKNLASASRLRAKREISALSATGVLTETQCTTGAKPESTYPR

SEQ ID NO: 181880 - protein, 107 aa, Glycine max
  Coding DNA Sequence Number=SeqID_90195
TGFLKEWTLVCNNTLDTGYDVAPCGACRPWIFFIYEVICFLKINDNEMEKEKRACHELENSDLNDSELFGKLRQDLQFLFSQAKAISHVFRVNFASEVAAPAPHVFR

SEQ ID NO: 181881 - protein, 146 aa, Glycine max
  Coding DNA Sequence Number=SeqID_90196
GLVDKPSGGRHVLQRLGLAWLTQLDDINRSPSMIGKQPSGFYQTLDLVFQGQALFGGVAWDFPMIFPRDITAIWLATRDGKRSSYVIGIGVNVGLGGKFHIALETTPKWALPAARVGVGAVAWGVSLWMGAGTLAYTGAESEESPA

SEQ ID NO: 181882 - protein, 71 aa, Glycine max
  Coding DNA Sequence Number=SeqID_90197
MKKQQWKRRCNGRQRRRGEGRHHPLGNKPWKKELHHQGCAFDKKLEEDALMEEKKERRGEHEIDGIKEGEK

SEQ ID NO: 181883 - protein, 102 aa, Glycine max
  Coding DNA Sequence Number=SeqID_90198
MENCTKQSVRMAPNSWAEDARTKTQFMGLRKRCREWRITLSNHYAWLQTRGRRMHERSKLKGGGCMNENAIHEAPKKGREWRNAQINTMHGSKLLGGGCMNT

SEQ ID NO: 181884 - protein, 139 aa, Glycine max
  Coding DNA Sequence Number=SeqID_90199
MMHRDQCGHLLFSSKTERLSTETTLVSIFAIQRQSSLIARRDEYGHLPLFVEDSMSFDRDRYSPLIIQRQAVPFAIRRSSSPMAFRDKHGHLLPLSRDSMSVDQSYRTPPAIPRQASSIACKDHHGHLFLSLSRHQGFC

SEQ ID NO: 181885 - protein, 83 aa, Glycine max
  Coding DNA Sequence Number=SeqID_90200
MKKIQGLQAPHGATSIAWREAIADHANKYGHSYSNLDDLSPEHLHQFFITEPLRLQLKPEKSNKELGCPALIRGLCKFYGVSV

SEQ ID NO: 181886 - protein, 105 aa, Glycine max
  Coding DNA Sequence Number=SeqID_90201
MGFFLVGNLALSVFGLFSFLFLFSTRRTSHRHTGFWLGKVYGELGLWLKACRTDGHDICQGVGLVQGYKGNNSKKNQTRLLQMISICFKNNSRLLQQTKPCFKIH

SEQ ID NO: 181887 - protein, 177 aa, Glycine max
  Coding DNA Sequence Number=SeqID_90202
MYPPLELIHKRCTLSCSQSTTQVDVPSTCTTKDVPSNVLRQSSQAVKPLKLCEWGYKRILRREKGDTKEFRRLVLRSFGKGRRETQKEFKREYKRSLEKLDDATRNATIQKGRCKVLPQGFGPTNVKQMKIGLDMKIRRIAPLTKEELRVEREKRLMPPLFQGIEPNIICYCTQQFK

SEQ ID NO: 181888 - protein, 210 aa, Glycine max
  Coding DNA Sequence Number=SeqID_90203
  Homolog annotation: Hit_ID=Q6WAY4; Match level="QueryCoverage=87%, HitCoverage=32%, E-value=3e-20, Identity=34%"; Hit description =Putative uncharacterized protein
MGTNQNSKRFYQVKVKSLDVTSLKELGRLMGPLQRQAFRKVYGKILDFTAAEVFTEAVVSLAQYYDQPLRCFTFGDFQMVPTIEEFEEILGCPLGGRKPYLFSGFLPSLSKIAAVVGDSARKLDRMKQTRNGVVGLPRKYLEGKARDMASQEKWGPFVDILALLIFGVVLFPNVGGLVDLAAIDAFLAYHHSKESPVVAILAYLFDTFDR

SEQ ID NO: 181889 - protein, 118 aa, Glycine max
  Coding DNA Sequence Number=SeqID_90204
MIRGDTLRLSAPFCHPEAAGPMTSRDQIWSFCTLVSSRGGGPDDTRKYPSGYPYKYSFAICKTERLIACDTRKYLTVIRTLVSSRGGGPDDTRKYPSGYPYKYSFAICKTERLIACRG

SEQ ID NO: 181890 - protein, 95 aa, Glycine max
  Coding DNA Sequence Number=SeqID_90205
MGEYAKDEELLIHSFQEKSYWGSCYLDATTEHVQKGGTDLSKNTPKRWRDLAAQVVPPMMERETIIVMVDTLSILYYEKMVGYAPSKLCGFGLRQ

SEQ ID NO: 181891 - protein, 101 aa, Glycine max
  Coding DNA Sequence Number=SeqID_90206
  Homolog annotation: Hit_ID=A5C3T2; Match level="QueryCoverage=87%, HitCoverage=9%, E-value=3e-26, Identity=65%"; Hit description =Putative uncharacterized protein
MSLWIFATSQTVSLSDIQCDVLELKGDNCRIWKERVLLQLRWMDIDYAIRKEEPSAITDESSPVVVALCERMERSNKLSVMFIKTKISTGICGFVNQHEKV

SEQ ID NO: 181892 - protein, 88 aa, Glycine max
  Coding DNA Sequence Number=SeqID_90207
DQNGQWLKKDALPPQDERTPSPPPQREDSALLNEVLTELRGLRSYVGERFDSLDTRFVGMDIRLTQVEEDVSFIRTCFDPPPPPPSSS

SEQ ID NO: 181893 - protein, 229 aa, Glycine max
  Coding DNA Sequence Number=SeqID_90208
  Pfam annotation: Domain name=Transposase_23; Domain location=3-65; Score=-7.0; E_value=0.0069; Accession=PF03017.5; Description =TNP1ENSPM transposase
RIPHIEENPPRLVALGRVYEGSTIVHNIPLLHDQVKVGVEEVKDADAPVPVPTDEVNLVGQTLNTFLAWPTHLVKRLSEQGAMGPAKHVDRLDNEVDDPLYLMTLTIPQLFLKSLQVMWDATVFGVFNKDFPLYIKHEDLSEIAHGGQCLSIFVIQLWILAHWQMVVILPKENLVVWFCSLHNRPDNYLKEIINSALKGLNDTPQPKSKAGARWIVALSVLRCHEACKA

SEQ ID NO: 181894 - protein, 128 aa, Glycine max
  Coding DNA Sequence Number=SeqID_90209
YCTSRQAQGGAPQAPDASPPPHQADPAGSFDTEWYLRHLVRQQAANHRGQVQTHECLYQLSLTPQSQGFDSFACPTPDQFRAEVAWPGDWPEAQAGEPPAEAPGDGEEARMDEEMTDLLDFLGGSGAT

SEQ ID NO: 181895 - protein, 22 aa, Glycine max
  Coding DNA Sequence Number=SeqID_90210
MPVSAETQSSVELDRKDPAGLH

SEQ ID NO: 181896 - protein, 89 aa, Glycine max
  Coding DNA Sequence Number=SeqID_90211
LDRVQQNAETNYGHSASCINKEEQVRQYRDDVSVLIIFKFLQVPLAGRFTGRKKAVASGGSNLARLGELDFQPFFDVLCSFFAVLRSST

SEQ ID NO: 181897 - protein, 98 aa, Glycine max
  Coding DNA Sequence Number=SeqID_90212
SPTGSWSCQALITGLCEFYGVSVTSSKGIRPPTNRAFIKKYCVPRQAQGETPQQPGNGHQWATDAPPSPLEFTSAHPQKVRALPTTHGRAIGDQVQSQ

SEQ ID NO: 181898 - protein, 63 aa, Glycine max
  Coding DNA Sequence Number=SeqID_90213
MGAKYLEVVKRGSHPNNGWSPDEIRVCGMTIIYLRPPLELLFLNDKGRIICLCAFITQLAKSE

SEQ ID NO: 181899 - protein, 88 aa, Glycine max
  Coding DNA Sequence Number=SeqID_90214
  Subcellular localization annotation: CTP_CleavageSite=19; ConfidenceScore=5.35e-01
MSSVIACLQKDSTSFVCIVATYPSAGGRRVTRGMRVPRKEYARSRHQRLFEENVGKTGKDAIYELLSERVFPFAPTYSSICDEEIRPT

SEQ ID NO: 181900 - protein, 139 aa, Glycine max
  Coding DNA Sequence Number=SeqID_90215
MTLLFSNILPSDHNANLPLQMYRLGSRPQRDPVDPEKSNRALGFPALGSCLQDIQWTRRSPTWSWSCQALITGLCQFYGVPVTSSKGIRPPTNRAFIKKYCVSRQAQGETPQQPRDGQQRATDTLPSPLEFTSAHPQKG

SEQ ID NO: 181901 - protein, 75 aa, Glycine max
  Coding DNA Sequence Number=SeqID_90216
MPNETSLVRTCCIDNQLPLKTEGIKAGRRAPPGMSHRRKLWLAGAMLAGQQAIQPIDDPVAARRHQHPAGANQHH

SEQ ID NO: 181902 - protein, 177 aa, Glycine max
  Coding DNA Sequence Number=SeqID_90217
  Pfam annotation: Domain name=Transposase_23; Domain location=79-149; Score=-1.7; E_value=0.0018; Accession=PF03017.5; Description =TNP1ENSPM transposase
DVLAVAIGCPEHPGRVRTAEPQLTQQIRDQLEESITKKVTRQVMASFSQLQSQMQSQGLAVPPEPLGSCVDPSRNDPETGDSNWCGLYIEADPACLVSMGRVYEGSTVVHNTPLLPGQVKVSVEEVIDADSPVLVPTDEVFLVGQALHTFLAWPTHLVAVSPPKPSPKPHPEVEGIL

SEQ ID NO: 181903 - protein, 33 aa, Glycine max
  Coding DNA Sequence Number=SeqID_90218
MGSPPTSPPPPPPPAPSDASASPSAVKRTHKAS

SEQ ID NO: 181904 - protein, 110 aa, Glycine max
  Coding DNA Sequence Number=SeqID_90219
MALTRSPSMIGERGQTFFDGMPRGIPMIRASYVRIIPLWERGDGKRSSYVIGSGVNSGIGFGGKFLIALELPAGRVVVGAGAWGASLWMGALGYTGAELEEFPARAEKLG

SEQ ID NO: 181905 - protein, 76 aa, Glycine max
  Coding DNA Sequence Number=SeqID_90220
MRKGKSEENIDKKKDTTPNEGKEVPYPLVPSRKEKERHLTRFLDIFKKLEITLPFGEALQQMPLYAKFLKVRTSCL

SEQ ID NO: 181906 - protein, 169 aa, Glycine max
  Coding DNA Sequence Number=SeqID_90221
MAKPSTNALSELRARLALSSNSLTRAKRDVEIRKPLLSLICTKLKEESLKSVNFREHRAEQWAKFSSFREISEFLRDCEIPRGGGDIPTPLKSVFQHLGYPHQGNKNPCEGDILPRRRHAIGQGKSPSERKVAKVNVRECVTTLKITVMNQGDVKNAKTQRPRLIVQKE

SEQ ID NO: 181907 - protein, 81 aa, Glycine max
  Coding DNA Sequence Number=SeqID_90222
MASYGAIKLQEAKDVEAKLHGECDSKMMTKVMNKKAQRSKNNSSESRTSQEFKNQEGFKISRIKIKIKDSRFKNEEKTQSR

SEQ ID NO: 181908 - protein, 99 aa, Glycine max
  Coding DNA Sequence Number=SeqID_90223
MIYFVRHVKRGNRLKIPLPIKTYPPLDLSNYYILICLVQLGLCPLMNSKEEDFKCFKGILMQKLEEKGLEEKLEEVDSSLSAHSRLSAKKAHSEAQRHA

SEQ ID NO: 181909 - protein, 36 aa, Glycine max
  Coding DNA Sequence Number=SeqID_90224
MSLEEAHHHRRPWIRAWRKKEMNEGEGEKSTKFCAL

SEQ ID NO: 181910 - protein, 158 aa, Glycine max
  Coding DNA Sequence Number=SeqID_90225
MIEVPSFYHRQWAPNYPELVTFRYDGITYQIRLRQHRGKVYFAEGLDEFKKYLSIFESVIIKFLACNNKSIFDLYFIPSLECQTCGRPQLMPRQYIWTVEITQSMLGAPGPLRLPNCAMLHVNACGQHLTILWRFGPPLQWNVVVVDGGVRRIYVVQP

SEQ ID NO: 181911 - protein, 149 aa, Glycine max
  Coding DNA Sequence Number=SeqID_90226
  Subcellular localization annotation: CTP_CleavageSite=64; ConfidenceScore=5.12e-01
MFAHSIKGCRPLGRTYGVLIPSPCVNTTPEPFHLRVGRSRLFRFFRRFPQINVGGDSARIPFVEHASRESRVALPPKGNTPTFVDELRGSGGGGDASIAHCRPSPGYCGVSPCACLRDAVLLDESSVSRGPDDLAGVGSSGLRIIKKGG

SEQ ID NO: 181912 - protein, 98 aa, Glycine max
  Coding DNA Sequence Number=SeqID_90227
MEELINKTQLSPKIIPTSSCRLDGSTKESHFSYSTAVILLPQTKVRDHHKQLPPHGDQPKSQGSSKTSDMPPSTSIPPYEKLQVLTDKVYTISMSYEV

SEQ ID NO: 181913 - protein, 72 aa, Glycine max
  Coding DNA Sequence Number=SeqID_90228
MTCGDTQVETNVVFCTLCQSGASKPIDTQRLMSSSAFSVILTREVRRRCLSGYPYKHSFAIHQTQSMVACRD

SEQ ID NO: 181914 - protein, 68 aa, Glycine max
  Coding DNA Sequence Number=SeqID_90229
MTKDFHCSEDTSYYNEASSFANDTSLEPSCSMTNLRYGESCTRCGKCMLNILVFNIHIRCGKSSHSFS

SEQ ID NO: 181915 - protein, 104 aa, Glycine max
  Coding DNA Sequence Number=SeqID_90230
MAAEWRRKRERRRHFKEKMSLEEAHHHRRPWIRAWRKKEMNEGRGREEHKILSFLAYLFNFESNSCICHIGNWKRGLVSSLEEFESRSKGPTTLRAIGIRSTPN

SEQ ID NO: 181916 - protein, 180 aa, Glycine max
  Coding DNA Sequence Number=SeqID_90231
MSALKEQMASMMDAILGMRQLMENNVATAVAVSSAAEADPTLLATTHHPLPNVWLTLYGLPPNYTPLVMRDDMGHVPSPILEGEPPRQSDEVHEDHAQGGIDFYPPIPVKGLAPNILPQPNLPAQPIFLSTEGPPPAAEERRKLDLIEERLRAIEALATIRSRTWRIFAWYRDVGHPPKI

SEQ ID NO: 181917 - protein, 280 aa, Glycine max
  Coding DNA Sequence Number=SeqID_90232
  Homolog annotation: Hit_ID=Q2HTA0; Match level="QueryCoverage=93%, HitCoverage=39%, E-value=6e-21, Identity=31%"; Hit description=IMP dehydrogenase/GMP reductase, related
MYQVSYRARQWFAAARAYLLHLVGCTLFANKSATHVHVVHLQAFRDLAQAGTFSWGAAALVHLYDQLNEVSQAPTRAGFTSTFHQSTGKAQMISIKEAPYRARIDGLTVTDVCWMLYAEHRGVRGYDLISSYMGQVRWGPIIVYLRPERVVRQMGYIQTVPLPSVRDSLTGTDIDDRWVQFSDHVAPTGELCVVPGQVAPDYMECFFQISHPFVTPTEDIAEPRPAPPLPTHDDDFVEPPVAQVPIASDPPYAFCACVRMGRIAEHLERVINLRMVTARI

SEQ ID NO: 181918 - protein, 303 aa, Glycine max
  Coding DNA Sequence Number=SeqID_90233
  Homolog annotation: Hit_ID=Q5CDC4; Match level="QueryCoverage=13%, HitCoverage=32%, E-value=3e-15, Identity=100%"; Hit description =LacOPZ-alpha peptide from pUC9
MRRAQPGGEAVGGPHGEVAEEAARGGDPVQQHPALQADVAGEQPPPAAPGEQRLVDAVVDEHLGQVPHPGAAEHHPLPQPVVLEQVEVPVAAHGERHRAPQHHAGVVEGAVVGQVAHDLLMRERPGAQRAGSGRDPVAELAHRGAQQIQALRVHPRDLQGEALGAADVVRVRARDEIVRAGFQAVLQGGGDAAVGIVAQHPGGAVRAGLHLLHDRLELRGERAVDGEDQQVRRELLIQGRRAQRELESAYRYRRPRGGARYQLLFPLVRVNFELGVIMVIAVSCVKLLSAHNSTQHTSRKHKV

SEQ ID NO: 181919 - protein, 15 aa, Glycine max
  Coding DNA Sequence Number=SeqID_90234
VNAVKIFTDARNGLE

SEQ ID NO: 181920 - protein, 70 aa, Glycine max
  Coding DNA Sequence Number=SeqID_90235
MTLSSWQNKLDKYFTCKTLVMKGEDDDSYTDTYVSPLTAQITGNVVGEEEADDVHANRNDHDEGELINIG

SEQ ID NO: 181921 - protein, 220 aa, Glycine max
  Coding DNA Sequence Number=SeqID_90236
MLSHRLKHCNALADSMSNASPTQLQQLKTQLAEQMGNPVGLHTMGIPAAISTLGVIISFAIPQLWLGYGVLVALGQPVERVFVQHARRTDTPCAGGDKPGINGSIYLLAALSGSPFPGVSLTAALPFIRCCYLLCIIAPGASRSGRLAMHICHAKPAPRNHPAPIIPDAISLTSPRPDGCATPQDMARNWQRNGGNHWPEHKNAQPAPALHARFLLRPRR

SEQ ID NO: 181922 - protein, 118 aa, Glycine max
  Coding DNA Sequence Number=SeqID_90237
  Gene Ontology: Mol. function=structural constituent of ribosome; Cellular component=ribonucleoprotein complex; Biological process =translation
  Homolog annotation: Hit_ID=Q6D1T8; Match level="QueryCoverage=67%, HitCoverage=97%, E-value=7e-35, Identity=91%"; Hit description=30S ribosomal protein S16
  Pfam annotation: Domain name=Ribosomal_S16; Domain location=37-97; Score=116.1; E_value=1.1e-31; Accession=PF00886.10; Description =Ribosomal protein S16
MSKIFGLFILQPGPVPQWGPAVLLTKEDVMVTIRLARGGAKKRPFYQVVVTDSRNARDGRFIERVGFFNPIASGQAEALRLDLDRIEHWVGLGATVSDRVHALIKTLRKQLNLSRWWQ

SEQ ID NO: 181923 - protein, 213 aa, Glycine max
  Coding DNA Sequence Number=SeqID_90238
MTERLLIGSLAFESRILHYLIVRILLSRSSNLAQVFEEDLIVMWAFHKGLQIDWANLVRYRMHKALRLNAPLPYPHLVTFFLQHFSIPLDSEPYVLIKRSFLIGASVIASFGYQKEHDGSWVKKGAQNVGEEGHDGEYSSLLSKILDRSCHHQKGGDCRAKLHGESKNNSRVQDKNQEEFKTQEESLESRIKIQGSRSQESRSRLKIQESREG

SEQ ID NO: 181924 - protein, 73 aa, Glycine max
  Coding DNA Sequence Number=SeqID_90239
MQEPQEKHQGDDKKLKGQSKNEFKMFKIESRTLQDSRGKLISRIKNQDSRIKLPRIKIKIKIQDSRFKNQEKT

SEQ ID NO: 181925 - protein, 74 aa, Glycine max
  Coding DNA Sequence Number=SeqID_90240
MSRKDPYMYIISKEICGSNAFQDYFDDAKESRVKQIPKIQESSFKNQESRFKIQESSFKNQDSRIKRRLNQDKY

SEQ ID NO: 181926 - protein, 91 aa, Glycine max
  Coding DNA Sequence Number=SeqID_90241
MAFTKLLRERGVEEKLNTHVKAEIKCTVESKRIGKKETNTQGFLYWFSTNPCLPPVPKEPAVLEISFNLVKWWLDRNIEMAITEATGFQMR

SEQ ID NO: 181927 - protein, 105 aa, Glycine max
  Coding DNA Sequence Number=SeqID_90242
MKLAKYRLKAQVEKDEGPSGEGQSPRVEKDEGPNLSSFIGSGVYPDLSSFTGSGVYPDLSSFTGSGVYPNFSSFTGSGVIQIFVACIKRSAPTQVHIIWYQSFGS

SEQ ID NO: 181928 - protein, 137 aa, Glycine max
  Coding DNA Sequence Number=SeqID_90243
  Gene Ontology: Cellular component=ribosome
  Homolog annotation: Hit_ID=A2Q6B4; Match level="QueryCoverage=91%, HitCoverage=51%, E-value=4e-09, Identity=29%"; Hit description =Ribosomal protein L33; Nucleic acid-binding, OB-fold
MARNFDSIKDIDGTQETLHLVIRIIDLWVVPTRDYSGHLEMVIMDSNGDKILFMARKDQFDTWYAMLREGSTYIMNNFRTVPNDGQYKICNHALKLLFTGETTLKTQDLLDIANNVYGFMNFEDILTKRAKFLCVNW

SEQ ID NO: 181929 - protein, 74 aa, Glycine max
  Coding DNA Sequence Number=SeqID_90244
MGLVILFQRPTLSLILHSVDPHQVGNGENNGGNEMIIVVIVKTTNVMTMMVRVIVNVAIEIEVVIMRLKNNNKW

SEQ ID NO: 181930 - protein, 98 aa, Glycine max
  Coding DNA Sequence Number=SeqID_90245
MPISPCERIAPTRHPVDPEEPNRALGFPALVTSLCQSYRVPVPPARSWHHEIGIAPERHPVDPEKSNRVLGFSALITSLCQFYGVLVTPSKVIRPPTN

SEQ ID NO: 181931 - protein, 99 aa, Glycine max
  Coding DNA Sequence Number=SeqID_90246
  Subcellular localization annotation: CTP_CleavageSite=51; ConfidenceScore=5.14e-01
MLLLSFSLPSSSPPSSSYPWLPIVVSFFLTHLLLEVVYPSSFFILHSVVIKIQEAKDFIDEEDTKPTSSTWSYIMWYQEHLHLGDVLLLPLSFCSVNSL

SEQ ID NO: 181932 - protein, 204 aa, Glycine max
  Coding DNA Sequence Number=SeqID_90247
  Homolog annotation: Hit_ID=A5C169; Match level="QueryCoverage=75%, HitCoverage=13%, E-value=4e-07, Identity=25%"; Hit description =Putative uncharacterized protein
MTGRLLSRSLSFESHILHYLIMRILLPRSSNLAQVSEKDLIVMWAFHTGRQIDWAHLVQYRIHKALRLNAPLPHPHLVTLFLQHFDIPLDSEPYVPIKISFLIGAAVIASFGYRKEHDDSWVKKGAQPIDEEGHLPVGEDSSLFQRILDRFDGLQTFVGESFDALELQVDMRFNEMDSRITKVEGDVSYIRTCFDLPPPPPPSS

SEQ ID NO: 181933 - protein, 283 aa, Glycine max
  Coding DNA Sequence Number=SeqID_90248
  Gene Ontology: Mol. function=DNA-directed DNA polymerase activity; Cellular component=intracellular; Biological process=nucleobase, nucleoside, nucleotide and nucleic acid metabolic process
  Homolog annotation: Hit_ID=Q9F173; Match level="QueryCoverage=100%, HitCoverage=30%, E-value=1e-115, Identity=75%"; Hit description=DNA polymerase I
  Pfam annotation: Domain name=DNA_pol_A; Domain location=1-282; Score =390.8; E_value=2.1e-114; Accession=PF00476.11; Description=DNA polymerase family A
MINPITGRVHTSYHQAVTATGRLSSTDPNLQNIPVRNEEGRRIRQAFIAGADKRIVAADYSQIELRIMAHLSQDKGLLDAFAQGEDIHRATASEVFGVALSKVSGEQRRSAKAINFGLIYGMSAFGLSRQLNIGAGEAKKYMDLYFERYPGVLRYMEATRAQAADKGYVETLDGRRLWLPDINSSNAIRRKAAERAAINAPMQGTAADIIKRAMIAVDGWLLQQNSDEVKMIMQVHDELVFEIHKDAVAGASQTIRELMENSMKLDVPLQVEVGTGDNWDQAH

SEQ ID NO: 181934 - protein, 99 aa, Glycine max
  Coding DNA Sequence Number=SeqID_90249
  Subcellular localization annotation: CTP_CleavageSite=35; ConfidenceScore=5.35e-01
MHLPQLISDVIYCLQGLCPGCLSPPARSSGPLLTRLSSRSTASPGRRRARHHSSIGMAGSGQQMHCHHLLSSPQLIHKKVRALLTTHDRPIGDQVQSQR

SEQ ID NO: 181935 - protein, 115 aa, Glycine max
  Coding DNA Sequence Number=SeqID_90250
  Homolog annotation: Hit_ID=A5BEV8; Match level="QueryCoverage=93%, HitCoverage=12%, E-value=1e-11, Identity=37%"; Hit description =Putative uncharacterized protein
MLDQFAPFMQGFIHNVMDVKADGNCGYWSIVALSGMGEDSWPLVHNELIKELCRWSHDYMNLFGGTERFERLRLSLLVDGFSSLLVDGFSKVSVDKWMDITAMGYVIASRYIEDS

SEQ ID NO: 181936 - protein, 107 aa, Glycine max
  Coding DNA Sequence Number=SeqID_90251
MVQLWFGIRVKKLGGPFGPANKSYPEPHELIVIHASSTIESGAPRIDCLALFVYPPPSNLIWRPMNRLPSVVHASPAIEFGAPRIDCLALFVYPPPSIYSETHELIS

SEQ ID NO: 181937 - protein, 76 aa, Glycine max
  Coding DNA Sequence Number=SeqID_90252
MRQVVTRAHLLKMTGKGVRVCQKVTISKLIDLKKIDNKATLRVEKSKTKSVSLPLVSTQHQMDTNTLGVDPKMRKI

SEQ ID NO: 181938 - protein, 76 aa, Glycine max
  Coding DNA Sequence Number=SeqID_90253
MEIFRSVWNVCKLLASPVPPGKVEGVCPEYWLVEASSHHFGGKGASSGAETINPFMKNFGKDVVNPLLNSSLSRMM

SEQ ID NO: 181939 - protein, 93 aa, Glycine max
  Coding DNA Sequence Number=SeqID_90254
MHRRLQTHRHHLIRLVQLGHLAWSGIYSTCLNQQSQGFAPFACPTPDQFRAEVAWPEAQAGEAPAEVSDNTEEARMDEEMTNLLDFLGGSGAT

SEQ ID NO: 181940 - protein, 313 aa, Glycine max
  Coding DNA Sequence Number=SeqID_90255
MAPRKLASKRSRKDKAAEGTSSAPEYDSHRFRSAVHQQRFEAIKGWSFLRERRVQLRDDEYTDFQEEIGRRRWAPLVTPMAKFDPEIVLEFYANAWPTEEGVRDMRSWGQECEYGQRRNRSDGFDEETIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALIIGLCQSFGVPVAPTKVIRPPITRAFIEKYCTQRQAQGDAPQAAGAPPPPHQAGQAGAFDMEQYLRHLVRQQAANHRAH

SEQ ID NO: 181941 - protein, 295 aa, Glycine max
  Coding DNA Sequence Number=SeqID_90256
  Gene Ontology: Mol. function=phosphotransferase activity, for other substituted phosphate groups; Cellular component=1-2nm peptidoglycan- based cell wall; Biological process=lipopolysaccharide biosynthetic process
  Homolog annotation: Hit_ID=A8G831; Match level="QueryCoverage=54%, HitCoverage=45%, E-value=3e-75, Identity=85%"; Hit description =Undecaprenyl-phosphate alpha-N-acetylglucosaminyl 1- phosphatetransfe rase precursor
  Pfam annotation: Domain name=Wzz; Domain location=183-284; Score =35.4; E_value=2.1e-07; Accession=PF02706.6; Description=Chain length determinant protein
MAFWCFAMIATIVPYILLNLGILGRRYKVFMGDAGSTLIGFTAIWLLLQSSQGKAHSINPVTALWIIAIPLMDMIAIMYRRLRKGMSPFSPDRQHIHHLIMRAGFTPRQAFVLITLAAALLAAVGVIGERLTFIPEWVMLALFLLAFFLYGYCIKRAWRVARGFLAVMNPETTSDKHTPAVDNELDIRGLCCTLWRGKPWIIGIAVLFAAVALIVSYLVKQEWSATAITDKPTVNALGGYYSQQQFLRNLDVRTLPATAGDQPSIADEAYNEFIMQLAAYDTRRDFWLQSDYYKQ

SEQ ID NO: 181942 - protein, 108 aa, Glycine max
  Coding DNA Sequence Number=SeqID_90257
MQHISIHIEGLRAKRWRYWWLAVTWSIWKLRNRILFANAEFDTNRLFEDAIFIIWTWLRQFEKDFTVHYNQWSNRIPTKGNLRRRQLEKGFAQPYNYWSSNLSTTFFD

SEQ ID NO: 181943 - protein, 142 aa, Glycine max
  Coding DNA Sequence Number=SeqID_90258
IMPLPFSYLGIPIGANPEEVPMGIWDVSLQMFGNGSLNGEDTFLNGEATSLGCIKSHYRSITTSNRWEVTKTMGGSGALFGEGHCFDNEIDTAGVFLNEVQDMAIHQHGPDVWEWTADPTGTVRMMQFSFFGPGLGTLRKAS

SEQ ID NO: 181944 - protein, 66 aa, Glycine max
  Coding DNA Sequence Number=SeqID_90259
MGPNKLSTFVPAANKSEVPPESELAVLLLAWVFHLGPVDQPMRISLGFLNVAHLTTQYMDVTSLLA

SEQ ID NO: 181945 - protein, 87 aa, Glycine max
  Coding DNA Sequence Number=SeqID_90260
  Subcellular localization annotation: CTP_CleavageSite=64; ConfidenceScore=5.06e-01
MGVQIATSPLVPSRRLLLSGGSNPARLGELGGKHLPYFAINRGGSERRKGRGASRNVSVTFSVKNFAKVSTVLRRSSFVLHRSSIFN

SEQ ID NO: 181946 - protein, 78 aa, Glycine max
  Coding DNA Sequence Number=SeqID_90261
  Subcellular localization annotation: CTP_CleavageSite=56; ConfidenceScore=5.32e-01
MLVRMVRTLLFAAARVKSCPSMHSSCVIASLSGCARTVGPPPISGGGPGTARECIPMMARTCNPLKVRACPPLKMGNM

SEQ ID NO: 181947 - protein, 132 aa, Glycine max
  Coding DNA Sequence Number=SeqID_90262
  Homolog annotation: Hit_ID=A5AFY0; Match level="QueryCoverage=83%, HitCoverage=8%, E-value=5e-09, Identity=32%"; Hit description =Putative uncharacterized protein
LKLSIVNHLLGLGKTFEDDELNIKILNFLSSTWEPKIKVIKESKDLASMSMEALFEKLLAYEHEFIQQSDTENFSLMVKKFGNFLKRSKDRKFSKPSKKIESNNNTFTCFQCGKQDNASTSSDSSSEEEVAN

SEQ ID NO: 181948 - protein, 364 aa, Glycine max
  Coding DNA Sequence Number=SeqID_90263
  Gene Ontology: Mol. function=oxidoreductase activity, acting on the CH-OH group of donors, NAD or NADP as acceptor; Cellular component =cytosol; Biological process=metabolic process
  Homolog annotation: Hit_ID=A8GIS8; Match level="QueryCoverage=100%, HitCoverage=88%, E-value=0.0, Identity=95%"; Hit description=D -isomer specific 2-hydroxyacid dehydrogenase NAD-binding
  Pfam annotation: Domain name=2-Hacid_dh; Domain location=13-326; Score=130.7; E_value=4.4e-36; Accession=PF00389.21; Description=D -isomer specific 2-hydroxyacid dehyd
  Pfam annotation: Domain name=2-Hacid_dh_C; Domain location=117-294; Score=232.4; E_value=1e-66; Accession=PF02826.10; Description=D -isomer specific 2-hydroxyacid dehydr
  Pfam module annotation: Pfam domain module=2-Hacid_dh::2-Hacid_dh_C; Domain location=13-326::117-294
MAKVSLEKDRIKFLLVEGVHQSTVDNLRAAGYTNIEYHKGALDTESLKASIRDAHFVGIRSRTHLTEEVFAAAEKLVAVGCFCIGTNQVDLKAATKRGIPVFNAPFSNTRSVAEMVLGELLLMLRGIPAANAKAHRGVWHKLAVGSYEARGKKLGIIGYGHIGTQLGILAEGLGMKVFFYDIENKLPLGNAQQVRHLSDLLNMSDVVTLHVPETLATKNMMGAEELALMKPGAILINASRGTVVDIPALCDALASNHLAGAAIDVFPEEPATNSDPFNSPLCEFDNVLLTPHIGGSTQEAQENIGDEVAGKLAKYSDNGSTLSAVNFPEVSLPAHGPNASRLLHIHENRPGVLTQINQIFAEEG

SEQ ID NO: 181949 - protein, 258 aa, Glycine max
  Coding DNA Sequence Number=SeqID_90264
  Gene Ontology: Mol. function=DNA binding; Cellular component =intracellular; Biological process=regulation of transcription, DNA -dependent
  Homolog annotation: Hit_ID=A8GIT3; Match level="QueryCoverage=78%, HitCoverage=74%, E-value=1e-102, Identity=91%"; Hit description =Transcriptional regulator, IclR family
  Pfam annotation: Domain name=HTH_IclR; Domain location=76-164; Score =103.7; E_value=5.8e-28; Accession=PF09339.1; Description=IclR helix -turn-helix domain
  Pfam annotation: Domain name=IclR; Domain location=193-258; Score= -6.4; E_value=0.00088; Accession=PF01614.9; Description=Bacterial transcriptional regulator
  Pfam module annotation: Pfam domain module=HTH_IclR::IclR; Domain location=76-164::193-258
MGYFLLCGSVTDGSLQCGGNIADFWPAADNETAFRLHVMQALGAGWRFDTGEIFAMSLKAVDEKDDKKDKPLGSQSLFRGLQLIEILSNFPNGCPLAHLSELAGMNKSTVHRLLQGLHTSGYVTQAPSPGSYRLTTKFISIGQKALSSLNIIHVAAPHLEQLNLEVGETVNFSSREDDHVILIYKLEPTTGMMRTRAYIGQHMPLYCSAMGKIFMAYGNDDYPAHYWQSHQQEIQTLTRNTITELPKMYEELADIRQR

SEQ ID NO: 181950 - protein, 301 aa, Glycine max
  Coding DNA Sequence Number=SeqID_90265
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=49%, E-value=1e-151, Identity=82%"; Hit description=DNA -directed RNA polymerase subunit beta'
  Pfam annotation: Domain name=RNA_pol_Rpb1_1; Domain location=5-162; Score=-105.4; E_value=1.2e-05; Accession=PF04997.3; Description=RNA polymerase Rpb1, domain 1
  Pfam annotation: Domain name=RNA_pol_Rpb1_2; Domain location=164-268; Score=138.4; E_value=2e-38; Accession=PF00623.11; Description=RNA polymerase Rpb1, domain 2
  Pfam module annotation: Pfam domain module=RNA_pol_Rpb1_1::RNA_pol _Rpb1_2; Domain location=5-162::164-268
MDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDYSGRSVIVELLRVKFGKKEPIVWEILQEVMQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRR

SEQ ID NO: 181951 - protein, 119 aa, Glycine max
  Coding DNA Sequence Number=SeqID_90266
MNFAARKPIPLTPIPVSHADLLPYLLDNSMVAITPTKVHQLPFFREYNSNAMCACHGEAPGHSIEHCRGLKRKVQGFSTFTGIGCKPLVYLLKPPVLLSLDFQDRSIGDYSSCTLVGLP

SEQ ID NO: 181952 - protein, 177 aa, Glycine max
  Coding DNA Sequence Number=SeqID_90267
  Homolog annotation: Hit_ID=UPI00016621D1; Match level="QueryCoverage =93%, HitCoverage=42%, E-value=3e-13, Identity=33%"; Hit description =UPI00016621D1 related cluster
DGPLGTSTLVFRGLLALVFKGLHVLTIKGLHAHAIRGLPILTIRGLHALTFIGLHALTFRGLHVLTFRGLHDLAFRGQHVLAFAFVGLHAHTFRGLHVFAFRGLHVLTFKGLHTLTFRGLHVLTFRGPNILIFRGLHVLIFRGLHVLTFRGLHALTFRGLHVLALRRATRPCLQRTT

SEQ ID NO: 181953 - protein, 68 aa, Glycine max
  Coding DNA Sequence Number=SeqID_90268
MPEMQMLKLGEGQAWVLLLLSMEGFVWDMILGVCKAEEGDDGSGEANAVVIGNSGEEGRVKFGGKGVQ

SEQ ID NO: 181954 - protein, 58 aa, Glycine max
  Coding DNA Sequence Number=SeqID_90269
MPEMRMLKLGEGQADAQTWRGPSVGQIRFLCGVAIGLDGAVSKKEMTEVGEEENSGAQ

SEQ ID NO: 181955 - protein, 143 aa, Glycine max
  Coding DNA Sequence Number=SeqID_90270
MGEQRRQFKSDLTSKWAFAADKESVDDTDMRKKAQAIQKHNIAPHLLPREGYEYLENKLMDEKRKKKLEEAAQSGSTDTVIDPPSPIRQHMKWKMARIKKTGQMTSEAAKEIAEKIESLEEQSPEWPVHNSIRSHFFLLTHNL

SEQ ID NO: 181956 - protein, 75 aa, Glycine max
  Coding DNA Sequence Number=SeqID_90271
MGQIRFLCSVAIGLDGAVSVGVAVSFHGGVLFAADRRRIEVLGSDGRPQANAGVIGNGGEEGRVKFGGKGLAAFK

SEQ ID NO: 181957 - protein, 195 aa, Glycine max
  Coding DNA Sequence Number=SeqID_90272
MDAHGDKPANVDTDDPMRGLIKYSFDIYDKPVECKFDGTKFGIADAPPSIFLTYSDWTETLEQGSNYAFLEPQSLVVSKETRGECEGYLERWLKESNREVYVGPYFHQKPDMHIKAAINSVMTKLKTSLSPESKAAAPKWIEVKSHVQTGCYECGYYVMHWMWNIITSDIKSDWSMWFGDDTPLDKENMTTIRKK

SEQ ID NO: 181958 - protein, 88 aa, Glycine max
  Coding DNA Sequence Number=SeqID_90273
MLSKRKTLDEGSLLSSKSEIQHDHRFTSTPYVPMDSGIGPPLFNSPPQWSRQLSQPTLRREGDAGLTGASSKGGKRVESPPTFIRGKR

SEQ ID NO: 181959 - protein, 184 aa, Glycine max
  Coding DNA Sequence Number=SeqID_90274
WVDPGDADAQTWRGPSMGQIRFLCSVAIGLDGAVSVGVAVSFHGGVLFAADRRRIAVLGSDGRPQANAGVIGNCGEEGRVKFGGEVDPYNQLGDSCFGTSNVFLKVIALLNDSPWPVNVTASFCWLGKVLMEREVMVPEGASRGKCGKPDEFKKKPAIAICMLLVQSVLAPRKARQSVWPIWYG

SEQ ID NO: 181960 - protein, 132 aa, Glycine max
  Coding DNA Sequence Number=SeqID_90275
FIEKYCTPRQVQGDAHQATSALPPPQQADPAGPQGVEHYLQHLVRQQATNHRGQVQIHECLYRFSLNQQEQGSVPFVCLTPEQFGAEVTWPGDWPDAQVGEEPTGSPGEADESYMDENMTDLLGFLGGSGAT

SEQ ID NO: 181961 - protein, 127 aa, Glycine max
  Coding DNA Sequence Number=SeqID_90276
  Homolog annotation: Hit_ID=O52175; Match level="QueryCoverage=64%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGVGSSLQAGTVCTNPPFSPTAAPYPGNYRL

SEQ ID NO: 181962 - protein, 139 aa, Glycine max
  Coding DNA Sequence Number=SeqID_90277
MVLFSILYLTGMYIARYRVEVMVTQNNESSKFLLWDHECAELNDQTADEVNRVKIEVDFSSFWHDGDVDLNASPQALDRLLGYVLAFKVRIQSKFRNVVVLRYSNELDLINVVLEMLADSEACSKIDASNVDCNNATHP

SEQ ID NO: 181963 - protein, 95 aa, Glycine max
  Coding DNA Sequence Number=SeqID_90278
MESSRIHSWKYLMDAVATYPSAGGRRVTRGMRVPRKEYARSRHQRLFEENVGKTRKDAIYELLSERFGSCIYARGRVFPFAPTYSSIWDEKIRPT

SEQ ID NO: 181964 - protein, 109 aa, Glycine max
  Coding DNA Sequence Number=SeqID_90279
MSFDQMQSQGLALPLEVKVYPFVARVSIKESCVDPTGQDPETGDSDKCGLYVDDSPPRLVTVGRVYEGSTTIHNIPLGNDQLKVGAKEVRDADARILYPLKRSVSGADT

SEQ ID NO: 181965 - protein, 122 aa, Glycine max
  Coding DNA Sequence Number=SeqID_90280
  Subcellular localization annotation: CTP_CleavageSite=28; ConfidenceScore=5.52e-01
MATQMNQAQSQNSDKLPSQTVQNPKNVSAITLSSGNQIQVPPSVAAPAPEPVKLHSTTEKEDKIVAQKRKLPNKNFHAGGPSSRNSDLQQPPISLPFPPRAIPNKKMKEAEKEIFETFRKVE

SEQ ID NO: 181966 - protein, 118 aa, Glycine max
  Coding DNA Sequence Number=SeqID_90281
LRLAGDSIAIAAPSVHLPYLAAGTSAVLAPTDTTIHYREPAPPIGRSFFFKAWSWCMSLLYPFQLPSFQKDSNWRMKLQLNLLEREEDRLEVGLGLDPQAQGTSIPGMKSTLSRSTSF

SEQ ID NO: 181967 - protein, 127 aa, Glycine max
  Coding DNA Sequence Number=SeqID_90282
ALPVALMIHDNSSDRTAFVPATHHSNFCPINFRWRANYPILTREVVTINNNTGLIESVKKLVVGPWGWVDRSRLPVCTGRLVPSAGDALLSLTGRVVPPDSDPIVLAFGIGVMINRDSRGHSYFIVR

SEQ ID NO: 181968 - protein, 138 aa, Glycine max
  Coding DNA Sequence Number=SeqID_90283
  Gene Ontology: Mol. function=oxidoreductase activity, acting on NADH or NADPH, NAD or NADP as acceptor; Biological process=electron transport
  Homolog annotation: Hit_ID=Q5PHS8; Match level="QueryCoverage=100%, HitCoverage=68%, E-value=5e-63, Identity=85%"; Hit description=FMN -dependent NADH-azoreductase
  Pfam annotation: Domain name=Flavodoxin_2; Domain location=4-133; Score=76.7; E_value=7.5e-20; Accession=PF02525.8; Description =Flavodoxin-like fold
APLSPRQQDALALSDELIAELQAHDTVVIAAPMYNFNIPTQLKNYFDLIARAGVTFRYTEAGPEGLVKGKRAVILSSRGGIHKDTPTDLLTPYVKLFLGFIGITDVDFVFAEGIAYGPEVATKAASDAKDAIKQIVAA

SEQ ID NO: 181969 - protein, 149 aa, Glycine max
  Coding DNA Sequence Number=SeqID_90284
MGTNQTGKRFYQVKVKSLDTTSIKELGRLMKPLQMQAFRKTYRKILELTIAEVSIEAIASLTQYYDQPLRKDQELRGIRNGIIGGYPEWLKVHIRGLDWLAKLKVVSEESFEAPEEDEEVQALKSELGKAKLAKEKFKLAATHIRRSVP

SEQ ID NO: 181970 - protein, 212 aa, Glycine max
  Coding DNA Sequence Number=SeqID_90285
MLTDPYKDEYLLWTMLEWFSPLAWWRMKLKQILDIERQRGISEDHLENLVSIVIIHRPYFMERGQLWSRNEAQVWGTFEAYPLEESYRHQLARHLCEINNYLYKTVDPNLPTSSQRPKESYPIDRIIPQNTDDGQIRTEFYVPEPVFQKIEDLANDYSSLNRDWEDYNAQLMEDLLHKKKYRYHHPVYGSLNRLEVQNYNLSLSTRSDYRSN

SEQ ID NO: 181971 - protein, 32 aa, Glycine max
  Coding DNA Sequence Number=SeqID_90286
MTEARQKGVRKLKTAENEEGMMDVEERLKTFA

SEQ ID NO: 181972 - protein, 65 aa, Glycine max
  Coding DNA Sequence Number=SeqID_90287
MGVQIAPRPTWALQKIPPPRRGGNEEGRAEALPKRFRNVSVRNLAKVSTVFDVLHSFFIVLRSST

SEQ ID NO: 181973 - protein, 54 aa, Glycine max
  Coding DNA Sequence Number=SeqID_90288
VDSRGSHLVLAIRQLGYPMRGVPSDESITPFIARGFSDHNARVLQGVRKAWDAA

SEQ ID NO: 181974 - protein, 76 aa, Glycine max
  Coding DNA Sequence Number=SeqID_90289
MTAEWRRKRERRHHFKEKMSLEEAHHHRRPWIRAWRKKEMNEGRGREEHEILCSKRALKSEPTNPRSIPRFSTKCA

SEQ ID NO: 181975 - protein, 109 aa, Glycine max
  Coding DNA Sequence Number=SeqID_90290
MRSFNGDFPPWRCSGRQTRRGERRRHPLGNKPWKKELHHQDEPWIRSLEGCLEGCFNGGKERGRERERGEHEIEEIKEGEKWNFEVASLRSFLEKTSLRSFFEKTSLRS

SEQ ID NO: 181976 - protein, 145 aa, Glycine max
  Coding DNA Sequence Number=SeqID_90291
MWDATMFGVFNEHFLLYIKYEDLSEIVRGGQCLSISVIELWILHLTETSMRTGNSNVYGFLEPQSIQRSRQSQFESESYMKSWMQSSKRDVYLGAYRMAQTGKWSSFCLRKYLVVWFCSLHNRQDNYLKGIINKSVLFFNTFALA

SEQ ID NO: 181977 - protein, 248 aa, Glycine max
  Coding DNA Sequence Number=SeqID_90292
  Gene Ontology: Biological process=transposition, DNA-mediated
  Homolog annotation: Hit_ID=Q1J7G7; Match level="QueryCoverage=15%, HitCoverage=67%, E-value=2e-10, Identity=72%"; Hit description =Transposase
LPGINRDTRIYLFLRSDLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIEEEWRDVLQAEVRIEFAKRNLQWLSTRKNPEEDDLLSSLSALLQVIKRTTSTHLLSKTSEGDILTTCVFAVFHLVLLFVVKEVSELWKAKSSVGSSLGNLSDSKVLDSMGLSCCAITRNR

SEQ ID NO: 181978 - protein, 240 aa, Glycine max
  Coding DNA Sequence Number=SeqID_90293
  Homolog annotation: Hit_ID=UPI00016621D1; Match level="QueryCoverage =62%, HitCoverage=40%, E-value=3e-14, Identity=35%"; Hit description =UPI00016621D1 related cluster
MNTSRLQRLHALAFRGLHVLTFRGQHVLAIRGLHVSAFRGLHVLTFRGLHVLAFRGLHVLTFRGLHALTFRGLHVLIFRGLHALTFRGLHVLASRGLHVLTFRGLHVLAFRGPHALAFRGLPVLAFRGLHILAIRGLHALTFRGLHVLAFRGLRILTFRGLHICALREFKGSRPQDTQWTRRSPTGPWGFQLWLRASVSPTGCPSPPARSCHREIGIAPTRHPVDPKKSNGVLGFPGGIL

SEQ ID NO: 181979 - protein, 29 aa, Glycine max
  Coding DNA Sequence Number=SeqID_90294
MGDEQTGPPGQWVTGKVTTVDDDQTTFYE

SEQ ID NO: 181980 - protein, 502 aa, Glycine max
  Coding DNA Sequence Number=SeqID_90295
  Gene Ontology: Mol. function=phosphatidylinositol binding; Cellular component=Golgi apparatus; Biological process=clathrin cage assembly
  Homolog annotation: Hit_ID=Q8VYT2; Match level="QueryCoverage=100%, HitCoverage=99%, E-value=1e-129, Identity=47%"; Hit description =Putative clathrin assembly protein At4g25940
  Pfam annotation: Domain name=ANTH; Domain location=29-238; Score =148.9; E_value=1.4e-41; Accession=PF07651.7; Description=ANTH domain
MGTFQTLRKAYGALKDSTTVGLAKVNSEYKELDIAIVKATSHVEYPPKERHGDPTFKDDLINYARRGRFLQISNFKDDSSALAWDCSAWIRTYALFLEEKLEYFRILRCDIEAERLTKPSPTKTQGHSRTRMLTSEELLEQLPALQQLLYRLIGCEPEGLAFSNYLIQYALALFFDMPKYDAVKALHIYKRAGQQAENLADFYEYCKRLDLARNFQFPTLRQPPASFLATMEEYIREAPLTATKRLEYHENDQSPQREEAKHREAEASEQPDEEVNEEEPVDKDETQPKEEEAELPPLISTDDTDDLLGLNEINPKAQELEENNALALAIVPPGGHNSSNLALTNISGTSGWELALVTTPSSHTSQAPDRKMAGGFDKLLLDSLYEDENARRQLQLRNAGYGYEGMVTHNPFDHYNQQDPFAMSNIAPPANVQMAFMAQQQQQMMFQQQQQYNTMMVPYQYPQTQYNQQMPVIGSSNPFNDALPMPSYPHSSMHHQGNYHLM

SEQ ID NO: 181981 - protein, 38 aa, Glycine max
  Coding DNA Sequence Number=SeqID_90296
MQRQRGKGKSGCGGGYQLGNASNTWWAAMMKEDQYGPN

SEQ ID NO: 181982 - protein, 122 aa, Glycine max
  Coding DNA Sequence Number=SeqID_90297
  Gene Ontology: Mol. function=cytokine activity; Cellular component =extracellular region
  Homolog annotation: Hit_ID=A7QUD8; Match level="QueryCoverage=85%, HitCoverage=90%, E-value=4e-47, Identity=90%"; Hit description =Chromosome chr11 scaffold_177, whole genome shotgun sequence
  Pfam annotation: Domain name=MIF; Domain location=2-111; Score=58.9; E_value=1.8e-14; Accession=PF01187.9; Description=Macrophage migration inhibitory factor (MIF)
MPTLNLFTNVPVDTVVASDILRDATKAVAKIIGKPESYVMILLNGGVPIAFAGTEEPAAYGELISIGGLGPSVNGKLSSTIAEILETKLYIDSSRFYIKFYDVQGIGCYLLITEVILVDVDF

SEQ ID NO: 181983 - protein, 71 aa, Glycine max
  Coding DNA Sequence Number=SeqID_90298
METKKKYGSRDLPIMWLRSLLRNQSRAQKRSKTLALQAEAQLVKTIMGLYMCPVVGRLLANQMPQILLRIK

SEQ ID NO: 181984 - protein, 82 aa, Glycine max
  Coding DNA Sequence Number=SeqID_90299
  Subcellular localization annotation: CTP_CleavageSite=10; ConfidenceScore=5.02e-01
MPHYFRMHPRLKAIAYTPQFNKNKQQFKDKSLTFLSKYMQLRSPKYINGKLESPRMRYLLVGDDNSANGIKNAKNGDLGLQL

SEQ ID NO: 181985 - protein, 162 aa, Glycine max
  Coding DNA Sequence Number=SeqID_90300
  Subcellular localization annotation: CTP_CleavageSite=69; ConfidenceScore=5.35e-01
TFRGPRKVKGKRSEAPSIAPSEVPTPFSSTLPPSSSTDIPVIPPARTQRPLPTPLSTGPADFVFTPQMLHSMLQSIHRGKSIIVAWLGDQPSSSRGGGASTAQEPAIEEPTAPTSSPVVAEEETTPAQTPQLSPPSAPAPEETQPSSALELNEDQPQEEQDV

SEQ ID NO: 181986 - protein, 191 aa, Glycine max
  Coding DNA Sequence Number=SeqID_90301
MGSSQKPSLKKRFYQVKIKSLEVTSLRELGQLMGQLQQQAFRKAYASADLKEFEEILGCPLGGRKPYLFFGFYPSTTRVAKVVKISAQELDRVKQNRNGVVGVPRKCLEERAKALENQGEGCPNVLLMGTRGCINYNPILAIRQLGYPMREVPSDKSITPFIAWGFSDHKREGTPRSSQGMGCDVKKGQRA

SEQ ID NO: 181987 - protein, 95 aa, Glycine max
  Coding DNA Sequence Number=SeqID_90302
  Gene Ontology: Mol. function=oxidoreductase activity; Biological process=negative regulation of transcription
  Homolog annotation: Hit_ID=O23207; Match level="QueryCoverage=77%, HitCoverage=23%, E-value=4e-19, Identity=60%"; Hit description=Minor allergen
WTAITQFIHHGMLYVPIGYSFGMLYVPIGYSFGAGMFNLESTKGGTLYGAGVFAGDGTRQASEMELELAEYHGNLSQPMLLMADGGSWRKAKNPP

SEQ ID NO: 181988 - protein, 100 aa, Glycine max
  Coding DNA Sequence Number=SeqID_90303
MYMISLRLSAFNEYGSGVIDILTGSVCHIGWCIVGRQAIWSTSAMVMVVAIAAALTSIISFMLIIASIIVAICSFKASVLAFICSYTSSTSPNTLALARV

SEQ ID NO: 181989 - protein, 118 aa, Glycine max
  Coding DNA Sequence Number=SeqID_90304
VVIIKKGEIVEAKLHDESRLIQRCFDDNKGDEKKLKDVQDASRFKRKFDFKNQESRFKVQASKNQDQDSRLKIQESREDLKKIRYIYLGLTENKRGYISCGSVLVEGTSTRFFKENKG

SEQ ID NO: 181990 - protein, 15 aa, Glycine max
  Coding DNA Sequence Number=SeqID_90305
EYVGAKGNVLVDHKR

SEQ ID NO: 181991 - protein, 95 aa, Glycine max
  Coding DNA Sequence Number=SeqID_90306
MSQNFKDNDGCQVPRSGQARVASQQTDDPRTKLGCIMTIICRCVPSDTIVSGWQKVRNDHNLSPRAIGHDRIWMAKGVRNDHNLSLHVIGLAASG

SEQ ID NO: 181992 - protein, 95 aa, Glycine max
  Coding DNA Sequence Number=SeqID_90307
MTRGNPGDLQPVDPEIDRTFHRLVRHSVHPGHSVHFEHFEHPDHFEHSVVGDSEYSDFEHSTVNFHTKNMAQPPPREMAAHDFTYESLCIQYLDE

SEQ ID NO: 181993 - protein, 68 aa, Glycine max
  Coding DNA Sequence Number=SeqID_90308
MTAHPGELRLSPEVMSSPKRASFLTLKSFGGPSELEASLEHSTSVLKPMLKVPMLNVSMLTSVLENQC

SEQ ID NO: 181994 - protein, 180 aa, Glycine max
  Coding DNA Sequence Number=SeqID_90309
MIMRGQDIYSNQDEATTPPSFSKSEEAKGEESSEEIYPQEEGQPLMVKEECKKTTSKSPKKERHQIPMIGGMMNVLSGATLFCKITHASNIFMIHIDTDSLGVPTNPKRIKVIPEWSTPPSVEGRSPKFQVPLDLRSNPFQGGGNHDVAPCEAYRPWIFFINGVLCFLNMNGSGMEMEER

SEQ ID NO: 181995 - protein, 86 aa, Glycine max
  Coding DNA Sequence Number=SeqID_90310
MAYSLVDGAGRSPLLLCLPLHLHGGKPPLKDLIEAQRSSLHRSSTSKLPSSGNQSTRASKFAPIKLAIEVRFDFLWFKFLVLVLEP

SEQ ID NO: 181996 - protein, 279 aa, Glycine max
  Coding DNA Sequence Number=SeqID_90311
  Homolog annotation: Hit_ID=Q2HW90; Match level="QueryCoverage=72%, HitCoverage=49%, E-value=5e-20, Identity=30%"; Hit description =Putative uncharacterized protein
DFQLVPTVEEFEEILGCPLGGRKPYLFSGFYPSTTRVAKSEYQGSVWRKGQRPWQIKANGLLLLNILALLIFGVVLFPNMEGLVDLAAIDAFLAFHHGKESPVVAILAMYDTFDRRCEKSGARIVCCTPALYVWLVSHLFLQEGRPVYPLQEGRKNQDLSSCEGFPNVPLMGTRGCINYNPVLAIRQLGYPMRGVPSDESITPFIARGFSDHNARVLQGVRKAWDAAVRTQGLDWLPNLKTVRDDEVKASEESDEVQALKAELERARVVEEKFKSIAIK

SEQ ID NO: 181997 - protein, 108 aa, Glycine max
  Coding DNA Sequence Number=SeqID_90312
  Subcellular localization annotation: CTP_CleavageSite=29; ConfidenceScore=5.48e-01
MEPANSLPSAVRQFSILNFIRRPMNSLPSAVHVSSTNESRAPRIHCLALFARSPILNLIRRPMNSLPSAVPVSSTIESGAPRIHCLALFANIHSPSLIRRPMNSLPSA

SEQ ID NO: 181998 - protein, 203 aa, Glycine max
  Coding DNA Sequence Number=SeqID_90313
  Pfam annotation: Domain name=N_methyl; Domain location=16-39; Score =13.2; E_value=0.061; Accession=PF07963.3; Description=Prokaryotic N -terminal methylation motif
MKLFKSRMHRHARSQAGFTLVEISVAVLLLTLLTVYASVDMRRKADESAAEATARYLMRIRGAVVDLQLKHEAWLRGEDLTGLPSGSYPTPPALAWANVAGVQVARGGLADLTALGLLPATIPRYPTLGDVARFILVRQGACPGDECRTSAYVYVCHPISAARSLRQNAECAPPGADRSRYDQALLSKVVLASEGYGGHEGIL

SEQ ID NO: 181999 - protein, 117 aa, Glycine max
  Coding DNA Sequence Number=SeqID_90314
MDNEEGVQEQMKADLSALKDQMASISEVMLKLQKTIEDKATATASSTVREAEPVLQPALNPGRDKNTVVFGRRYSPQAYPYGLPPDFTPCATPEDLSQAPTFEGQLPPYDDWGRARR

SEQ ID NO: 182000 - protein, 99 aa, Glycine max
  Coding DNA Sequence Number=SeqID_90315
MAKGAEDDVSLYASMGSFAPSLMKGAGAGGDVSLYASTGSFAPWLTKGAGAGDDVSLYASTGSFAPWLTKGNSVGLAEARDQRRKPQGPIGLIWVQRVP

SEQ ID NO: 182001 - protein, 358 aa, Glycine max
  Coding DNA Sequence Number=SeqID_90316
  Homolog annotation: Hit_ID=A5B5V0; Match level="QueryCoverage=67%, HitCoverage=57%, E-value=2e-07, Identity=22%"; Hit description =Putative uncharacterized protein
  Subcellular localization annotation: CTP_CleavageSite=41; ConfidenceScore=5.58e-01
MVESLKKQKGSSSTTTVAGNHRQGTSRDPSAPVPLSLSSSRSSTLFSSDDQHQRYYSQFCNRVILDPKYLDLEFIDEETFDCYQFPELVKVFYNNLKIQDGILYSKVHNIPIVIDQSLFFSLTKLPSQGVPFEGTLVDDWKFDYSSHDARCMVYNDQADMNSRLLAGSLTFDCRIMHYIIVRILLPRSSNLAQASEEYLILMWAFQTGCQIDWAHLVRYRMHKALRANAPLPYPHLVTLFLHHFNIPLDDEPYVKVKRYFSIGAGVVSSFGYRNDVDGQWIHKQDLPLPIPYELTPSPPPQRGDSTSLLNEVLTELRRLQAFVGEQFEAMDTRLDAMDTRFDGMDTRITRLEDDMSFI

SEQ ID NO: 182002 - protein, 100 aa, Glycine max
  Coding DNA Sequence Number=SeqID_90317
  Homolog annotation: Hit_ID=A2X5W1; Match level="QueryCoverage=98%, HitCoverage=50%, E-value=5e-20, Identity=48%"; Hit description =Putative uncharacterized protein
MWRHMKERSLTNKGNRSKQEIKSIIGTKSIVQKAFEMKEDSISGEWSDVVEVWKATHMSSNGTWCIPKGEEIMEALQNVGDIYQKEISKAPVPLVEHFAM

SEQ ID NO: 182003 - protein, 107 aa, Glycine max
  Coding DNA Sequence Number=SeqID_90318
  Subcellular localization annotation: CTP_CleavageSite=48; ConfidenceScore=5.75e-01
MATPPASPPPSHPPPPPPPPPAVASTCPSTLKQTRKVTRLRSLATRPPGAEKPVVHVDPATSKANGPQKKKLRTYLGIVVRDKIDVTYETWKEVSASQKDLIWEDIQ

SEQ ID NO: 182004 - protein, 149 aa, Glycine max
  Coding DNA Sequence Number=SeqID_90319
MAMFLLNLWIIPASILIRISLRPLLTPIKIVSKDVLLKGMVGYEPVPSASSPNSISTSVKRISPSVSHANTLSNSDLSFATWHSRLGHFHLTNIQIKNHDPGGGERSNSDETKETENNNHFDNGRDKKFNQFREKRCDSAEKYYREVVQ

SEQ ID NO: 182005 - protein, 86 aa, Glycine max
  Coding DNA Sequence Number=SeqID_90320
WALLRDTGSGQNMQNVLNLIRPNLKTDESGIWNNPMEGCMKNNSGGAYLPVVGVASCGVVIKGNNGSFVWAYSRRLGHCLILEVEL

SEQ ID NO: 182006 - protein, 144 aa, Glycine max
  Coding DNA Sequence Number=SeqID_90321
MLTNPNTSYQEQAQEVALVCIKNKLKRLLKRLALTDPLKLLQEHNKGLHQTYLREVAKEKKHRLLTMLDFKVDGEQREQESLDGEEDREKEKTLRRRRNIPRYGGEGEEAETCDDARVRRTRCSDADRDLEGRRRLEEEESAKA

SEQ ID NO: 182007 - protein, 198 aa, Glycine max
  Coding DNA Sequence Number=SeqID_90322
MAARFLCDVEGCHIQRNIMDECIWKPHPSGLYSTKSAYAVMWGEAAVDNQVQHFEELWKLKIPPKVVVFAWRLFRDRALAEGKRGTNESLWWQDLMVVTHEQQLNNVMQSGLSWNVGSGDKIKFWEDCWNGERVALMQKFPRLYQISRQQHNLIQQGALTAGEAMIAEVHGKPGSQRYNKWKTWWIALTWSIWKHQNE

SEQ ID NO: 182008 - protein, 76 aa, Glycine max
  Coding DNA Sequence Number=SeqID_90323
MYMISLGLLALNGYGCRVVDILMGVCATLGGVWLGAKPYGDDKKLKDQSKNNSSESRTIQEFKIRIKKNSRLKKKV

SEQ ID NO: 182009 - protein, 95 aa, Glycine max
  Coding DNA Sequence Number=SeqID_90324
  Gene Ontology: Mol. function=sequence-specific DNA binding; Cellular component=nucleus; Biological process=regulation of transcription, DNA-dependent
  Homolog annotation: Hit_ID=P48001; Match level="QueryCoverage=51%, HitCoverage=12%, E-value=3e-14, Identity=75%"; Hit description =Homeobox protein knotted-1-like 4
MGDYLTSWISLHNFLLLTREEDKARLVQETGLQLKQINNWFINQRKRNWHTNPSSSSGSKSKRKRWVSSFLVYFWIKVRRDQSSGAGESSNQSFM

SEQ ID NO: 182010 - protein, 105 aa, Glycine max
  Coding DNA Sequence Number=SeqID_90325
MAAPVVPPMMERELITMIVDTLLVSYYEKMVGYVPSSFADLVFACERIKVVKSLGQMEKRRRRKEPMSWLPFLHGQISQLLNNVIAQPISSLLITQHPIIHKGHH

SEQ ID NO: 182011 - protein, 106 aa, Glycine max
  Coding DNA Sequence Number=SeqID_90326
  Subcellular localization annotation: CTP_CleavageSite=31; ConfidenceScore=5.12e-01
MEAKAQKWWPRGKKSANPVQGCSPRRAQLAQASSARPSELTLYFFFGKTQRWAWDEDLSIVILASTHVRPQVPENRKRHCATNCGRVTVYLDWSLPLGLARYLTIA

SEQ ID NO: 182012 - protein, 444 aa, Glycine max
  Coding DNA Sequence Number=SeqID_90327
MAPSSLGVFLPIKAKELVVTEGGHEVHVAFSLDSLACKAEEWTDVMVDSVRGDLKSLEGFSVQDVNGTSLFDEDPGHHEVRYNDGDNHEVVLVDRDVSLEVLVRKGDRRETSLKECGEKINVNVPDGVRVPVLVEVVTHRPMAGVFVYLSLLLFFCLLPGSCVAPLDVLQGPAVFGVVTNTTVISTVVCNTRTNGVLHTKSFDEGVEAVYGLGFSCVKMASKCSSGAVVPLYCSRLSGFHPKDDARRRDLGHLQCCLFVGGVIPLGCVQASDPCKDSLAYVMPNPSRLEDDLRVDAKAILNTPTPYATLFDDNKVIWRLSKDGCLPTRHALSATQCVVHSSQLTTRGNNIGHRHDFVELVVRARSSQRVEPMVNHQLQRWMLPPPGSLKCNLDETFFSQEMALSNVIQDFSNWKPYFPMVKEGEAMTLKSALLWLQTERGEGHH

SEQ ID NO: 182013 - protein, 280 aa, Glycine max
  Coding DNA Sequence Number=SeqID_90328
MDYTSVPSLASEMLRNFTDCALTLPFNSRHVVEIHGLPNDGYQVPRSGQAKDRGCLVKSKVTRSHLRFEFNLIKGLVLHLVGLPSFVWSFSFDIYEELCLNFPWLKFLPNQCGDSSLDLQSSSSNDYEEVDLAYLEFPWGWNLVMERASPRVTLGLSSLGPGTCLSKYKCYALAYMALAVGGIYWRRGGVNQWDLPRADLGFCNPFRGLTRKLFDLGFEHRALEHMSLVVGGTHRRRGDMLLHICHSPWVTHIGVMMGGCFMWELPSSPGRAGQQPPPSF

SEQ ID NO: 182014 - protein, 42 aa, Glycine max
  Coding DNA Sequence Number=SeqID_90329
MGLKEHSNRVTPKAYTPKGPSGPLPPDSGLTPKIILAHRLYL

SEQ ID NO: 182015 - protein, 237 aa, Glycine max
  Coding DNA Sequence Number=SeqID_90330
  Homolog annotation: Hit_ID=A7PT51; Match level="QueryCoverage=100%, HitCoverage=49%, E-value=1e-46, Identity=47%"; Hit description =Chromosome chr8 scaffold_29, whole genome shotgun sequence
ALLSRLDLAGNSHNHHNSNNGHHDLPSPNNLRHRRRPFLHLTRVGTLDDDFFSGDDDDARSLFGSIPKPSSNATLLALSPFKTTSAFSDLLADDGIRVSQVIRSGTTFNTQGLSSLSSHHDDDDDDDDSEEKEEPKKEKVDLQFFVKGIEVGRRDAAALFFLVSFLSAAYGWVILVFLVTYSWVLGVVFVSVVNDLLGRFSSVTVLVWEGSRLGLKRLSGFILMRWAVRDALTQLLG

SEQ ID NO: 182016 - protein, 73 aa, Glycine max
  Coding DNA Sequence Number=SeqID_90331
MEKCLVKLQTKFREDPTANEGWAVFLPRQLHTQFREDPMVNEGWTAFLPRQLHVAISRSFIKRLPPEAPLWLL

SEQ ID NO: 182017 - protein, 32 aa, Glycine max
  Coding DNA Sequence Number=SeqID_90332
METQKNSGEKTRKLQKAFGTKKKKKFKEIEGL

SEQ ID NO: 182018 - protein, 165 aa, Glycine max
  Coding DNA Sequence Number=SeqID_90333
MNFAARKPVEFTPIPVSYADLLPCLLDNSMVAITPTKGHQPPFFREYDSNATCACHGEAPGRSIEHYRALKPKDFQLSPEVGASHGQFAQATYAPEFGTSKTVGGGAVKQQGQPFPCVQESPTTRDPRSLNPFSEIRRREEEISLKRDRLYNEDQSKFLIEYASG

SEQ ID NO: 182019 - protein, 107 aa, Glycine max
  Coding DNA Sequence Number=SeqID_90334
  Subcellular localization annotation: CTP_CleavageSite=93; ConfidenceScore=5.43e-01
MHTQIFSIPPFPKIGLTHKNSPQWCRQLSQPTLLRAGKARLTGALSKGGKCAESPPTFICGKRRKNRRKPVIKNIPSSGVVFTFEEGRQKRGSCSYVPSIEEEIRPT

SEQ ID NO: 182020 - protein, 131 aa, Glycine max
  Coding DNA Sequence Number=SeqID_90335
  Pfam annotation: Domain name=Ins_element1; Domain location=42-124; Score=-19.7; E_value=0.011; Accession=PF03811.4; Description =Insertion element protein
VKVGTCYVPINVSSSPKVGPGLPGINRDTRIYLFCEVIFRHSCPSCSATDGVVRYGKSTAGHSAGKCTSRCAYTTPAALSAVQGAPIAIQAAQLLGRAIVRPLRITPAGERGMCCKAIKLGNARVFPVTTL

SEQ ID NO: 182021 - protein, 106 aa, Glycine max
  Coding DNA Sequence Number=SeqID_90336
IIEHKCHNLPFCGRARRDSRVRFSKEEKCAESPPTFISGKRRKNRRKPVDKSGALAPTYPPSNRKSDLRSSLLRVNQAILFTWKVIILRRWTLKMIHLLDELDFTS

SEQ ID NO: 182022 - protein, 150 aa, Glycine max
  Coding DNA Sequence Number=SeqID_90337
MVSPQGSNTWTVDDLVSYMEKIMILSEEQERITESVSHGPTSERQFPAQEFHILQSSVETQGIGRRREAVEAEEYSQQMVECGHGMYYMPPIFFQYPSQMYQYPFEGVDLRHQFSTEAEQVEAGRHRGRRNPDRQAQRWDRPCGTSSRTS

SEQ ID NO: 182023 - protein, 132 aa, Glycine max
  Coding DNA Sequence Number=SeqID_90338
MVPKDLKQLTQKIKDQLEDSITKKVASQLMLSFSQMQSQFQSQMQSYGLPLPLELEVGLSTARVLTKKSCVDPLGQDPDIVSQRNMSCTSTKILLAWLPLEDFMRGQPPFTTSLWEMIKSRINRELRYQRNL

SEQ ID NO: 182024 - protein, 124 aa, Glycine max
  Coding DNA Sequence Number=SeqID_90339
HSGITPEKVVNAAELNNDVPKQDPLRELIKTLVDIYDKPVEFVWDLIEFGIPNVNSSLFLTYTDVSKITSGEKCLNIAILQLWTIAHWQMVVLCPKDNVVVCAYKKLNTTADGKVPKTGPSRLN

SEQ ID NO: 182025 - protein, 94 aa, Glycine max
  Coding DNA Sequence Number=SeqID_90340
  Homolog annotation: Hit_ID=Q1SN17; Match level="QueryCoverage=98%, HitCoverage=19%, E-value=6e-08, Identity=31%"; Hit description =Transposase, putative
MAKSFVGHPYVGQLTKDEKIVVANMLKSMVKPRNILLMLNEYNANSYTTIKQIYNARNVYRSSIKGNNTKMLQLMMMLDRDQYIHWPRMKDEND

SEQ ID NO: 182026 - protein, 59 aa, Glycine max
  Coding DNA Sequence Number=SeqID_90341
MEVEESLMGSRLPLHYRADTRGWCLVLDVQQVDFVADLGVAFVDDWVFLVGRVVSNGKD

SEQ ID NO: 182027 - protein, 134 aa, Glycine max
  Coding DNA Sequence Number=SeqID_90342
  Subcellular localization annotation: CTP_CleavageSite=30; ConfidenceScore=5.55e-01
MYPLLFSVTTTQVDVPSSCTTKDVPSNVLRQSSQAVSPSKLCEGGNKRILRREKGDTKEFRRLVLCSFGKGRRETQKEFRRLVLVEFFLAKGEERHKRIQAVSPLFFWKREKRDTKRIQTVSPWRILFGKGRRE

SEQ ID NO: 182028 - protein, 179 aa, Glycine max
  Coding DNA Sequence Number=SeqID_90343
MQLLCIPGQDFTRAAAKRRVRVMRTNMTTLTQIWMTLLLSNIPPGDHNANLPLWKYQGCAHKTPSGLGEVQQGPGVSSSSYGPLSVLQGSHFPPARGCAHKTPNGPGEVQQGSGVSSSSYGPLSVLQGARFPPARDCARKTPSGPEEGQQGLGVASSNYGPLSVLRGACRPQQGHQAPY

SEQ ID NO: 182029 - protein, 165 aa, Glycine max
  Coding DNA Sequence Number=SeqID_90344
MAPRKLSTKRYRKDAVAEGTSTAPEFDSHHFRSAEHQQHFEAIKGWSFHRERRVQLRDDEYTDFQEEIARRRWTSQVTPMAKFDPDIEEGARGMRSWVRGQWIPFDADALSQFLGYPLVLEEGQTCEYSQRRNRADGFDEEAIAQLLWIPDMDDVAAQQHPAQRS

SEQ ID NO: 182030 - protein, 102 aa, Glycine max
  Coding DNA Sequence Number=SeqID_90345
MLGKLGRIDGDPVLRETRIWATWEYVSSVGGGQQGMVGLCAICGCGKTCCAPSPDRHLVPHVMEWYLEICRGGQETLGTSGGVLLPKTKLDKSRPNPGIVSQ

SEQ ID NO: 182031 - protein, 44 aa, Glycine max
  Coding DNA Sequence Number=SeqID_90346
MKQRDVVNPLWIPHKLFLGQPGGKGFPSMYNTNRNSGGKIRGLG

SEQ ID NO: 182032 - protein, 169 aa, Glycine max
  Coding DNA Sequence Number=SeqID_90347
MSCLAIITPISLYRSVSWYMPSDTDERHVAQVIADAIYFFAGMPPTRHPLDPDKSNRALGFLALITGLCQSFGVPITPSKVIRPPITRAFIKKYCTPRQVQGDALEAADAPPPPHQANPAGSLGMERYLQHLVRQQAANHRGQVQIHEFYQFSLSQQGQGFAPFACLTP

SEQ ID NO: 182033 - protein, 73 aa, Glycine max
  Coding DNA Sequence Number=SeqID_90348
MKAQRQRHLPRLLIIVEGNPCGIYPDLSSFTGSGVYPDLSSFTGSGVIQISVACIKRSTPSQDHIIWYQSFGS

SEQ ID NO: 182034 - protein, 477 aa, Glycine max
  Coding DNA Sequence Number=SeqID_90349
  Homolog annotation: Hit_ID=A7PL80; Match level="QueryCoverage=88%, HitCoverage=60%, E-value=1e-126, Identity=58%"; Hit description =Chromosome chr7 scaffold_20, whole genome shotgun sequence
MKLEGCESYHKSANTNYRGSNFCSADGCTFASSGTEKRNDRIHNPNGPNPKRQCINELCRMRLDVPLLDQLVREYCVYRGIVDSASGKQPIPEPVKINQQDPGYCSSRDCSLELDCNASKHSDGETSVTNAQMDGSPENNSDVTSMRRIDFEVRYASELASIHEDCSTSGSQQHEDASVLQRCRLSGNGERSKRKRWRGRYDGNSYMSDASLEENSKQEHSIGTVVSTILKEKQGSEKLSVHDINNVEDRYEILLGMKELASKGMAAEAVEEVEFLKLVSSGDYNAALKVACTHLGPLAASDPALLKPLKETLLALLRPNEDALGNALPLHALAASLQVAVGRRLGVEEPQLMKIMRATLYTHNEWFKLQMWKDRFEGLLRLDSLKEANTPFLAPVTTSKSYADSCTNGSSQATVSSGTRMSEDGSSPTQASSRDVICDEGAILKVMEFLALPRADAIHLLAQYNGNAETVIQQIFA

SEQ ID NO: 182035 - protein, 448 aa, Glycine max
  Coding DNA Sequence Number=SeqID_90350
  Homolog annotation: Hit_ID=Q6L477; Match level="QueryCoverage=42%, HitCoverage=36%, E-value=4e-10, Identity=25%"; Hit description =Putative uncharacterized protein OSJNBa0009L15.8
  Subcellular localization annotation: CTP_CleavageSite=19; ConfidenceScore=5.34e-01
MATPPSSPPPPPHPPLPTDAASHSPSILKRKIKSKRMRSLFIGPIGAERPLVHVDPATGKADSPNRKKLRTYLGIVARDKVDVTYENGKQVLATQKDLIWEDIQPNLMLKWELTTNKDGVDDIVCEKNDISKEKWTQFCQSCRDPSWEAQVIQKQNTTPHVLSRGGYEYLENKLMEEKKKKQLEEAAQSRSTDTIIDLPSPIRRHVKWKKACTKKFGQMTSEAAKKIDEKIEHASQGSFIAHRRQDVLTVAIGQPEHPGHVCAARVGVTIKQYFGPAPRISHTSSSMAPEDLEQLTQKLKDQGLAMPPKPKVGPSATHVSTKESCVDPSGNDLDTGESEKYGLYIEENPPRLVAIGRLYEGSTTVHNIPLANDQVKVGVEEVRDADAHIPGAVGPGKPTDRSDHDVDDPLYLMTLIIPQLFLKPMQVMWDATMFGVYNDNFPLYIKHE

SEQ ID NO: 182036 - protein, 93 aa, Glycine max
  Coding DNA Sequence Number=SeqID_90351
MAKGAEDDVSLCASTGSFASWLTKGAEIDCAEKLLVYLRTSPDYRVSVEKLLVYLRTSPDFRVSKTDNAKDDVNLRVSTGSLAAIDKGCRRRR

SEQ ID NO: 182037 - protein, 215 aa, Glycine max
  Coding DNA Sequence Number=SeqID_90352
MCFAGNGPEKASIKEYFEAIKGWSFLRERRVQLRDNEFPDFQEEIGHRRWVPLVTPMAKFDPEIVMEFYANAWPTKEGVRDMHSWHCEFSQRRNQVSGFDEEAIAQLLCIPGQDFAWTAAARRLRIMRTSMTTLTQIWMTLLLSNILPSDHNFDLPLPKCQLVYAILIELIADTIYQFAGTTPTRHPVDSEKSNRALGFPALIKGLCQFYGVLVA

SEQ ID NO: 182038 - protein, 456 aa, Glycine max
  Coding DNA Sequence Number=SeqID_90353
  Gene Ontology: Mol. function=aspartic-type endopeptidase activity; Biological process=DNA integration
  Homolog annotation: Hit_ID=A5AMK2; Match level="QueryCoverage=20%, HitCoverage=15%, E-value=2e-15, Identity=41%"; Hit description =Putative uncharacterized protein
MTRNDQHGRPHPLSKAQCLPTETTKFSLFLHPEESEPDDTQRPTWSSAPFVERLNVYRPRLLKSPRFFIQRKVSPMTRNDQHGRPHPLSKAQCLSAKTTKVSPFRHLETIVSDDTQRPSWSSAPFGRRLNTMMVTRFHCSETIKVPLSSRDKQVRWCAGMTMGGVPITGPIWNILEEGYFRWKQPSLPGQAEQAGRQPPPPFFYKMAWMGAEEGGDVGPLLMLHPTFVGPHSPEEDDSHRSSFFTTTCTITSKGTNATVFHHLLVSFSIGPAYTYENVCNVVLMDACHCLLGCPWQFDRIAIHDEFDDVFPDPLPNELPPLRNIQNHIDLVSGYIQESLSPCDVPALLTPKKDAWHLAHRDSRFGLIDYQLTVINYTVQLRPCLNTSIDYIKNLIDYIVLDLVKCVPIPPLRSSSPNFASIIPYSGDASFGNETVPDLRTNLLHLREDDAVQGHQS

SEQ ID NO: 182039 - protein, 346 aa, Glycine max
  Coding DNA Sequence Number=SeqID_90354
  Homolog annotation: Hit_ID=A7P9G2; Match level="QueryCoverage=98%, HitCoverage=99%, E-value=1e-117, Identity=60%"; Hit description =Chromosome chr3 scaffold_8, whole genome shotgun sequence
MVLKEDICFFNKVARTSASKDILVMKPQKKSPLLLRMSVLIFSMISTHARTMLMELQIEKPSRSSISSINRLNLTHDVPLLHYPEPVSFNRSECAGNPVRFFAILSNQRSGSGWFETLLNSHINVSSNGEIFSVRERRVNVSTIVQTLDKVYNLDWLSSASKNECSAAIGSKWMLNQGLMDHPKEIADYFNSRSVSVIFLFRRNLLRRMVSMLANSYDRYAKLFSGTHKSHVHSKEEADTLSKYKPTINSTSLLADLKDMEMRTAKALEYFNTTRHMILYYEDLIQNRTKLKDVQEFLGLPQMELTSRQVKIHRGPLSDHIKNWDDVNRTLAGTIYESFLHADYSS

SEQ ID NO: 182040 - protein, 35 aa, Glycine max
  Coding DNA Sequence Number=SeqID_90355
NWKEDCFYVLSLEEFESRRKGLTTLRVIGLRSTPN

SEQ ID NO: 182041 - protein, 78 aa, Glycine max
  Coding DNA Sequence Number=SeqID_90356
MSPPPLETSQSFKISSKVPQDGFLFKPEGEDGVLSELAFAQHLYTTHPSSKIVHALNHQIGRLVNDALGQKISGLASS

SEQ ID NO: 182042 - protein, 152 aa, Glycine max
  Coding DNA Sequence Number=SeqID_90357
MAGTPHLPNYTPPNVAYIPNEDVNNSTPILIKSQQPQSDHAHVSRPMEETHEIPHHDLADFEPCHGYVAEGQAVGGVPLQNTLEGPQYHPQPQPSRSTTSKNPRAMAEMEKLDHLEERLRAIEGGEDYAFANLEKLFLLPKHGYSQVQGARL

SEQ ID NO: 182043 - protein, 341 aa, Glycine max
  Coding DNA Sequence Number=SeqID_90358
  Gene Ontology: Cellular component=periplasmic space
  Homolog annotation: Hit_ID=P0ADV3; Match level="QueryCoverage=48%, HitCoverage=88%, E-value=4e-76, Identity=84%"; Hit description =Protein yhbN precursor
  Pfam annotation: Domain name=DUF1239; Domain location=35-192; Score =141.2; E_value=3e-39; Accession=PF06835.4; Description=Protein of unknown function (DUF1239)
  Pfam annotation: Domain name=OstA; Domain location=186-326; Score =195.7; E_value=1.1e-55; Accession=PF03968.5; Description=OstA-like protein
  Pfam module annotation: Pfam domain module=DUF1239::OstA; Domain location=35-192::186-326
MAAEPDAVPSLLPTQRGPMATSCWVVKRGYHLLYGRVALVLIGVNLADRDDTQTEVINNNDPTYKSDHSDTVVYSPQGALNYRLIAQHVEYFSDDGISWFTQPVMTTFDKDKVPTWSIKSDRAKLTNDRMLYLYGHVEVNALTADSQLRKITTDNAQINLVTQDVTSQDLVTLLEPPMKFKTNKLSLKVIIASAMLATSLPALAVTGDTEQPIHIESDTQSLDMQGNVVTFTGNVVMTQGTIKINADKVVVTRPGGEQGKEIIDGYGNPATFYQMQDNGKPVKGHATHMHYELAKDLVILTGNAYLEQLDSNITGDKITYLVKEQKMQASSEKGKRLTTVL

SEQ ID NO: 182044 - protein, 49 aa, Glycine max
  Coding DNA Sequence Number=SeqID_90359
MEYHALITCLLQANQLAYRASAKRNTHGLSARKTLEEDELYRFCLSPPL

SEQ ID NO: 182045 - protein, 134 aa, Glycine max
  Coding DNA Sequence Number=SeqID_90360
MARAGDNGGVYHQLDESQRLFLDAWTTQMQRLLTKSSLFTLKPLSPREVCDDQIRMREKREQEKENSEAPQRNMKKSDTPEEKSDTHERKFNYFAEASEARKVLPAHEPLNLQYCKDRKISTDNSNEFTISISH

SEQ ID NO: 182046 - protein, 172 aa, Glycine max
  Coding DNA Sequence Number=SeqID_90361
MTETLNKLPQHLQAVSPSHSSLMQIRGCHICDGAHEPGKSIAQVDSYREVNYMGAQKPPQIPRLQPRRTAGIQSREEFHTGLKLEESFGEPTNKLEGTLNQFMHIFMSKYRSTELSIKKLEIQVGQLAKQMAERPTSSFGANTEKNPKEECMAVLTKSQRKAQGEEEKAEGD

SEQ ID NO: 182047 - protein, 65 aa, Glycine max
  Coding DNA Sequence Number=SeqID_90362
MEYETTNIKNGLFPLIQKPLSYPGETARKPHYKRNLKESWASSSKGNNTRKSSLPWIQTENANET

SEQ ID NO: 182048 - protein, 143 aa, Glycine max
  Coding DNA Sequence Number=SeqID_90363
MYPPLELIHKRCTLSCSQSNPSRCTLYLYHKGLPSNVLRQRSQAVKPLILCEWGFKRILRREKGDTKEFRRLVLCSFGKGRTETQKEIRRLVLGEFFLAEGEENEKMNSTSFQGLENQKTSESFWYKEEEVQRDSRLVKDCMK

SEQ ID NO: 182049 - protein, 21 aa, Glycine max
  Coding DNA Sequence Number=SeqID_90364
MTVKKRLSHKVPKVTVELSPS

SEQ ID NO: 182050 - protein, 108 aa, Glycine max
  Coding DNA Sequence Number=SeqID_90365
IAPTKTPSEPEEVQQGPGVSSSGYGPLSVLQGARTPPARSRHHRDRDCKTPSGPEEVQQGLGIFYGSTCHLQQGHQAPTNRAFIKKYCAPDRRRAKHHSSIGMAGSGQ

SEQ ID NO: 182051 - protein, 155 aa, Glycine max
  Coding DNA Sequence Number=SeqID_90366
  Homolog annotation: Hit_ID=Q6WAY6; Match level="QueryCoverage=94%, HitCoverage=28%, E-value=1e-20, Identity=35%"; Hit description =Putative uncharacterized protein
MANQGDWVPFMDVLALLIFGVVLFPNVDGLVDLAAIDAFLAYHHSKESPVVAVLADLFDTFNRRHPCPLQSHRSCTEKRRIDWDQLLAGIGGRTINWFPRWKEGKEGVLFSCGGYPNIPLIGTRGCINYNPALAIRQLGYPMRGAPTEEGMSPFL

SEQ ID NO: 182052 - protein, 137 aa, Glycine max
  Coding DNA Sequence Number=SeqID_90367
  Homolog annotation: Hit_ID=A5C7Z4; Match level="QueryCoverage=84%, HitCoverage=41%, E-value=4e-11, Identity=31%"; Hit description =Putative uncharacterized protein
MQSSKCNVYLGAYMNGGHWQMVVIVPNEHLVVWFCSLHNRPDNYLKGIINIALKGLDDAPQPKSKDPARWIVVKCNRQKGSTECGYYVMHWMSTIILGSFRNNCEAYFNDPRPLEPERLKAVRIQWAQYYLRVRDQT

SEQ ID NO: 182053 - protein, 225 aa, Glycine max
  Coding DNA Sequence Number=SeqID_90368
MEQSMLAIIGQYKEELNQSLAHEQKLVEDFAQAYAEKEARGRVIDALHQEATMWMDRFALTLNGSQDLPRLLAKAKAMAEGLEVDLSASITEVMLKIQKSIEDNTTAAASNTTREAKPVLQPAMNSGWDRSTTGFNRRYSPQAYPYGLPPDFIPRTAPDDLSQAPTFEGQLPPHGNYPLQEDDEGDAHLGPLLPPREPAPHELPQPNIICHAPSQSAPIKEPVPI

SEQ ID NO: 182054 - protein, 173 aa, Glycine max
  Coding DNA Sequence Number=SeqID_90369
MTLLLSNILPSDRNANLPLQKYQLVYVVPTWGSHPQRHPVDLKKSNRALGFSSFGYGPLSALQGARSPPASSCRRGIGIVPARHLVDPKKANRGVLSPPARSSGPPTNRAFIKKFCVSRQAQGETPQQPGDGRQRATDAPPSPLEFTSAHPQKGLSIAYTTWPTNRRPSPKPK

SEQ ID NO: 182055 - protein, 292 aa, Glycine max
  Coding DNA Sequence Number=SeqID_90370
  Homolog annotation: Hit_ID=A7ZVR4; Match level="QueryCoverage=90%, HitCoverage=56%, E-value=8e-67, Identity=47%"; Hit description =Putative uncharacterized protein
  Pfam annotation: Domain name=CSE2; Domain location=8-77; Score=0.7; E_ value=0.083; Accession=PF07544.4; Description=RNA polymerase II transcription mediat
ARHRRRRPGHQAVQHVIHAEVAQCGTEEHRGQLAAQESLLIELVGSALHQLQLIAQLRRQIFTHRRIQLRVVQAFDDAHFLNGVAFTGLLATADRPGDGRAGDLQFALDFIHHFHRIADIAVQFVHEGQDRRVAQTGNLHQLAGAILNALGGVDHHQTAVDGGQSTVSIFGEVFVPRGIQQVDQAVAVRELHHRGGDRDPTLLFHFHPVGFGVLAGAAAFYRTGGLDRLSEQQYFFGNGGFTGIGVRDDGESSSFGDFAGKFTRRHGFQVLRLVRPATSSERADRGAGQSGE

SEQ ID NO: 182056 - protein, 324 aa, Glycine max
  Coding DNA Sequence Number=SeqID_90371
MAKFDPDIVLEFYANAWPTEEGVRDMRSWVRGQWIPFDADAISQFLEYPLVLEEGQEYEYSQRRNRSDGFDEEAIAQLLCIPGQDFARNAAGRRVRIMRTNMTTLTQIWMTLLLSNILPSDHNSDLPLPKYQLVYAILTRMSVHVAQLIADAIYLFAGMAPTRHPLDPDKSNRALGFPALITGLCQSFGVPVAPTKYCSQRQAQGNAPQAAGVPPPPHQAGPAGSFDMEQYLRHLVHQQAANHRAHVQTHDCLYQLSLSMQSQGFASFSCPTPDQFRAEVAWPGDWPEAQAGEAPPEAPGDGEEAHEDEEMADLLDFLGGSGAT

SEQ ID NO: 182057 - protein, 318 aa, Glycine max
  Coding DNA Sequence Number=SeqID_90372
AAVSLAKPPQKPDPEVDDPLYLMTLTIPELFLRPYQVTWDATVFGVFNLDFPFYIKHEDLSEISRGGQCLNISVLQLWILPDNYLKGIINSALKGLDDAPQLKSKAPTRWIIAKCNRQKGNTECSYYVMHWMSTIILGSFRNNWEAYFNDPRPLEPERLKEERCAESPPTFICGKRRKNRRKPVKMKILSSGVVFTLEEGISTSHVDKSGAFAPTYPPLERKSDLRSSFFKGESSDSFYLKGDHFKALDLKKDPFYLQNRGGACHPARPGEQGCFLQKQQPSGGRIWKAQLSKKLRKLTDYAKTPLFDFRHITEFHGS

SEQ ID NO: 182058 - protein, 96 aa, Glycine max
  Coding DNA Sequence Number=SeqID_90373
  Gene Ontology: Mol. function=protein serine/threonine kinase activity; Cellular component=nucleus; Biological process=protein amino acid phosphorylation
  Homolog annotation: Hit_ID=A7P5G1; Match level="QueryCoverage=100%, HitCoverage=34%, E-value=5e-31, Identity=69%"; Hit description =Chromosome chr4 scaffold_6, whole genome shotgun sequence
MMERVLGPIPEHMIHSKRAEKYFKRGSHLKWPEGGVSRERISAVKKLGHLKDIVSRNVDSSMSSLTDLLHGLLTYDPTKRLTACQALDHPFFRNPT

SEQ ID NO: 182059 - protein, 74 aa, Glycine max
  Coding DNA Sequence Number=SeqID_90374
  Subcellular localization annotation: CTP_CleavageSite=32; ConfidenceScore=5.10e-01
MKSWSLKMFIGHGYSKGCRNMPFCGRAKARLTGALSKGGKMRGVATNVYLWKTSEKPKETGRNENSKFGSCIYV

SEQ ID NO: 182060 - protein, 142 aa, Glycine max
  Coding DNA Sequence Number=SeqID_90375
MARKPRQDFSVSKIRFFLTFVAEYGSQSKRESGPFLLHSNGDMWHCLNKIIEKEKTLLFKTKKLFRQLSLSLTLPFSSSSFSIEAPSKASTFGHHFCPKSRKEGIFGVVKCMATSGTSKFQTFVESLLKLPCLDELDIPILF

SEQ ID NO: 182061 - protein, 62 aa, Glycine max
  Coding DNA Sequence Number=SeqID_90376
MRGVATNVYLWKTSEKPKETGRNENSKFGSCIYVDKSGALAPTYPPSKRKSDLRSSFLCVNQ

SEQ ID NO: 182062 - protein, 194 aa, Glycine max
  Coding DNA Sequence Number=SeqID_90377
  Homolog annotation: Hit_ID=Q6WAY4; Match level="QueryCoverage=86%, HitCoverage=30%, E-value=4e-19, Identity=35%"; Hit description =Putative uncharacterized protein
MGTNQNGKRFYQVKIKGLDVTSLKELGRLMGPFQRQAFRKVYGKILDLTAAEVFTEAVVSLAQYYDQPLRCFTFGDFQMVPTVKEFEEILGCPLGGRKPYLFSGFLPSLSKIAVVVGDLAKELDRMKQTRNGVVGLPRKYLEGKARDMASQEKWVPFMDVLALLIFGVVLFLNVDGLVDLAAIDAFLAYHHSKK

SEQ ID NO: 182063 - protein, 76 aa, Glycine max
  Coding DNA Sequence Number=SeqID_90378
  Subcellular localization annotation: CTP_CleavageSite=52; ConfidenceScore=5.64e-01
MSVSACYHALSLRDSKRKFKSAGPNGSRMSSGPPPLNDKRRRRQHSKRKFKSAGPNGSRMSSGPPPLDDQRRRRQR

SEQ ID NO: 182064 - protein, 45 aa, Glycine max
  Coding DNA Sequence Number=SeqID_90379
  Homolog annotation: Hit_ID=Q6VPE8; Match level="QueryCoverage=100%, HitCoverage=5%, E-value=8e-07, Identity=53%"; Hit description =Putative gag-pol polyprotein
MEARRILLERPWQFDKKIICNGLTNEITLTHLGTKFVLHPQTPSQ

SEQ ID NO: 182065 - protein, 156 aa, Glycine max
  Coding DNA Sequence Number=SeqID_90380
MQPGGGLLFRLFPQPVALNRVETRMLLQAILPGVVEQVMLQELAVARIEVAAEQRLAGVDRLCQRRRRGGIGRQRLPQARGEIAFDKPRAAAQGPPQPVDEAQALVEHAAPQLVAMVGIDGDLQVMETLDFTGHLGYILPGYRGGDAVDSAPGLQL

SEQ ID NO: 182066 - protein, 89 aa, Glycine max
  Coding DNA Sequence Number=SeqID_90381
MCRRALSVPFQYVPCFSLVPSRAHLRSLYLPLSLSAERAYEAGEELMAYADLALDPTEVKNRLDRKIEGVGSEPDRAQLAASGRDVPTI

SEQ ID NO: 182067 - protein, 110 aa, Glycine max
  Coding DNA Sequence Number=SeqID_90382
MFMTARLCISAVVGEKMCFREENPSRGAAVKLPRHFHEQIREDFPPFFVPFSFVLQSSTVNMDRSKAQNQSITLPLLQELLLKELRRSDFLIAIEEYVGAREIPLLTTKR

SEQ ID NO: 182068 - protein, 228 aa, Glycine max
  Coding DNA Sequence Number=SeqID_90383
LVEEDFALLLGAGQVEGLARDVVGLLLQLHDALAQVVALLGQRGGIDEHAVALYAEQGLAGGDLQLVDAAQAVVGLQLRPQYAVHVQGLVGILAGIGGSLVHGHLGERDLVGALAAQVFIADARAVGVAQRQAGQAVRAVHFQHIALQHGVVHIAVHLDAGIGEDMAAVALARRGRHGAGDVGSGAGLHAQRDAHDLGTHLVQRGGFGIQGREFGGVDLGQPLVERFP

SEQ ID NO: 182069 - protein, 126 aa, Glycine max
  Coding DNA Sequence Number=SeqID_90384
FLWGGGLDQKKIAWVKWDYWLMEQEPLREKYPRLYNISCQQQKLIQDMGCQSANVWEWKLEWRSRSITTSNRWEVTKTMGGSGALFGEGHCFDNEIDTAGVFLNEVQDMAIQQHGPDVWEWTADPT

SEQ ID NO: 182070 - protein, 130 aa, Glycine max
  Coding DNA Sequence Number=SeqID_90385
  Pfam annotation: Domain name=zf-CCHC; Domain location=58-75; Score =30.1; E_value=8.1e-06; Accession=PF00098.14; Description=Zinc knuckle
MQEEEEEEEEEEEEEESDDEEDFSLFVKRFHKFVKNRRMERSHNFNNGKRSQEVSPTLKCYKCNQPDHIKANCPTNESWPEKNEKKSYKERRSKKAYIAWDDNDSSDGSEKEINLLSKDYESDENISQEV

SEQ ID NO: 182071 - protein, 143 aa, Glycine max
  Coding DNA Sequence Number=SeqID_90386
MAAQLIHDRVEMECLEGAWETLEGNTRCRFWGTIRFTATSLVHPDEPVRTLQHIVEWILPTPTPYLLAKPVQVIEVTSSEEDPKEDPEELPPQPAVDALDFLEGDEDPLLEVDSPEEVMSASEADSTEDSGPREMATSGGPSS

SEQ ID NO: 182072 - protein, 167 aa, Glycine max
  Coding DNA Sequence Number=SeqID_90387
  Gene Ontology: Mol. function=isoleucine-tRNA ligase activity; Cellular component=cytoplasm; Biological process=tRNA aminoacylation for protein translation
  Homolog annotation: Hit_ID=A8G9L4; Match level="QueryCoverage=97%, HitCoverage=17%, E-value=1e-75, Identity=84%"; Hit description =Isoleucyl-tRNA synthetase
  Pfam annotation: Domain name=tRNA-synt_1; Domain location=1-167; Score=-319.1; E_value=4.7e-06; Accession=PF00133.13; Description =tRNA synthetases class I (I, L, M and V)
MDQKGLRQQSLEEIKGVQWIPDWGQARIEMMVANRPDWCISRQRTWGVPMSLFVHKETEQLHPRSVELMEEVAKRVEQDGIQAWWDLDAADILGADAADYVKVPDTLDVWFDSGSTHASVVDVRPEFHGHSADMYLEGSDQHRGWFMSSLMISTAMKGKAQYCIKKC

SEQ ID NO: 182073 - protein, 122 aa, Glycine max
  Coding DNA Sequence Number=SeqID_90388
MKRDFQGQIRVGPESHGRGGLSERKKEKINGAMLTYVRLIDQTIRLPLLSTSLQGLLSSSFRPGQAFSLSRFGLGRCAPATSWQKSRLMGKPPPAAMVWGVRGCCPVANSKGLKFDAELFGC

SEQ ID NO: 182074 - protein, 71 aa, Glycine max
  Coding DNA Sequence Number=SeqID_90389
GSHLQDTQWTRRSPTESWNCQALNTGLYQFKGVPVAPSRVIRPPTDRAFIKKYCVPRQAQGETPQQHWDGR

SEQ ID NO: 182075 - protein, 63 aa, Glycine max
  Coding DNA Sequence Number=SeqID_90390
  Homolog annotation: Hit_ID=A6FJQ2; Match level="QueryCoverage=60%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARRYQKISGSLLYVD

SEQ ID NO: 182076 - protein, 124 aa, Glycine max
  Coding DNA Sequence Number=SeqID_90391
  Gene Ontology: Mol. function=chitin binding; Cellular component =extracellular region; Biological process=chitin metabolic process
  Homolog annotation: Hit_ID=UPI000066154C; Match level="QueryCoverage =95%, HitCoverage=100%, E-value=6e-15, Identity=39%"; Hit description= Homolog of Homo sapiens "Keratin-associated protein 10-1
  Subcellular localization annotation: CTP_CleavageSite=20; ConfidenceScore=5.37e-01
MVRASSPLKARTCSPLKARRCSPLKAWTCSPLKARACSPMKARTCSPLKLKDARACSPLKVRAWSPLKVRTSSPLKARACSPLNVRTCSPMKARACSPRKKARTCSPLRARACSPMKARTCSPL

SEQ ID NO: 182077 - protein, 81 aa, Glycine max
  Coding DNA Sequence Number=SeqID_90392
TSPSGRVTGCCRVSGLAKLCGIRADCTESAPYAAPFAIQAAQLLGRAIGAGLFAITPAGERGMCCKAIKLGNARVFPVTTL

SEQ ID NO: 182078 - protein, 19 aa, Glycine max
  Coding DNA Sequence Number=SeqID_90393
VDLETVEPQAQQSEQTSGF

SEQ ID NO: 182079 - protein, 25 aa, Glycine max
  Coding DNA Sequence Number=SeqID_90394
ACNMRQAAMEDLAEMLEKQLASELF

SEQ ID NO: 182080 - protein, 111 aa, Glycine max
  Coding DNA Sequence Number=SeqID_90395
MEQGNKVNPLPLPLKNDEKPSEICDPPGHLGVSWWSKQYGILSDACVGFHLQGHETLEANGSVQFFKNIWDILIRVLDAQAFVGSKDCKSDGLPLVIHYIQHAQLVAFLCK

SEQ ID NO: 182081 - protein, 307 aa, Glycine max
  Coding DNA Sequence Number=SeqID_90396
  Gene Ontology: Mol. function=transcription activator activity; Cellular component=cytoplasm; Biological process=regulation of transcription, DNA-dependent
  Homolog annotation: Hit_ID=A6T9W0; Match level="QueryCoverage=99%, HitCoverage=99%, E-value=1e-160, Identity=93%"; Hit description =Putative transcriptional regulator
  Pfam annotation: Domain name=HTH_1; Domain location=13-72; Score =68.8; E_value=1.8e-17; Accession=PF00126.18; Description=Bacterial regulatory helix-turn-helix protein, lysR family
  Pfam annotation: Domain name=LysR_substrate; Domain location=96-306; Score=139.1; E_value=1.2e-38; Accession=PF03466.11; Description=LysR substrate binding domain
  Pfam module annotation: Pfam domain module=HTH_1::LysR_substrate; Domain location=13-72::96-306
MEKNGLFSQRIRLRHLHTFVAVAQQGTLGRAAETLNLSQPALSKTLNELEQLTGTRLFERGRLGAQLTLVGEQFLTHAVKVLDALNTAGQALNRKEGMNSDVVRIGALPTAALGILPTVIGQFHKQQKDITLQVATMNNTMLLAGLKSGDVDIGIGRMSDPELMSGLNYELLFLESLKLVVRPGHPLLQETVTLSRVMEWPVVVSPKGTIPRQNAETLLQSQGCKIPPGCIETLSASLSRQLTVDYDYVWFVPSGAVKDDLRRGLLTSLPIATEGAGEPIGILTRVDASLSQGAQTLLSAIRKSMPG

SEQ ID NO: 182082 - protein, 246 aa, Glycine max
  Coding DNA Sequence Number=SeqID_90397
  Homolog annotation: Hit_ID=Q84VI1; Match level="QueryCoverage=100%, HitCoverage=40%, E-value=1e-116, Identity=79%"; Hit description =Envelope-like protein
DLIDLEEVESDEEPIANRLAPGIAERLQNRKGKTPLKRSGRIKTMAQKKSTPITPATSRRSKVAIPSKKRKEISSSDSDDDVELDVSTSKRAKKSGRKVPGNVPDAPLDNISFHSIGNVEKWKYVYQRRLAVERELGRDALDCKETMDLIKGCWTTERQSPMFVRGKCVRFSPAVINKYLGRPTDGVIDIDVYEHQIAKEITAKRVQHWPKKGKLSAGKLSVKYAILHRIGAANWVPTNHTSTVAT

SEQ ID NO: 182083 - protein, 48 aa, Glycine max
  Coding DNA Sequence Number=SeqID_90398
SRIILGHGQKSRQVNGGSQPRQMEDRVTADRRLFPALDKQRRSLQDSP

SEQ ID NO: 182084 - protein, 132 aa, Glycine max
  Coding DNA Sequence Number=SeqID_90399
  Subcellular localization annotation: CTP_CleavageSite=17; ConfidenceScore=5.00e-01
LFRYGTHPTKGAHTPTRGSSPDSSSDSTSTGQQRSLWHKHGKELFAKAGTNLCPDPNDIWGTLAISHHQPIGHGGPRKDLLVPVPKVQGPKLDRGRVVDFSRGQAQHKNKPEAKEIGDQFLLERKHTIQDKL

SEQ ID NO: 182085 - protein, 65 aa, Glycine max
  Coding DNA Sequence Number=SeqID_90400
LDHQGFASFACPTPDQFRAEVAWPGDWPEAHAREAPAEAPGDGEEARMDEEMTDLLDFLGGSGAT

SEQ ID NO: 182086 - protein, 75 aa, Glycine max
  Coding DNA Sequence Number=SeqID_90401
MTRGNPGDLQPVDPEIDRTFHRLVRHSVHPGHSVHFEHFEHPDHFEHSVVGDSEYSDFEHSTVNFHTKNMAQPPP

SEQ ID NO: 182087 - protein, 127 aa, Glycine max
  Coding DNA Sequence Number=SeqID_90402
  Homolog annotation: Hit_ID=A4PP05; Match level="QueryCoverage=62%, HitCoverage=23%, E-value=5e-08, Identity=40%"; Hit description=IMP dehydrogenase/GMP reductase, putative
MVVTARPERVLRQFGYIQSIPPPPVSASLSHDDIDDRWMHFANHVLAVGELCLVPGRVSTDYMEWFFRISHPFMIPTQAGDQPRDAPAADLEEYMQPPIPQDCLTIAREGVSADGSVRARQRRCTEH

SEQ ID NO: 182088 - protein, 203 aa, Glycine max
  Coding DNA Sequence Number=SeqID_90403
  Gene Ontology: Mol. function=serine O-acetyltransferase activity; Cellular component=cytoplasm; Biological process=aromatic amino acid family biosynthetic process
  Homolog annotation: Hit_ID=Q1H3Q2; Match level="QueryCoverage=99%, HitCoverage=63%, E-value=7e-56, Identity=56%"; Hit description =Serine O-acetyltransferase
MEEIAIEHIVQQLASIRESALRQRQRLSQPPKLPARKALGKCVEWLAASLFPNRLGDSDIQAQAINFYVGTTLDKALRELQQQVRLELAFKAPGTPASQFNTQAHAISHAFAEQLPHIRIQLDTDLEAAYQGDPAADSVDEILVSYPGILALIHYRIAHVLHGLGLTIIARLITEIAHSQTGIDIHPGARIGDYFFIDHGTGV

SEQ ID NO: 182089 - protein, 75 aa, Glycine max
  Coding DNA Sequence Number=SeqID_90404
MDSLKQSWYIDSGCSMAGDASKSIHISPKNSEHVIYGDNNKGFDDAKKNSLDNDCHHQKGGECKCINIGFDDAKV

SEQ ID NO: 182090 - protein, 205 aa, Glycine max
  Coding DNA Sequence Number=SeqID_90405
  Homolog annotation: Hit_ID=A7P7E6; Match level="QueryCoverage=88%, HitCoverage=32%, E-value=5e-18, Identity=33%"; Hit description =Chromosome chr9 scaffold_7, whole genome shotgun sequence
  Pfam annotation: Domain name=DUF1723; Domain location=83-132; Score =45.8; E_value=1.6e-10; Accession=PF08330.1; Description=Protein of unknown function (DUF1723)
ADASAQAVEDEPEGFPGGPSDPSVLTEYTNHVASSVWTGEERPELKLSFHGRKVHNLGRLVPVIEGLVVGTGLSPLIACSINTGDRGLLSSFVERWHRETSIFHLPVGEVTIMLDDVASLLYLPVMLMELLMVTSEAARAETGQYRGPYVRLQWVCDIYERRCRAGHWTVAACTFLLHLLGCTLFANKSATHIHVVFLEALHDLS

SEQ ID NO: 182091 - protein, 152 aa, Glycine max
  Coding DNA Sequence Number=SeqID_90406
  Homolog annotation: Hit_ID=Q1SN17; Match level="QueryCoverage=77%, HitCoverage=24%, E-value=2e-14, Identity=33%"; Hit description =Transposase, putative
MDEDQWMYESIMSEEADMDYQNDEACGANEAHVDCSDAFNTSQVFDSREDVLRWARSVAHETDLWWSDEYRRRKKEFIRRDIRTRKCGCPFKLRCKPVVRGEGWMVKLICGVHNHELTNSLVGHPYAERLTKAEKTVIADMTKSMVKPRTFY

SEQ ID NO: 182092 - protein, 244 aa, Glycine max
  Coding DNA Sequence Number=SeqID_90407
MSVASSFLLLGGAYLHGATWLFRYGNRIGLISEGYRGVRGAVSLVKYTTKGLGLPKLLSSVDCIHICCSSLPSSPTSSQPRSIICCNRLRPAQPTRLDDINYSPSMIGERVCFHVGPILLKRQPSDIYQMLDHVFKGQALFDGVARGFPMVCAGCVKVIPLWEKRLIDLLGRYHNHLVGDEGWQEVFVRHWDRGEFWSWPWGKVRHCVGNGAKVGVADRASRGWSRSFGSLPLDGRGRSRLYGC

SEQ ID NO: 182093 - protein, 50 aa, Glycine max
  Coding DNA Sequence Number=SeqID_90408
MPSKIILMMPKNQELSKFQRIKFQNSIKFQESRFKNNEDQDSRIKRRLNK

SEQ ID NO: 182094 - protein, 59 aa, Glycine max
  Coding DNA Sequence Number=SeqID_90409
  Subcellular localization annotation: CTP_CleavageSite=21; ConfidenceScore=5.35e-01
MKKDKGSSIRPSPRRAQCTLSAKTGTYAKQSALSAKTGTCAKRAERAKRNVRPSMAMRG

SEQ ID NO: 182095 - protein, 368 aa, Glycine max
  Coding DNA Sequence Number=SeqID_90410
  Gene Ontology: Mol. function=transporter activity; Cellular component= membrane; Biological process=transport
  Homolog annotation: Hit_ID=A6ECD9; Match level="QueryCoverage=60%, HitCoverage=28%, E-value=1e-83, Identity=66%"; Hit description=Outer membrane protein
  Pfam annotation: Domain name=Plug; Domain location=125-227; Score =39.0; E_value=1.7e-08; Accession=PF07715.6; Description=TonB -dependent Receptor Plug Domain
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQMGTETLSIKNIEKLPVLFGEKDVMKTIQLLPGIKSNGEGSSGFSVRGGATDQNLILLDEAPVYNASHLLGFFSTFNSDALKDASIIKGNSPAQYGGRLSSVMDVKMKDGNNKDYNINGGIGLISSRLSVEGPIQKEKSSFIVSGRRTYADLFLKGSEDFKDSKLYFYDLNLKANYQINDNNRLYLSGYFGRDVLGIGKTFATDWGNTTATLRWNSIISIHLPYPDTEQCFRNKCQQLSKKST

SEQ ID NO: 182096 - protein, 105 aa, Glycine max
  Coding DNA Sequence Number=SeqID_90411
MASRKRKSIGTRPTSQYGTRRFSSLDAWTRYTDNVLGRNILPERKVELYHIELDDFKVELERRNFHKCLTNLADGSIDLALVNEFYANLYSSEERPPKKSRVRVH

SEQ ID NO: 182097 - protein, 66 aa, Glycine max
  Coding DNA Sequence Number=SeqID_90412
MGFSRLNSRQYFKITSHKIKMITSILGREFLIELAKGLAKNLHDSGTLKRVAWGLDVGTKGVAEPR

SEQ ID NO: 182098 - protein, 225 aa, Glycine max
  Coding DNA Sequence Number=SeqID_90413
  Homolog annotation: Hit_ID=Q6WAY6; Match level="QueryCoverage=97%, HitCoverage=36%, E-value=4e-23, Identity=32%"; Hit description =Putative uncharacterized protein
LLIFKVILFPNVDGLVDLAAIDAFLAYHHSKESPVTAILVDLYDTFDRRCEKSDTRIVYCTPTLYVWLVSHLFRHESRPVCPMQGHYICAEKGEVNWEQLLASVVGASINWFPWWKKGGVGVLSSCKGFPNIPLMGMRGCINYNPVLAIRQLGYPMRGAPSEESIMPLIARGFSDHNARILQGVHKAWGAVQRKDKELRGSANGIIDDYHKWLKTQTQELDWIKS

SEQ ID NO: 182099 - protein, 194 aa, Glycine max
  Coding DNA Sequence Number=SeqID_90414
MTSGNPSDLRPFDPEIDRTFHGLVRHHFIPFEHPDHSVIGESEHSINFEHFDFEHPDFEHYNFEHFDFEHSENMAQPPPCERTLRKMAAPDFTYESLCIQYPDEDVPYVLKTGLIHLLPKFNGLAGLSNMEKSMIDAARGGALGDMTPAEARNLIKKMASNSQQFSARNDAIVIRGVHEVATNSSSSAETKKLE

SEQ ID NO: 182100 - protein, 113 aa, Glycine max
  Coding DNA Sequence Number=SeqID_90415
MSILTLGSKKKGERRKISNQRESKKKRKEVPNQRVGESKKKRKEIPNQIMGEGRKKKEEEEGKKAPDQGSKENRRNVQKGLWIGQYLSNTGLSPNEQKRRKGNHDLKWSSPFN

SEQ ID NO: 182101 - protein, 95 aa, Glycine max
  Coding DNA Sequence Number=SeqID_90416
MDQLSQRDGVGSVYGFLEPQAILNANDKRGQCQEYIEKWLKESNRDVYLGAYLNHAFKTLETKSEGKFGHSTLRWIEVKSHVQSGTYECGYYVMH

SEQ ID NO: 182102 - protein, 438 aa, Glycine max
  Coding DNA Sequence Number=SeqID_90417
  Gene Ontology: Mol. function=iron-sulfur cluster binding; Cellular component=extracellular space; Biological process=metabolic process
  Homolog annotation: Hit_ID=P0AEI3; Match level="QueryCoverage=100%, HitCoverage=92%, E-value=0.0, Identity=90%"; Hit description=UPF0004 protein yleA
  Pfam annotation: Domain name=Radical_SAM; Domain location=130-304; Score=125.9; E_value=1.2e-34; Accession=PF04055.12; Description =Radical SAM superfamily
  Pfam annotation: Domain name=TRAM; Domain location=357-419; Score =86.3; E_value=9.6e-23; Accession=PF01938.11; Description=TRAM domain
  Pfam annotation: Domain name=UPF0004; Domain location=1-83; Score =80.5; E_value=5.4e-21; Accession=PF00919.11; Description =Uncharacterized protein family UPF0004
  Pfam module annotation: Pfam domain module=Radical_SAM::TRAM::UPF0004; Domain location=130-304::357-419::1-83
MADLLNSTHGFEWTDNAEEADVLLLNTCSIREKAQEKVFAMLGRWRLLKEKNPSVIIRVRGCVASQEGELIRSRAPCVDVVFGPQNLHRLPEMINHVQGTRSPVVDISFPEIEKFDRLPEPRAEGPTAFVSIMEGCNKYCTYCVVPYTRGEEVSRPCDDILFEIAQLAAQGVREVNLLGQNVNAWRGENYDGTTGNFADLLRLVAAIDGIDRIRFTTSHPIEFTDDIIEVYRDTPELVSFLHLPVQAGSDRVLNLMGRTHTVLEYKAIIRKLREARPDIQISSDFIVGFPGETTEDFEKTMKLIAEVNFDVSYSFIFSARPGTPAADMVDDVPEADKKQRLYILQERINQQAMAWSRRMLGTTQRILVEGTSRKSLMELSGRTENNRVVNFEGTPDMVGKFVDVEIVDVYTNSLRGKIVRTEDEMGLRVVESPESVIA

SEQ ID NO: 182103 - protein, 317 aa, Glycine max
  Coding DNA Sequence Number=SeqID_90418
  Pfam annotation: Domain name=Transposase_23; Domain location=115-185; Score=-8.8; E_value=0.011; Accession=PF03017.5; Description=TNP1ENSPM transposase
EQATQGSFVPHGRQDVLAAAIGRPEHPGCVRAVGAGVTIKQYFGSAPWTSHSASSLPPDELQQLTQQIRDQLEESITKKVTRQGPPEPLVGPGPSGPWVSTKGSCVDPSGNDPETGDSDRCGLYIEADPARLVAMERVYEGSTLIHNTPLLPSQVKVSVDEVKDAHAAVPVPTAEVSLVGQTLHIFLALPTHLIKSLSNQVVVSSPKPPPKPDPEVDHPLYLMTIPELFLRPYQHEDLSEIAHGGQCLSISVLQLWILHLTETCMRAGNSDIYGFLEPQSIQRPDNYLKGIINSAIKGLDDAPQPKSKAHARWIVVK

SEQ ID NO: 182104 - protein, 171 aa, Glycine max
  Coding DNA Sequence Number=SeqID_90419
MTETVCTDNRLGISARHLTSRVRMIETVCTDNRLGISVRYLTSRVRMTETVCTDNRLGISVRHLTSRVRMTENAEDDVTIAEGGVVDKSEAFAPTYPSFVMTTLASACQSNLGSLNNEVRITGRCFRMLPESWVLIEKGGVVDKSEAFAPTYPPFVMRNSDLRSSFFCETK

SEQ ID NO: 182105 - protein, 311 aa, Glycine max
  Coding DNA Sequence Number=SeqID_90420
EELAACSRSKRSLAQHLEATEQSMLAIIGKYKEELNQSLTHEQKLVEDFAQAYAEKEARGRVIDALHQEAAMWMDRFALTLNGSQDLPRLLAKAKAIAEVKADLSALKDQMDNEEGVQEQMKADLSALKDQMASITEAMLKLQKTIEDNATAAASNTAREAEPVLQPAINLGRDRNTTVFGRRYSPQAYPYGLPLDFTPHTAPDNLSQAPTFEGQLPPYANYPLQEDDEGDAHLGPLLPLKDPAPHELPQPNIVRHVPSPPAPVKEFVPFAKDKGKIDLLEERLRAVEGLDNYPFLDLAELCLVPDIVIPP

SEQ ID NO: 182106 - protein, 133 aa, Glycine max
  Coding DNA Sequence Number=SeqID_90421
MMVAWVMLGYGYEPIIGRTKAKARGQDSKPKEAPPCHISRSFISAGLRREGQVAAICEDDSPRRLDLIRPCPPDPTTSPSKVLIPGTRPSILSKKRVGRGCGASPRAGEDNRSGRPRDEASSRRDRAHRLRNL

SEQ ID NO: 182107 - protein, 106 aa, Glycine max
  Coding DNA Sequence Number=SeqID_90422
MCLSGKGEGSTGFNKNRRKSLKVYQSHTLRGEKVASGQDFVGNQRERTTLGRGQGFTFSPWVKVYDKLGFWLKACRTGGHDICQGLASGSGIKGMSYIISMIHMQQ

SEQ ID NO: 182108 - protein, 73 aa, Glycine max
  Coding DNA Sequence Number=SeqID_90423
MRVCSLGGHMPFLFDLAREMAFLFELSNSSAALEFDSHRFQSAEHQQRFETIKGWSFHRERHVQLREDEYPDI

SEQ ID NO: 182109 - protein, 180 aa, Glycine max
  Coding DNA Sequence Number=SeqID_90424
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=94%, HitCoverage=45%, E-value=1e-42, Identity=52%"; Hit description=CTV.20
MEYNIMNTLQHMTMVATAYQTSHECSEETIIDILVAGFSEQLKAQHFIGDPSMWKDRSAELLSNLKCRTLADFRWYRDTFLTRVYTRENSQQPFWKEKFLVGLPRSLGDKVRDKIRSQSANGDIPYESLSYGQLISYVQKVVLKICQDDKIQRQLAKEKAQTKKDLGSFCKQFGLPACPK

SEQ ID NO: 182110 - protein, 79 aa, Glycine max
  Coding DNA Sequence Number=SeqID_90425
MGTNQNGKRFYQVKIKGLDVTSLKELGRLMGPLQRQAFRKVYGKILDLTAVEVFTEAIVSLAEYYDQPLRCFTFGDFQM

SEQ ID NO: 182111 - protein, 111 aa, Glycine max
  Coding DNA Sequence Number=SeqID_90426
MSNHKSTESALKNLEIQVGQLAKQLVEKSSNSFRENTEKNPKECKVVVTRSRKLVAAEDEDVVALKEQVPLKDTTVKKKNEETGNNYALWRSFAADATLLKVFERYVDKEA

SEQ ID NO: 182112 - protein, 96 aa, Glycine max
  Coding DNA Sequence Number=SeqID_90427
DAGSRQARQGASAGVGGCRGWLNYAASEQIVLRVHHMRAIGAGLFAITPAGERGMCCKAIKLGNARVFPVTTLIPVFFSIARDIKQRLADTDTKAE

SEQ ID NO: 182113 - protein, 25 aa, Glycine max
  Coding DNA Sequence Number=SeqID_90428
MDKEQFQSMNLLPQDGCSAGVLGVK

SEQ ID NO: 182114 - protein, 323 aa, Glycine max
  Coding DNA Sequence Number=SeqID_90429
  Homolog annotation: Hit_ID=Q2HVW1; Match level="QueryCoverage=29%, HitCoverage=39%, E-value=2e-08, Identity=34%"; Hit description =Putative uncharacterized protein
MSIDENGTSLFHMLEKWNPSLWTGYRLVCILCWGILLHTWDLENIKSISSAVGEVVELDDNAEELKRLDRARVLIKTPWHPTIQHAVAVTINGEEYMVHIVEETCYNPCRYSPMRVKLMAGYALSEGEFLTRAKTADAEGQQNGAGCEMQLSDGQYLLSGLVGITLGLLTRGPNHLRYRDESYGQSKIDKTVLGGKHRLTQQRQGGENFEIKGRGSRKYFDDEKGDNSLLGFAKHTCAEIKEGENNSLKSKLNGPTHIWKVYSRNKWCKKHIGHNKIDESNVGKLTKSNSNEQKQANSVSGKHDISPPVMRGSRLKEVSGWEE

SEQ ID NO: 182115 - protein, 50 aa, Glycine max
  Coding DNA Sequence Number=SeqID_90430
MTKKELTAAIPGVFDLGPPRLHNQDSWNHQVFQPQSWEMIEELNWKERKP

SEQ ID NO: 182116 - protein, 100 aa, Glycine max
  Coding DNA Sequence Number=SeqID_90431
  Homolog annotation: Hit_ID=A5AKL9; Match level="QueryCoverage=41%, HitCoverage=4%, E-value=2e-08, Identity=71%"; Hit description =Putative uncharacterized protein
MGINRAYDPCHDLGVPDFPHNIFFRLVFFVRSRIGVVNMTSKVEGDSGSLIPGVSGLQYRITKEAIGKFISFQCTPGLILKGWVEAHEWVVGGEIGIAIV

SEQ ID NO: 182117 - protein, 94 aa, Glycine max
  Coding DNA Sequence Number=SeqID_90432
MSQEVDMDYENEQECGVNQPHVDCSDVYNTLEVFGTRDDVLHRGRSSFVLIGYERSGQYKCRKKEFFRRDTESRKCGCSFKLRGKPETGGPVGW

SEQ ID NO: 182118 - protein, 60 aa, Glycine max
  Coding DNA Sequence Number=SeqID_90433
MLIELHVELVGLGSSSSMDSFASWKMNGSKMEKEDDWRRHFKEKISQEEAHHHRKPWIRA

SEQ ID NO: 182119 - protein, 42 aa, Glycine max
  Coding DNA Sequence Number=SeqID_90434
MKQLDEDNHSREQIQSRMQWWRRETPGTQGKGGHKTMSLQSQ

SEQ ID NO: 182120 - protein, 134 aa, Glycine max
  Coding DNA Sequence Number=SeqID_90435
MEMVVCGTDVDHLEAKKRHYILKCKIQPIWWDTLTWLHIKGAFPLSPKQHFLQHLGVQLDGVRMNRWQYWWLALTWSIWKLKNSIVFSNATFNANALFEEATFLLWSWLRGFEKGFTVHFNQWASSFTQSFLYQ

SEQ ID NO: 182121 - protein, 84 aa, Glycine max
  Coding DNA Sequence Number=SeqID_90436
  Homolog annotation: Hit_ID=A5BAF5; Match level="QueryCoverage=98%, HitCoverage=14%, E-value=2e-09, Identity=45%"; Hit description =Putative uncharacterized protein
MAEAHSISTPMVTNCKLSKHGADLFHDPTLYRSVVGALQYATLTRPEISYVVNKTFHIKSSYLSWLKLDILVVQEAESHGMVQH

SEQ ID NO: 182122 - protein, 311 aa, Glycine max
  Coding DNA Sequence Number=SeqID_90437
  Homolog annotation: Hit_ID=A5AD69; Match level="QueryCoverage=29%, HitCoverage=9%, E-value=8e-10, Identity=33%"; Hit description =Putative uncharacterized protein
  Subcellular localization annotation: CTP_CleavageSite=44; ConfidenceScore=5.12e-01
MASANNNSSPSPPMPPVSTPALCSPALFSHDVTAKLMDSNYLLWCSQVQPVIIGHDHENNIVSAAYRFWEQEDQFFLSWLQSTISEAVLPCIINCATSWHLWDQLHEHFQSIASAKKKQSHSDFLSLDDVTSMPLAEESSIEKSRKKNLGSLNLVEGSNSNSTSEAQVHLTQGNTHSSSNYDFVSEGGVMVAIRTVEVELVGEGVAEHGRFAHLLLQALLTNSQTNYQSNYPKQNPNSPYPYSPYPFYPYFPFMPPFGFPSPPQDHSPKPNCNSPPQVNVANASNTSSNSWYPDSGASHHVSQKYSASHSF

SEQ ID NO: 182123 - protein, 48 aa, Glycine max
  Coding DNA Sequence Number=SeqID_90438
MVLRATGGGVLGSTKNTIIANGERLNDYLEVRDELLHLGIRMNTCRDH

SEQ ID NO: 182124 - protein, 81 aa, Glycine max
  Coding DNA Sequence Number=SeqID_90439
MKKYDKGKGSLKINDDSLQIQKKGFLTIQIISSNEKFIFMENRVKAPVEAVETYCLKLNMEHHLDLLKTLYVAFLEKGWKD

SEQ ID NO: 182125 - protein, 111 aa, Glycine max
  Coding DNA Sequence Number=SeqID_90440
MTVTGFGSILGRINSLLKGNSSLALEGMDLFRFWRGSIAMPIGWTSQKSGADIEEEELTDLRSNPLQGEGDDAILPRKGPVTRAMSKRLQEDWARAVEEGPKVLMNLRVDF

SEQ ID NO: 182126 - protein, 139 aa, Glycine max
  Coding DNA Sequence Number=SeqID_90441
  Gene Ontology: Cellular component=integral to membrane
  Homolog annotation: Hit_ID=Q9FI10; Match level="QueryCoverage=43%, HitCoverage=30%, E-value=2e-12, Identity=55%"; Hit description =UPF0497 membrane protein At5g44550
  Pfam annotation: Domain name=DUF588; Domain location=41-116; Score= -9.1; E_value=0.018; Accession=PF04535.3; Description=Domain of unknown function (DUF588)
MVEVFEVAVDGAFDGGGTMWSTMVAWWWWFPSEKGRRRRKGREIRFDDVTLCLSRHYLIEMTMALASDGDGAATFMSELGKNGNSHAKWDKICDKFETYCDRGVVALIVSFVGFILLLIISVMSIIKLLKPNRINHASP

SEQ ID NO: 182127 - protein, 211 aa, Glycine max
  Coding DNA Sequence Number=SeqID_90442
MGVWEGDVWVWRWEWRREWFMWERDMVNRWSMMLNGVSLRRYSEDEWVRKLKIPPKAAFMIWRLLQNKLPTADNLGKRNVIHYGNGVSYDWVWKWLFNPILAHFLQHDFRDAYGMDRNAWSVILVYSLRELALQGNTWRESGISGGYEVDAWVRMLLQGAAKVLGVSLFVMIFEHIVICNMQLHDMCISIGRMGSVICKWLDDTYADLVHK

SEQ ID NO: 182128 - protein, 51 aa, Glycine max
  Coding DNA Sequence Number=SeqID_90443
MKSKGALSTKARAKREVRGPITRAMSKRLQKDWARAVEEGPMILMNLRVDL

SEQ ID NO: 182129 - protein, 271 aa, Glycine max
  Coding DNA Sequence Number=SeqID_90444
MDKRSWVRGQWIPYDTDAINQFLGHPLVLEEGQRCKYAERRSKFSGFDEEAICQLLFSTRHDFARSVAGRWVRIMCTSMTTLTQIWMTLLLSNIFPSDHNSDILLPKCQLVYSIMAQISVHVAQLISDVIHQFVGIASLRHLVDPENSNKALGFLALIASLCQFYVVSVALTKLIQPPINMSFIEKYCMPRQAQQSAADAPAPPPHQPPSLESILAHMQRMELQMHAYMQHLAYQQAANHRGQMQLNDSFYQYTLHQHREDPNPYPWPTLE

SEQ ID NO: 182130 - protein, 141 aa, Glycine max
  Coding DNA Sequence Number=SeqID_90445
MCLMYLGALHDVERCPIIEELLQGLISRDITTQIPQGFQPYVAKTPTPFPYKSDNAVPWRYDMQGSDGRQDASVMHVGTGMSAAKIMNIFSMSSMTHSGCVFAPPKLPARSKDKGKAKATMGKRQKMGLTANNEAYIGKFA

SEQ ID NO: 182131 - protein, 398 aa, Glycine max
  Coding DNA Sequence Number=SeqID_90446
MGSDQGSSFKKRFYHVKVKNLEVASLRKLGQQMGQVQRQAFSKDFQLAPTIEEFEGILGCPKGGRKPYLFLAGIPRKCLEKTKTLASQGEWVSFINILALLVFGTVLFPNVDGLVDLAAIDAFLAYHHSKESSVIAILADAHDTFNLRCEKSSARIVCCMTGVSISWFPRWKEGRAKVLCSCEGLPNVPLIGTRGFNEANTKMLQRIRKAWNKVERKDKELKGSSNGIIGDYYKWLKSRMKGMIWLQKIKGLNRKRLKCLRRMKRKECDELKDINMIADETLERETNELKLRKVERDKSRMESTMLEDKLKSYQRLKRSLIEQLSKMEENMLIIIGQYKEKVNLAANHGQMLEEEQAKVLALWIEREAREGVIELLHKEAMKLMDRFALTLNESQELP

SEQ ID NO: 182132 - protein, 159 aa, Glycine max
  Coding DNA Sequence Number=SeqID_90447
MDKRSWVRGQWIPYDTDAINQFLGHPLVLEEGQRCKYAERRSKFSGFDEEAICQLLFSTRHDFARSVAGRWVRIMCTSMTTLTQIWMTLLLSNIFPSDHNSDILLPKCQLVYSIMAQISVHVAQLISDVIHQFVGIASLRHLVDPENSIKALGFLALIA

SEQ ID NO: 182133 - protein, 110 aa, Glycine max
  Coding DNA Sequence Number=SeqID_90448
  Gene Ontology: Mol. function=transmembrane receptor activity; Cellular component=intrinsic to membrane; Biological process=innate immune response
  Homolog annotation: Hit_ID=Q19PP0; Match level="QueryCoverage=72%, HitCoverage=4%, E-value=1e-18, Identity=58%"; Hit description=TIR -NBS-LRR type disease resistance protein
  Subcellular localization annotation: CTP_CleavageSite=68; ConfidenceScore=5.09e-01
MANDRNKSDSNSSYSLHHSDHPGMGNEASLSAAPKANNVNFSSGLSAPKLIIDSGATNHITSPSLLVNSEENTSLPPVIMPNGDQAPIISTGNLPLSPIICLKNVPGVPS

SEQ ID NO: 182134 - protein, 102 aa, Glycine max
  Coding DNA Sequence Number=SeqID_90449
  Homolog annotation: Hit_ID=Q5XM22; Match level="QueryCoverage=74%, HitCoverage=57%, E-value=5e-23, Identity=59%"; Hit description =Resistance-like protein HAAS-2
CAYLLHLVGCTLFANKSATYVHVVHLDAFRDLTHSGGYAWGVAALVHMYDQLDEACRTPTRQLAGYLTLLQCWIYEHCLTIARGGLIADGTVRARQRRRTDH

SEQ ID NO: 182135 - protein, 150 aa, Glycine max
  Coding DNA Sequence Number=SeqID_90450
MNKQHHAWRCGPTRMRRPRQDSWGAVALEKRDHSRKCGRKGWRMCCHAPAKGAVWRIKGATHGGSYANMARWKMGDEQTGPPGQWITEKVTIADDDRKTFQERRKGSWQSGSKCGEYKDLSRTAGPRWAVLSGGRFSLLPQPGSDTMLRK

SEQ ID NO: 182136 - protein, 283 aa, Glycine max
  Coding DNA Sequence Number=SeqID_90451
  Gene Ontology: Mol. function=protein kinase activity; Biological process=protein amino acid phosphorylation
  Homolog annotation: Hit_ID=Q9C925; Match level="QueryCoverage=32%, HitCoverage=9%, E-value=3e-15, Identity=42%"; Hit description =Putative uncharacterized protein F14G24.23
  Pfam annotation: Domain name=DUF889; Domain location=1-133; Score= -82.8; E_value=7.4e-06; Accession=PF05970.5; Description=Eukaryotic protein of unknown function (DUF889)
MRLQANAQSVDNQETARFAKWILDIGDGVIGNENDEYATVEIPEYLLITEYNDPIDAIVRSTFPNLYQHHSNPEFFKCRAILASTNETVEEMKNPIIGPPLIIQFIAAFNNDKNIIQLPAFYHTQWAPQDPESVHLRYDGAIYEIQVRRHKERVYLANGLENFRKELKIYESTTINFFAYDHQCVFDIHFIPPLEWQTCGRQRYSSRKHMWTVWFTQEMLDAPEPLKLPLCTQVPLNACGHHMTVLRRFGPPLQWKVETLNPGIGGKCVVQPWQNDWDDSNTD

SEQ ID NO: 182137 - protein, 138 aa, Glycine max
  Coding DNA Sequence Number=SeqID_90452
MARVRDKIKSIDGSRETLKLSVRITDLWFIGILEKSEQAKMVIVDSDVLSCTLWENYCLQFLSYLNEVEDERPIIILLTHVRLKEGQGSYPPSVSNSLKVSKLMINELVLEIQEFRERLSDLGIKVRSVLMPIGQGSS

SEQ ID NO: 182138 - protein, 83 aa, Glycine max
  Coding DNA Sequence Number=SeqID_90453
  Gene Ontology: Mol. function=protein dimerization activity
  Homolog annotation: Hit_ID=A3B418; Match level="QueryCoverage=55%, HitCoverage=6%, E-value=1e-09, Identity=54%"; Hit description =Putative uncharacterized protein
MDPKAWWLIHGINAPILQKVALKLLAQPCSSSCCERNWNDFGSLDDCGILEIASLSLDEPELEGVFFNDDDHLGVKGLRLWNS

SEQ ID NO: 182139 - protein, 849 aa, Glycine max
  Coding DNA Sequence Number=SeqID_90454
  Gene Ontology: Mol. function=identical protein binding; Cellular component=cell wall; Biological process=negative regulation of catalytic activity
  Homolog annotation: Hit_ID=A7QC07; Match level="QueryCoverage=99%, HitCoverage=99%, E-value=0.0, Identity=71%"; Hit description =Chromosome chr10 scaffold_76, whole genome shotgun sequence
  Pfam annotation: Domain name=PA; Domain location=414-529; Score=39.7; E_value=1e-08; Accession=PF02225.13; Description=PA domain
  Pfam annotation: Domain name=Peptidase_S8; Domain location=166-665; Score=82.5; E_value=1.3e-21; Accession=PF00082.13; Description =Subtilase family
  Pfam annotation: Domain name=Subtilisin_N; Domain location=88-151; Score=41.0; E_value=4.3e-09; Accession=PF05922.7; Description =Subtilisin N-terminal Region
  Pfam module annotation: Pfam domain module=PA::Peptidase _S8::Subtilisin_N; Domain location=414-529::166-665::88-151
MGNIYVAHLVVVVVVFCFLPCLCQGDSDDATTSDVYVVTLRHAPVSHYYGGLRREVNGFKDAAAAPGRTQFNKPRRYGNITKTDKRYGSYISRVHDSLLKKVLNGEKYLKLYSYHYLINGFAVLVTQQQAEKLSRSSEVSNVVLDFSVRTATTHTPQFLGLPQGAWFQDGGFETAGEGVVIGFVDTGIDPTHPSFDDNKYEKPYPVPAHFSGICEVTRDFPSGSCNRKLVGARHFAASAITRGIFNSTQDYASPFDGDGHGTHTASVAAGNHGIPVIVAGHHFGNASGMAPRSHIAVYKALYKSFGGFAADVVAAIDQAAQDGVDIISLSITPNRRPPGVATFFNPIDMALLSAVKQGIFVVQAAGNTGPSPTSMFSFSPWIYTVGAASHDRVYSNSIFLGNNVTIPGVGLAPGTDESKLYKLIHAHHALSNDTTVADDMYVGECQDAYKFNKSLIKGNLLMCSYSIRFVLGLSTIKRASETAKNLSAAGVVFYMDPFVIGFQLNPVPMKMPGIIIASTNDSKVLTQYYNSSLEIDAVSKKIVKFGAVATICGGLKPNYSNVAPKVMYYSARGPDPEDSLPHEADILKPNLLAPGNFIWAAWSSVGTDSVEFLGENFALMSGTSMAAPHVAGLAALIRQKFPNFSPAAIGSALSTTASLYDKSGGPIMAQRSYASPDQNQPPATPFDMGSGFVNASGALNPGLVFDSGYDDYMSFLCGINGSAPVVLNYTGQNCALYNLTVYGPDLNLPSITISKLNQSRIVQRTVQNIAQNESYSVGWTAPNGVSVKVSPTHFCIGSGERQVLSVLLNATLSSSVASFGRIGLFGNQGHVVNIPLSVMVKISSNTTTS

SEQ ID NO: 182140 - protein, 211 aa, Glycine max
  Coding DNA Sequence Number=SeqID_90455
  Pfam annotation: Domain name=Transposase_23; Domain location=85-150; Score=-5.0; E_value=0.0042; Accession=PF03017.5; Description =TNP1ENSPM transposase
MQNSGVSLMTESQHFATVHDDNLNLTSMPYFGHQDVQTIAIGRPKHFGRVHAAGVARCSCRYNPKGSCCLLSLSCVDPSGQDPDMGESDKCGLYVDDNPPRLVALGRVYEESTTVHNVPLGNNQVKVVVEEVQDANAYILVHTQEDKQGAEGLAKPVDRSEPDDDPLYQMALTILQLFLKTLQVSWDATMFGVYNDNFPLYIKHEDLFTLF

SEQ ID NO: 182141 - protein, 102 aa, Glycine max
  Coding DNA Sequence Number=SeqID_90456
MLAIGNRLLPSGNRLPESKTLWLTAVLKVTTLCPCKGCNNRIHRALLKNKDIVSNLQNCSYEPQFVDPFVDANTDDSGVGSKEHMHQRIGRKSLTTIQIMRL

SEQ ID NO: 182142 - protein, 40 aa, Glycine max
  Coding DNA Sequence Number=SeqID_90457
MAEDEAKMVCLGKERARDRAEMERKRAQESSTSVFTKNQC

SEQ ID NO: 182143 - protein, 230 aa, Glycine max
  Coding DNA Sequence Number=SeqID_90458
MASRNENVPTVVYYDAYVADCDDGVEFKGENNAITITDDEDIDGMFDVYNRHQCLSGFQLLIQYEQQPSSTTNVETTIQSSQIHETPYTNYHTQTYHEGPSSYTSIPYMPQMIITSLILNPLNLIPILAYTHNCLLDRQTTSQSNEISHDYHAQNGLPDEVVGDFSDDKDEILLYNNNINDNDDNDIYFLFQPTSIENVYHPYPNSADVGDNQVADNPNYRHFFGPTTTI

SEQ ID NO: 182144 - protein, 192 aa, Glycine max
  Coding DNA Sequence Number=SeqID_90459
MPTQSTIHVLLSYRERMRGEKGGERGRGEYKNLNRVRNEHRDHTSYYFTNFPESHNEEDFWKTFMRWGKPRFSRPTTYGKIRTIESDKKKNWAEYNIELLQKILVGRLKKPKEIYNNNEILLMEGVCSLKMRYIGDNLVLLTAMDREDIVDVIKKPEEWLTDLFEIIGPWDVKATPANRLTWLRISGEQGVL

SEQ ID NO: 182145 - protein, 88 aa, Glycine max
  Coding DNA Sequence Number=SeqID_90460
MIFHSPPLQTPTQTLTPSSPPLMSIGGHHKSPLLAAEPPHQEERFNQSRILKIQFKDSMEKNPLNPFFHSFSEGAFIVPLKTLENETL

SEQ ID NO: 182146 - protein, 34 aa, Glycine max
  Coding DNA Sequence Number=SeqID_90461
MVKVVVTTMEEMVFKVVSKRWKSRAPEIGPCGLV

SEQ ID NO: 182147 - protein, 1135 aa, Glycine max
  Coding DNA Sequence Number=SeqID_90462
  Gene Ontology: Mol. function=metal ion binding; Cellular component =nucleus; Biological process=regulation of transcription, DNA -dependent
  Homolog annotation: Hit_ID=A7NVY3; Match level="QueryCoverage=99%, HitCoverage=99%, E-value=1e-179, Identity=55%"; Hit description =Chromosome chr5 scaffold_2, whole genome shotgun sequence
  Pfam annotation: Domain name=SBP; Domain location=147-225; Score =178.1; E_value=2.3e-50; Accession=PF03110.5; Description=SBP domain
MESQLEGKNQYLYGPVVPEMKSVGKRSLEWDLNDWKWDGDLFTARQLNSVPSDCRSRELFPTDPEILATGGASNSLSSAYDDANLGEGKRELEKRRRGVNDDGGVEMNDGAGSLNLNLGGQVYPIMEGEEKSGKKTKMTASTSSRAVCQVEDCRADLSNAKDYHRRHKVCDMHSKATQALVGNVMQRFCQQCSRFHVLQEFDEGKRSCRRRLAGHNKRRRKTLPDATVVNGGSLNEEKGSSYLLMSLLRILSNMHSNGSDNMRNQDVLSHLLRNLASLAGTINGRNIVSLLEGSQGLVKAGTSGAAQNVPNTNSDGPEPSRPFDSFIKMDDGLIHRDPPESMVQRETTPANDMAKKCIASGSDGVGSLKSPSVPQSSNVLLSRDGLPPQSVAAQTTVGRIGLSNIDLNNVYDDVQDYVENTRNSCPPLPSGNGSLDHPLWIQCDSLKSSPPQTSRNSDSTSTQSPSSSSGEAQSRTDRIVFKLFGKAPNDFPHALRSQILNWLSHSPTEIESYIRPGCIILTIYLRLENSAWEELCYNLESSLRKLAAPNDSFWRTGWIYTRVQHSVAFLYNGQVVLDAPLRLKSPQNCQILCVKPLAVSASSSAQFVVKGFNFLLSNTRNKYIFNNKEFRGETVLDNAMFVIWSWLKALEKGFNVPFQGEEREGGIGRGFESSRSSLCEGMGEGCCTQPYPCICKEAVSGFEPMTNKSPRHNFTAAPGFALKNLLCEGKYLVQDSCYDLIDSADAVNGHQELQHLSFSCHVPNVTGRGFIEVVEDNGLSSCSFPFIVAEQEICLEICTLDNVIEAAEMADDNQIKTNLMEEKTQALYFIQEMGWLLHRSRVKVRLGPMAPVQDRFHFNRFIWLVGFSMDHDWCAVMKKLLNIIFEGTVDTGDHASVELALLEMGLLHKAVKRNCRPMVEILLKFVPVKASDGGDSNEKQVNKSPDRFIFRPDTVGPVGLTPLHVAASMHGSENVLDALTDDPGMVGTEAWKSAQDATGLTPYDYASMRGYYSYIQLVQSKTSNTCKSQHVLDIPGTLVDSNTKQKQSDRHRSSKVSSLQTEKIETTAMPRRCGLCQQKLAYGGMRRALVYRPAMLSMVAIAAVCVCVALLFKSSPKVYYVFQPFSWESLEYGSI

SEQ ID NO: 182148 - protein, 104 aa, Glycine max
  Coding DNA Sequence Number=SeqID_90463
  Homolog annotation: Hit_ID=Q6L3S2; Match level="QueryCoverage=45%, HitCoverage=2%, E-value=2e-08, Identity=57%"; Hit description =Putative retrotransposon protein, identical
  Pfam annotation: Domain name=Chromo; Domain location=2-50; Score=8.1; E_value=0.058; Accession=PF00385.15; Description='chromo' (CHRromatin Organisation MOdi
MAIMDKRVKRLCPKDVVSVKVAWRGPAGEEMTWELETIMREKYPHLFETQVTHPSLKPYLIFPQNFISQSFSHLLPLFRKAFASLGLSKYKKVTGEKAEHYSFP

SEQ ID NO: 182149 - protein, 152 aa, Glycine max
  Coding DNA Sequence Number=SeqID_90464
  Gene Ontology: Mol. function=RNA-directed DNA polymerase activity; Biological process=RNA-dependent DNA replication
  Homolog annotation: Hit_ID=Q0KIP8; Match level="QueryCoverage=47%, HitCoverage=7%, E-value=4e-10, Identity=41%"; Hit description =Putative uncharacterized protein
MAEVPLSAFTKLNPPTFRGSNIHEDPQTFVDEVLWICPGLGCSPTWMVQFAAFRLRDVTRGWYETMLLARLAGSPPLAWDECSASGKCTGSHKTLELDQFPLLNDPNKACIYVIKDLTITNKLISSSQTGSCFKLWSLQIFTQQNLSKLSRT

SEQ ID NO: 182150 - protein, 38 aa, Glycine max
  Coding DNA Sequence Number=SeqID_90465
MALTRPCCGAVGGKWRTQDEAHEILRGKWWVYLKVILN

SEQ ID NO: 182151 - protein, 295 aa, Glycine max
  Coding DNA Sequence Number=SeqID_90466
  Gene Ontology: Cellular component=endoplasmic reticulum
  Homolog annotation: Hit_ID=A7QKI5; Match level="QueryCoverage=88%, HitCoverage=34%, E-value=1e-112, Identity=75%"; Hit description =Chromosome chr2 scaffold_112, whole genome shotgun sequence
MALRSAITLIIIFILSSFHVVGIQIISKSKLEKCEKNSNSEDNLNCTTKIVLNMAVPSGSSGGEASIVAELVEVEENSSRKMQTLRIPPVITVNKTSAYALYQLTYIRDVPYKPEEYYVKTRKCEPDAGANVVKICERQAILRDEEGHIIEYTQPICCPCGPQRRMPSSCGNFCKCFDVATFFDKLTKGKANTAHCVRFPGDWFHVFGIGRRTLGFSVRIQVKSGTKVSEVFVGPENRTVISDDKFLRVNLIGDFVGYTNIPSFEDFYLVVPRQLGGQPWATTGFGEKHFYVDAA

SEQ ID NO: 182152 - protein, 189 aa, Glycine max
  Coding DNA Sequence Number=SeqID_90467
  Gene Ontology: Mol. function=metalloendopeptidase activity; Biological process=proteolysis
  Homolog annotation: Hit_ID=A7NY13; Match level="QueryCoverage=46%, HitCoverage=8%, E-value=3e-29, Identity=63%"; Hit description =Chromosome chr6 scaffold_3, whole genome shotgun sequence
MAKLLEKDPPLTYESNKLWNQIVEKRYIFDLSKKEAEELKNISKHDVVEWYKTYLKSSSPKCQQLLIRLWGCNTDLKEVEALPKSVQLERYHWRVRRDEIAREDGQRLGVIEKRVEIDGQVKFPPDSVAEIPGANSDYYETFFGQFQNQGPLGDLEWVRVVLIVDLRVRLEDIQDQAPHRRNEHRCVGE

SEQ ID NO: 182153 - protein, 218 aa, Glycine max
  Coding DNA Sequence Number=SeqID_90468
  Gene Ontology: Mol. function=oxidoreductase activity; Biological process=electron transport
  Homolog annotation: Hit_ID=A7PGD2; Match level="QueryCoverage=54%, HitCoverage=36%, E-value=4e-38, Identity=59%"; Hit description =Chromosome chr6 scaffold_15, whole genome shotgun sequence
MIFNKHDIRVCYYKHCNEIITNAYEKWDTLYMCTGFNKKSPYPLVVLQTEKSLVFNRIVMNLIWQKQNWMTVFVSLLYQLFASNVDEIGVWSLQGGPTGVELAGARLLEFVGAKAGDNTLNWLKSKNVVVKLEQSVDLNAFTDGQKIYQTSNGETIEADCHFLCVGKPLASAWLKETVLKNDLDGQRRIKVDERLRVKGWNNIFAIGDVTDIPVSACH

SEQ ID NO: 182154 - protein, 481 aa, Glycine max
  Coding DNA Sequence Number=SeqID_90469
  Gene Ontology: Mol. function=nucleotide binding; Cellular component =myosin complex; Biological process=striated muscle contraction
  Homolog annotation: Hit_ID=A5C9E2; Match level="QueryCoverage=75%, HitCoverage=54%, E-value=1e-69, Identity=41%"; Hit description =Putative uncharacterized protein
  Pfam annotation: Domain name=DUF827; Domain location=120-451; Score= -117.0; E_value=0.1; Accession=PF05701.2; Description=Plant protein of unknown function (DUF827)
MELIYLLRDWVQRHWRKLKDLNILAIDLEKIYDRESCGRHGRIGEFVLLTFRPYVANDMYDEDLSKEPVQNLVSALAGLQRRVDKADAIVEQLGTNDIVWYKETKWAAECAKAQAEAELSNAKQTVKDLFSMIGESMYKAKAEMRDMAPLKKYVKPRNDDNQYSQVMTELEHAKREFFQLKLHVGSVLEEKLQAENEVKASRSSMLSFSRVAQKLTNEIEEASEEQLVVQLDRMDALNELRDIEQLQNTRNKLKEAIQAIDETKELEMKLATTLSDIDMLKNEFKFVKKTGKRLLQRGVLEPTKEEIEAAKKDLASITKQVFKFMASMDVTRNQLKHVSAATINLKNKESKIGAKVRNLSYKLLRAKSKLEVVSAAEEKAKSIVSNLTQTLDKLKSKTEAAKKEKDLIINGEVAETKEEIIKALLEIKLQAVKSSEALALEKLKILRENAMKDKISNFRDCIKRLDKFQGMLPTEWQTLCF

SEQ ID NO: 182155 - protein, 175 aa, Glycine max
  Coding DNA Sequence Number=SeqID_90470
  Gene Ontology: Mol. function=metalloendopeptidase activity; Cellular component=membrane; Biological process=cell adhesion
  Homolog annotation: Hit_ID=A3AMD6; Match level="QueryCoverage=34%, HitCoverage=8%, E-value=9e-23, Identity=85%"; Hit description =Putative uncharacterized protein
MALDRRVIVGAAEALQKAQLQKYDAAIHFCEQSQHLAETNFVLANNTANSDSSLCDSYSSVKLWRLEASLNVLEKLQQVVSVTDKLADISFYNTGTSKGQGSHWEKRLLMNEIMTGSVDTRSVVSKMTLGILEDSGWYKVNCSMADHLDWGRNQGKYIYEVFMLFPGVEALYEVL

SEQ ID NO: 182156 - protein, 74 aa, Glycine max
  Coding DNA Sequence Number=SeqID_90471
  Gene Ontology: Mol. function=aspartic-type endopeptidase activity; Biological process=DNA integration
  Homolog annotation: Hit_ID=A5BBA3; Match level="QueryCoverage=98%, HitCoverage=10%, E-value=2e-25, Identity=67%"; Hit description =Putative uncharacterized protein
MEFKAEILRVFEMTDLGLVSFFLVSMLSRFMHCASEVHLQAVKRIVRYVKGTIDYGVKYTYSQNFQFHGYSDND

SEQ ID NO: 182157 - protein, 98 aa, Glycine max
  Coding DNA Sequence Number=SeqID_90472
  Homolog annotation: Hit_ID=A5C0G0; Match level="QueryCoverage=68%, HitCoverage=10%, E-value=2e-10, Identity=41%"; Hit description =Putative uncharacterized protein
MASLVEDKMKSLAMVEEEEDGFVFCTQAMKAHMAAIWKPWEGVTIKDVERVNFLFQFFPKLDMQSITNGVPWYFDNQLLILDKLKPNDVPDQVKLGIL

SEQ ID NO: 182158 - protein, 87 aa, Glycine max
  Coding DNA Sequence Number=SeqID_90473
MAEQTKQVFYVQDPCDERWPVVLYRKIIGVNLKDDDSTLDSRHTPFSTHMPNTNEEEVDDVHANHNDHDEGELINIARGYTTELPSS

SEQ ID NO: 182159 - protein, 124 aa, Glycine max
  Coding DNA Sequence Number=SeqID_90474
  Gene Ontology: Mol. function=DNA binding; Cellular component=nucleus; Biological process=regulation of transcription, DNA-dependent
  Homolog annotation: Hit_ID=A2Q532; Match level="QueryCoverage=45%, HitCoverage=8%, E-value=1e-19, Identity=80%"; Hit description =Transcriptional factor B3; Auxin response factor
MGGGGGHSLREGEIVADGEEEDTGAMVKSTTPHMFCKTLTTSNTSTHGGFLVPYRAAEDCFPPLYVSCGLENLRRLLAEPSYLKHWSFSQFVHACNGRVLDWHIASAVELLPKQLLPCLFAWPY

SEQ ID NO: 182160 - protein, 206 aa, Glycine max
  Coding DNA Sequence Number=SeqID_90475
FTDAGIGVAEDLDLDLEALVVAGDGSIDLAEHGKGVAKLHVAREGSEGVIGIAFDVEDFNSAFEDGDDYFKASEAAVDGSEDVEAHGEVEAGLSLDGATLEGLGDPDGQVKGLGGPIARGNGVAGQLKEEWAEIRVVERGIREKHRGFWSFLLRGARRRWGGWFFGIGWVCPGRRFGGVGSSIRDLAMEGVGLEIRVEGSYRQWGG

SEQ ID NO: 182161 - protein, 119 aa, Glycine max
  Coding DNA Sequence Number=SeqID_90476
  Gene Ontology: Mol. function=hydrolase activity
  Homolog annotation: Hit_ID=O65755; Match level="QueryCoverage=99%, HitCoverage=80%, E-value=1e-21, Identity=46%"; Hit description =Putative deoxycytidylate deaminase
MAIEEEYKGIEFCNDEVVACCHNIVLRNTDPTAHAEVTAIRKQLNVYVQIAILYSCTVMRGWFMERRQRQQLLLDSMTMISDALRGTGFYQKAQLEIKRVDRCIAEELFQKTKEKFRMF

SEQ ID NO: 182162 - protein, 50 aa, Glycine max
  Coding DNA Sequence Number=SeqID_90477
MKLDIPSSLNDFEHTSIMVRTRGLGRALGHVTGRGVGRGDHDDSDDAPQC

SEQ ID NO: 182163 - protein, 76 aa, Glycine max
  Coding DNA Sequence Number=SeqID_90478
MVAVVQTYTVLGYKCEVSLCGGSWSTGVPLESPQQLVSEPMVQVGDRLRRVCKYRRWPEWLAAQRAPQVERGGQNG

SEQ ID NO: 182164 - protein, 219 aa, Glycine max
  Coding DNA Sequence Number=SeqID_90479
MGSFLTQIKGILFYTDANGAVVDTAAKSSTYLIIVRFQVLPKPVPYEKYNFHSYSLQTPTQTLTPSSPPPTTTSGHHKPPLLAIGPLHREECFNWIRILRIYLKDSIEKQALNPFFHSFSEGYLTLIVDINLVFHEGKYLYLGACHSVWNSLMTRADHQGRGGGGMGGVSYARQGDLNTCYLVFLSMSVVWTRSGYFLTSGTTLHLRVEVRCMYHTEHD

SEQ ID NO: 182165 - protein, 116 aa, Glycine max
  Coding DNA Sequence Number=SeqID_90480
  Homolog annotation: Hit_ID=A2Q186; Match level="QueryCoverage=62%, HitCoverage=18%, E-value=5e-09, Identity=34%"; Hit description =Reverse transcriptase-beet retrotransposon, putative
MNANRNRNSIRGVFIDGSWTDDPHKVKEEVKSFFFHRFQEPIGQQPKIDGIRFQTVNLQQNNELLAPFMDEEIQKAIFKAATKFFMKEGNSQKDCMDLMEIDMLTKRKGWLGHQGY

SEQ ID NO: 182166 - protein, 273 aa, Glycine max
  Coding DNA Sequence Number=SeqID_90481
  Subcellular localization annotation: CTP_CleavageSite=4; ConfidenceScore=5.09e-01
MTARNSPKSSNHHIFLISLPNRFKQSSIFILFNSLQNPPIKISLNNFQWQNHQRKEKDLPPPPLSPWNLRRPTSTSSSHSFISQSSTLFSFDDQHQSQGVPFEGTLVDDCKFDYSSHDTRKMVCNDHADMTYRSLTGSFTFDCRIMHFIIVCILLPRSTNPAQASEEDFILLWALQTGRQIDWAHLVWYRMHKALRANAPLPYPHLITLFLHHFNVPLDDEPFVKVKRDLDGQWVHKQDLPLPIPDERTSSPPPQRDISSSLLTEVLTELHDL

SEQ ID NO: 182167 - protein, 236 aa, Glycine max
  Coding DNA Sequence Number=SeqID_90482
  Homolog annotation: Hit_ID=Q6WAY4; Match level="QueryCoverage=91%, HitCoverage=38%, E-value=3e-24, Identity=35%"; Hit description =Putative uncharacterized protein
MGTNQNRKIFYQVKIKGLDVTSLKELGQLMGPLQRQAFRKVYGKILDLTTTEVFTEVVVSLAQYYDQPLRCFTFGYFQIVSTVEEFEEILGCPLGGRKPYLFSGFLPSLSKIAAVVGDSARELDRMKQTRNGVVGLPRKYLEGKARDMASQEEWIPFANILALLIFGVVLFPNVDGLVDLAAIDAFLAYHHSKESPVVAILADLFDTFERRCEKNSARIICCLPALCVWLVSHLFQ

SEQ ID NO: 182168 - protein, 120 aa, Glycine max
  Coding DNA Sequence Number=SeqID_90483
MEWFYMISHPFITLAQPGDTPSVPPVQQYDTFVEPDVHQQLVAAVAPDEADVNVHRPGHAVVIYFFAIADKLERLLNLRILTKGTEAYTVAKECLSIARSYIGQSTIGHRSRHRRRTDDR

SEQ ID NO: 182169 - protein, 279 aa, Glycine max
  Coding DNA Sequence Number=SeqID_90484
  Homolog annotation: Hit_ID=A5BUF0; Match level="QueryCoverage=69%, HitCoverage=52%, E-value=7e-07, Identity=25%"; Hit description =Putative uncharacterized protein
DIIDPKYLDSEFFEGENFDCYQVFQNSELVDFMTKKLPYYPELVRVFYNKLEIHEGVIFSEVNKIPIVVDQSLFYSLTKLSNQGVPFEGTLVDDWKPIYSSLDACKMVYVANADTSGHLLVGSFTFECCIMHYILYCVLLPRSTNLAQATKEDLILMWALQTGCQIDWAHLVHYRMHKALRVNAPLPYPHLITLFLKHFKVPLTNEPSIKDYQANSPYKRTPSPPPRDPSSALLNNVLNEIRDLHAFFGERFDSMDSRITHLEDDMGFICCCFDPPTDP

SEQ ID NO: 182170 - protein, 216 aa, Glycine max
  Coding DNA Sequence Number=SeqID_90485
MAHWQLVVLCPMKDVVIWFSSLRKKADIHIKDAVNNAMKTLKSSLDGHIDKVAMQWIEIKSHVQTGGYECGYFVMHWMWNIVREGLKNDWSMWLGDGTPLDIKNTTTIPKPLDNALLSQLVGHCVVEDVDSADDSPIDINKYEVPQLHSFVSYTSVLNRNMVAKLHHDLIFVVEGFPDAGFALMEWDKFHFGTCWCSEYLKGSLIVEHNVPFRRNI

SEQ ID NO: 182171 - protein, 63 aa, Glycine max
  Coding DNA Sequence Number=SeqID_90486
MENSVLKKIRQLKQSLMQVHIPCEDMRKFDDRIPERDMTIFRVLLGVLELLLSTTKISHGMTM

SEQ ID NO: 182172 - protein, 69 aa, Glycine max
  Coding DNA Sequence Number=SeqID_90487
MWVSRERFPADFRQEDDKEKREGKKVVRNKRRRIVIVGATTAEDGMELVAEVGDVGGQGKRKRKRLKGL

SEQ ID NO: 182173 - protein, 167 aa, Glycine max
  Coding DNA Sequence Number=SeqID_90488
MRLERRKVQLMIEEPIRLIILFQRNDRRLMKQDPDQGTPWPLPSRILPPSPPPIALVEPDVNTCNKVLKKKGELGNHIFHPEMQKKELDKLNFTKLWMDGFPGIDPFHYPVWDTLPEEEEDSCRNYGGQELVLEEFPDAYPFEMPFSTPPDLQQLLGLIHALNVVLP

SEQ ID NO: 182174 - protein, 192 aa, Glycine max
  Coding DNA Sequence Number=SeqID_90489
  Gene Ontology: Mol. function=protein dimerization activity; Cellular component=nucleus; Biological process=regulation of transcription, DNA-dependent
  Homolog annotation: Hit_ID=A7PPE8; Match level="QueryCoverage=92%, HitCoverage=63%, E-value=7e-26, Identity=35%"; Hit description =Chromosome chr8 scaffold_23, whole genome shotgun sequence
MDEFLSSIWNSDDNNQVNPPLPTLDEAAKGKSVVATKSTTISQPLSIPPPICKKIMDEIWSQIHKSQPHYNEANNSLVRNEPLLKRQQTLGEMTLEDFLVKAGVVQESSSLFKSSLLYQNQIGNIAIIKDVTTNGTVGKCPSLGESSGKGNRKRIIDGPPKVVVERRQRRMLKNRESATHYIVFKDWLERQL

SEQ ID NO: 182175 - protein, 611 aa, Glycine max
  Coding DNA Sequence Number=SeqID_90490
  Gene Ontology: Mol. function=protein kinase activity; Cellular component=nucleus; Biological process=protein amino acid phosphorylation
  Homolog annotation: Hit_ID=A7PXE6; Match level="QueryCoverage=90%, HitCoverage=87%, E-value=0.0, Identity=58%"; Hit description =Chromosome chr12 scaffold_36, whole genome shotgun sequence
  Pfam annotation: Domain name=PPR; Domain location=121-155; Score =24.5; E_value=0.0004; Accession=PF01535.11; Description=PPR repeat
  Pfam annotation: Domain name=PPR; Domain location=223-257; Score =25.1; E_value=0.00027; Accession=PF01535.11; Description=PPR repeat
  Pfam annotation: Domain name=PPR; Domain location=260-294; Score =16.8; E_value=0.079; Accession=PF01535.11; Description=PPR repeat
  Pfam annotation: Domain name=PPR; Domain location=326-360; Score=8.0; E_value=0.87; Accession=PF01535.11; Description=PPR repeat
  Pfam annotation: Domain name=PPR; Domain location=424-458; Score =54.3; E_value=4.3e-13; Accession=PF01535.11; Description=PPR repeat
  Pfam annotation: Domain name=PPR; Domain location=459-493; Score=9.3; E_value=0.61; Accession=PF01535.11; Description=PPR repeat
  Pfam annotation: Domain name=PPR; Domain location=495-529; Score =11.3; E_value=0.36; Accession=PF01535.11; Description=PPR repeat
  Pfam annotation: Domain name=PPR; Domain location=54-88; Score=0.7; E_ value=6.4; Accession=PF01535.11; Description=PPR repeat
  Pfam annotation: Domain name=PPR; Domain location=561-595; Score =11.2; E_value=0.37; Accession=PF01535.11; Description=PPR repeat
  Pfam module annotation: Pfam domain module=PPR::PPR::PPR::PPR::PPR::PP R::PPR::PPR::PPR; Domain location=121-155::223-257::260-294::326 -360::424-458::459-493::495-529::54-88::561-595
MKSLHLKSRFSIFTSTVVPSRTESQILHHCKLGALPKALILLKAQAQAQALKPVVYASLLQACRKAHSFPLGTHLHAHVLKSGFLADRFVANSLLSLYSKLSPHFSQARALFDALPFKDVIAWTSIISGHVQKAQPKTAVHLFLQMLGQAIEPNAFTLSSILKACSQLENLHLGKTLHAVVFIRGFHSNNNVVACALIDMYGRSRVVDDARKVFDELPEPDYVCWTAVISTLARNDRFREAVRVFFAMHDGGLGLEVDGFTFGTLLNACGNLGWLRMGREVHGKVVTLGMKGNVFVESSLLDMYGKCGEVGCARVVFDGLEEKNEVALTAMLGVYCHNGECGSVLGLVREWRSMVDVYSFGTIIRACSGLAAVRQGNEVHCQYVRRGGWRDVVVESALVDLYAKCGSVDFAYRLFSRMEARNLITWNAMIGGFAQNGRGQEGVELFEEMVKEGVRPDWISFVNVLFACSHNGLVDQGRRYFDLMRREYGIRPGVVHYTCMIDILGRAELIEEAESLLESADCRYDHSRWAVLLGACTKCSDYVTAERIAKKMIQLEPDFHLSYVLLGNIYRAVGKWNEALEIRKLMEERGVKKVPGKSWIESEKQKGSPGF

SEQ ID NO: 182176 - protein, 68 aa, Glycine max
  Coding DNA Sequence Number=SeqID_90491
MICKVLELQEVRIDRPVLVEKLRYLENPRRRVGPVEARDVELHPGGGKGEGTDKGSGFEGVKAGENIV

SEQ ID NO: 182177 - protein, 66 aa, Glycine max
  Coding DNA Sequence Number=SeqID_90492
MLSILQDNNNNSQFIIEGASITMPLGFIGEDYPYWIDRIEMYIKSMQYRLWFIIVNDDIPILRPEA

SEQ ID NO: 182178 - protein, 214 aa, Glycine max
  Coding DNA Sequence Number=SeqID_90493
MIPTINNVEDVKRVFLEDCLEDEGVLIKDLFLSCWLDAISREVQFLTLRPLCFFLGNCEDEKTLGEQAQARLKTKLSYETKPSQPRSQLTTKRKDPPSPTFDLKPSNPVKKPPPSDPKPSDPRIAQKGKAIDSQSEPKYQPPPKRATIKIKHLQPQSHPTPISRHIQQESNSGILVTSPSKRTSPPKAQESYVEIRDTRTPQASPFLTVPPHNS

SEQ ID NO: 182179 - protein, 97 aa, Glycine max
  Coding DNA Sequence Number=SeqID_90494
  Gene Ontology: Mol. function=RNA-directed DNA polymerase activity; Biological process=RNA-dependent DNA replication
  Homolog annotation: Hit_ID=Q6VPE8; Match level="QueryCoverage=67%, HitCoverage=7%, E-value=2e-09, Identity=43%"; Hit description =Putative gag-pol polyprotein
MENQLNHNTGRHYGGNRVGNVGPRQHRIEGQNKIDGVKLNVPPFKGRSDPDVYLDWEMKVEHVFSCNDYTEEQKRDDEIEGVGDRYMDRDEKGDAKA

SEQ ID NO: 182180 - protein, 92 aa, Glycine max
  Coding DNA Sequence Number=SeqID_90495
MARSRTKQSVDTLQQMVADILNKAQVEKDKGPERNFWHLIEFGESFSLGSLLNQSQTYQDIPCGVYPDLSSFTGSGVYPDLSSFTRSDVYPD

SEQ ID NO: 182181 - protein, 279 aa, Glycine max
  Coding DNA Sequence Number=SeqID_90496
MAKCQWELRLWRLLGGVCKMSAIYWHSLHLFVKSRRLLDDSLKVPSLLGVGLLREKVCSGVALPGYVVNLKAFEVVNESFGNVSDIVRTFKDDFDSSSLYVGCTVNVKAPPGSYWISNSKSSTNHSTILPCHLLYHLVAFISVMEYATGEVDEKGTPSLIRLRTRGVTMVFLKAKKACSQASSHRNGSTFLSSLTIHLQYGYAFFGVGFYSPMCDHKAQELAFADPESTFFRVKEHIVFADFFKHFFKVCHVLGYAMEFDDHVVDVDLDISSNLLFENL

SEQ ID NO: 182182 - protein, 207 aa, Glycine max
  Coding DNA Sequence Number=SeqID_90497
MHLLPQFLYFSCVTKQITRIAVNKSGLKPDLTIQYTSSKDSLGHPFPAYVEIIMFQTTSSSSDIFSNNILASSRLPNFAYIDNSVVFTISSSHKLLRIITTWSDENPKTVQIQGPMTRSRTKQSVNTLQQMISAILNKAQRSNIEEEVVKIFVWNWKSGDVGDFGNVKEMKQMVVNVQHVWLNLTTSYISFLIVDLENLRKEYCTVK

SEQ ID NO: 182183 - protein, 189 aa, Glycine max
  Coding DNA Sequence Number=SeqID_90498
MKSKRWPESKKKLPSSEHQEVLIQKFNHEPFNPMTLYGESETKLEKIPEQESLDLTVKDHLGVLSLSQALNARHRLSRNNTLSTSRIIQERRLIQERVPLSSSYVLSARRTAILAKHNKRAQCKGCVKTKLICTYKRGREKKEKTQKIQESTIPYRRQRLEEGETIIKSHSFPSFPFLSIPPLLNILFL

SEQ ID NO: 182184 - protein, 112 aa, Glycine max
  Coding DNA Sequence Number=SeqID_90499
MYCTPSLVHQIFGQIGESVNATSHEWMTNLFSVDLNTPNSTTSYLTSLQQFDAPHSFGEQGQSSLAAATHIEYTDIEQQHHHDVGEPVIHERRNSRCNRRPPPCGIGHRLGH

SEQ ID NO: 182185 - protein, 666 aa, Glycine max
  Coding DNA Sequence Number=SeqID_90500
  Gene Ontology: Mol. function=cation:chloride symporter activity; Cellular component=integral to membrane; Biological process=sodium ion transport
  Homolog annotation: Hit_ID=A4VCJ8; Match level="QueryCoverage=81%, HitCoverage=52%, E-value=0.0, Identity=82%"; Hit description=Cation chloride cotransporter
MGAALQSLTGAPRLLAAIANDDILPILNYFKVGDASEPHVATFFTAFLCIGCVVIGNLDLITPTVTMFFLLCYTGVNLSCFLLDLLDAPSWRPRWKFHHWSLSLVGALLCIGAVVAAAIAVMWRDCGPRCVIMFLISWSFTVVSLLLASLIYKYVSIQGKAGDWGDGFKSAYFQLALRSLRSLGASQVHPKNWYPIPLVFCRPWGKLPENVPCHPKLADFANCMKKKGRGMSIFVSILDGDYHECAEDAKTACKQLSTYIDYKNCEGVAEIVVAPNMSEGFRGIIQTMGLGNLKPNIVVMRYPEIWRRENLIEIPATFVGIINDCIVANKAVVIVKGLDEWPNEYQRQYGTIDLYWIVRDGGLMLLLSQLLLTKESFENCKIQVFCIAEDDADAEGLKADVKKFLYDLRMQAEVFVITMKWDAQMDGGGGSPAQDESMDAFTSAQQRIDNYLTQMKATAEREGTPLMADGKPVVVNEKQVEKFLYTTLKLNSTILRYSRMAAVVLVSLPPPPVSHPAYFYMEYMDLLLEKIPRILIVRGYQRVPAITVCRHLWPPSATADRRTPAAGISPEFFFGVKMATFVELWFLGQGYHDHLEKNVNAVPNDKKPEWEKAQEIFANDFQRLFDAIVKVTALKQSNHDMIAHMGKAQAAVEELRRFFVADSLEE

SEQ ID NO: 182186 - protein, 753 aa, Glycine max
  Coding DNA Sequence Number=SeqID_90501
  Pfam annotation: Domain name=RRM_1; Domain location=71-141; Score =35.7; E_value=1.7e-07; Accession=PF00076.13; Description=RNA recognition motif. (a.k.a. RRM, RB
MENMDFLTQNTSNHKEKVSFSVVRRIPDLPIQFFSGRGRQREREAVRKDPRTSYTDTRIGNWRDKADITTFYFTRFTEHTTEQELWSHFKKWGDVREIFIPKHRNKRGRRYGFVRFKGVSDERKLESQLDNIVVGGLKMHVNAPKYGRRRITSEEHTAKTRTQMDGQNTQMAAARYTATHYRNLPMSYAKAVSNTKMADGHKRRLQPPQSSFDESQSSLHLKVPTTERKWYTGAWVGRLKKLGALERIEEDLPWELGIDVAPKYIGDDMILLLELSDSKAEEIITEEFQNGLIWAQCWGIPLEVWDIENIRKIVATVEDLIEVDDDVDERRRLDRARILIKTPRRPMIHHSVAVHIGGEIHKVYIVEEGCTDIRMRTLPGRSATDSSEEIESEDSDIRTMFEVPETAPDFQTGRVSLGGKQNAVDDSHQTSLLPDDHRAMENPLGITPYAQTHLPSTDKCVQTNAERGKQQNSKKRDTEPCIGEDGTCEATKKSRGAERRVGITIHTTPFMPHNSFDSPTHPEIPSVLPLTPTATCDKPFTKAGSRTDVGPSKNNSAINPELDKPSTSYQTAVNGNGLHVFDTPKGCTQKTAQQSDKQQTFNDIIPLNYLEPISGTATPTAASEQNTITSPKLNKASSSYQTTQIESEWKVYVRSRGCRQKKDHLNGKQDSMGDINPHTHTHLESTSGTATPTAITHGSNRGQYEEAAAQWELAKIMGVTSDSDQSIIINKLIDMEDKDSKETKDLGDSNTSS

SEQ ID NO: 182187 - protein, 199 aa, Glycine max
  Coding DNA Sequence Number=SeqID_90502
  Gene Ontology: Mol. function=cation:chloride symporter activity; Cellular component=integral to membrane; Biological process=sodium ion transport
  Homolog annotation: Hit_ID=A4VCJ8; Match level="QueryCoverage=84%, HitCoverage=16%, E-value=1e-83, Identity=90%"; Hit description =Cation chloride cotransporter
MRLETVQIVGMAGIGETLLLVSLCGTCTFLTSISLSAIATNGAMKGGGPYYLIGRALGPEVGVSIGLCFFLGNAVAGALYILGAVETFLKAVPSAGIFRETITQVNGTAIARPIQSPSSHDLQIYGIVLTILLCFIVFGGVKMINRVAPAFLIPVLFSVVCIFLGIFLAGKDHPSGICISIGRLCEPEEPKPIQPLKID

SEQ ID NO: 182188 - protein, 29 aa, Glycine max
  Coding DNA Sequence Number=SeqID_90503
MERENKGGETKAEKKKGEVEEEKEGETEY

SEQ ID NO: 182189 - protein, 82 aa, Glycine max
  Coding DNA Sequence Number=SeqID_90504
MWTSHQHQEQKHFSDATHILRIFYPSPGLLPRTCCKARFLRNRGLTGIICMGGYGIQVVPGLIVLWWMMEMMVQRVKYLLVK

SEQ ID NO: 182190 - protein, 62 aa, Glycine max
  Coding DNA Sequence Number=SeqID_90505
MALIITGCLTSLHRYCLTPGGPALLLMHPAISGVAWVEVKVLPANGDCCSGWFDSNIVGGMP

SEQ ID NO: 182191 - protein, 192 aa, Glycine max
  Coding DNA Sequence Number=SeqID_90506
MQESNGFDNSNGSTDDEVALIYEKEDPNYKKSLSLTCKTNETATIEKLREEVAWATNEFGKFLEIPKILTTILKFHQHRMTSLAWVLKRKQHPPSHSLFQTNVTFVIWVPKSQIVSVACILHRKRPSLSYCLDSGCLGHMAGKRFMFLDLKPDEEITVSFVGISKGKISSIGKIGIPSLTSIDNVLYVEGLK

SEQ ID NO: 182192 - protein, 78 aa, Glycine max
  Coding DNA Sequence Number=SeqID_90507
MEASSLLLLSNVWEPDQSNQRKKLRNLRKLLEMPPSLLEDTHSLCAKIFSGLDLNQEGEALTDSSEYRPWGSPGLGIL

SEQ ID NO: 182193 - protein, 140 aa, Glycine max
  Coding DNA Sequence Number=SeqID_90508
MEEEISLQEKNITMKIIFSENFPLVIDYRHMVIDYMLKIQIQNLFQQLFLYLVFWKCLSFEAALLDSSLTSSKSCVAVVFRGGVAVKVEDIAVARVVEGEKCAEDGGSVGGGVGDEVGEARRERGGGGIGRGKSLDSTKG

SEQ ID NO: 182194 - protein, 285 aa, Glycine max
  Coding DNA Sequence Number=SeqID_90509
MKVQYPILKIMYFIAKPHPYIVGVNHRKSDSKDDDILQPDTVLVSVSDAITGTCTTSRARGNDPGTGDSDKCGLYIEENPSRLVALGRLYEGSTTVHNIPLLHGQVKVGVEEVKDAEALVPVPTDETAVSPAKPPESPDEEVDDPLYLMTLIIPQLFLKPLQVMWDATIFEVFNQNFPLYIKYEDLSEIAHGGQCLSISVIQLWILHLTETSVRAGNSDVYGFLEPHGHWQMVVILSKENLVVWFCSLHNRPDNYLKGIINSALKGLDDTPQPKSKAAARWIVVK

SEQ ID NO: 182195 - protein, 347 aa, Glycine max
  Coding DNA Sequence Number=SeqID_90510
  Gene Ontology: Mol. function=protein binding
  Homolog annotation: Hit_ID=A2Q347; Match level="QueryCoverage=55%, HitCoverage=36%, E-value=2e-87, Identity=78%"; Hit description =Leucine-rich repeat
MALLGKWMWNLMYQQGALWVAVLEAKYGGWRGLVGEGNSSCQSIWWRDLKKAMHMPYNGKTLYQQIKWKVEAGNKVLTLGYGQQKHQGIFSTRSAYSSIWEEAAVDNLHECFEDLWKIKIPRTNYMDFYFVIVPLVMFFLEVKTQSYDRLVMVGHLRVEENPILKMPHLEASSILLVGPTLKKFNDRDLSREEVALANRYPAHTALCIRDGWEFSRPEQAAESTFCFLVEKWKDHIPPGFFLKEASIDKPVEEDMCRCHFTIIHDGAASTDPPLFLKYQWFCGDISLSNFIPIPDATDEVYWPKHNDIGKVLKVECSLTLGEMVYPPIFAISSRISRDEQLNFLDPD

SEQ ID NO: 182196 - protein, 185 aa, Glycine max
  Coding DNA Sequence Number=SeqID_90511
  Homolog annotation: Hit_ID=A5B9F1; Match level="QueryCoverage=45%, HitCoverage=50%, E-value=1e-18, Identity=58%"; Hit description =Putative uncharacterized protein
MAIYELDPDVVCWGLHLLDDCTLSHHYSPSIVTQYDPDLSQVEYVTEGFCQHQYVDSDEAVAQAYQEELWQLVSMVASGNDNFGESHNMKEVGNYGPTPSERKNGVHENNVCGSSSGSVEVPTTSTSDDFWDSLEISDESLDGEVGKRLNQMVPIPRAKVALSNGCTLSPNGPLSATVPFSTSRF

SEQ ID NO: 182197 - protein, 60 aa, Glycine max
  Coding DNA Sequence Number=SeqID_90512
MVAHGGHRWSWVVEKDVWRVRLKMLFLKSQQPKPDDWVHSLQSKFEGDTIVNKFEIMLSP

SEQ ID NO: 182198 - protein, 111 aa, Glycine max
  Coding DNA Sequence Number=SeqID_90513
  Subcellular localization annotation: CTP_CleavageSite=43; ConfidenceScore=5.28e-01
MATPSEVPRAGEERIKASPPASPPPSPPPPPPPPISDASASPSAVKRTRKASRLRSLSARPAGVERPVVHIDPATGKADGPHKKKLRTYLGIVARDKVNITYENWKEVPTA

SEQ ID NO: 182199 - protein, 278 aa, Glycine max
  Coding DNA Sequence Number=SeqID_90514
  Homolog annotation: Hit_ID=A9PEZ0; Match level="QueryCoverage=24%, HitCoverage=7%, E-value=1e-07, Identity=47%"; Hit description =Putative uncharacterized protein
MGESEPLLMRIGGLEGRPDMSVSAEAMTTRHTNTCFPYHHYIQNGCYVGLELDVEHYVVPTPATAANSAHVYAANMIENPRETRGTGTRETTCKPRQDFSISKVRFFSLFVAEYGSPSKEKQNRKIQKLSLSLTQPSSSFLPPPLLPNKASTFGAHFRSKLQKEGISGVVKRVSTCGTSKFQLVLFECCITLMLGKLGRIDGDPVLRETRIWATWEYVSSVGGGQQGRGETSCFYSLTTEWYLEICRGGQETLGTSGGVLLSKTKLDQSRPNPGIVSQ

SEQ ID NO: 182200 - protein, 242 aa, Glycine max
  Coding DNA Sequence Number=SeqID_90515
  Gene Ontology: Mol. function=carbohydrate binding; Biological process= fructose 2,6-bisphosphate metabolic process
  Homolog annotation: Hit_ID=A7NYC1; Match level="QueryCoverage=41%, HitCoverage=13%, E-value=5e-31, Identity=68%"; Hit description =Chromosome chr6 scaffold_3, whole genome shotgun sequence
  Subcellular localization annotation: CTP_CleavageSite=48; ConfidenceScore=5.40e-01
MQVIMLDPSKMFQSSGMVESKSVGKFSPLQKQESQRGLFVDRGVGSPRLVKSSSSNIFSTDLNLDNETKNLMPAATGAVVAAVVADQMLGPKEDRHLAIILDMISIHNLQENMALRWETEWRLGYGDKCQFWEDCWVDNDVPLKLKYPRLYQISSQQQQTIMQMGSFSGAGGVVLASFLPIIIGWEWNFSWRRSLFDNEIGMAAEFLEELAQVTIHQDRPDLWVWKADPSGFGQASRRKTRF

SEQ ID NO: 182201 - protein, 102 aa, Glycine max
  Coding DNA Sequence Number=SeqID_90516
MACWRSWERSHNLEPSHGFPPQAYYPFTVEKEMTHLLLLLTTKRTNILLDEHTSSYEIIPSREPVFKKPPSEDCSPWGIFSFQINLEVLTSEAGVEGFIINL

SEQ ID NO: 182202 - protein, 115 aa, Glycine max
  Coding DNA Sequence Number=SeqID_90517
MGTDQTGKRFYQVKIKGLDITSIKELGRLMGPLQMQVFRKAYGKILDLTIAEISTEASASLTQYYDQPLRCFTFGDFQLVPSWGKETISFLQVSSLLEQNCNCGQGFGKRIGPRK

SEQ ID NO: 182203 - protein, 255 aa, Glycine max
  Coding DNA Sequence Number=SeqID_90518
  Homolog annotation: Hit_ID=UPI00016621D1; Match level="QueryCoverage =83%, HitCoverage=42%, E-value=2e-13, Identity=30%"; Hit description =UPI00016621D1 related cluster
ELHVLTVGGLHAVAFRGLHVLAIRGLHALAFVGLHALTFRGLHTLIFRGLYVLPLRGLHVLAFGGLHALTFRGLHALTFRALHVLAIRGLHVLAIRGLHVLAFRGLHALVLRGLHVLANRGLHVLTFRGPHVLTFRGLDVLAVEGLHALVLRGLHVLANRGLDVLTFRGPHVLTFRGLDVIAFRRLHALSFRGLDTLATLGNNKLGGKRAETDSVPFIIQEQRVEWNNKLGGKRAEIDSAPFIIEEQQAEWINAH

SEQ ID NO: 182204 - protein, 279 aa, Glycine max
  Coding DNA Sequence Number=SeqID_90519
  Gene Ontology: Mol. function=Rab GDP-dissociation inhibitor activity; Cellular component=cell surface; Biological process=regulation of GTPase activity
  Homolog annotation: Hit_ID=Q706C9; Match level="QueryCoverage=63%, HitCoverage=37%, E-value=6e-72, Identity=77%"; Hit description=GDP dissociation inhibitor
  Pfam annotation: Domain name=GDI; Domain location=1-278; Score=79.5; E_value=1.1e-20; Accession=PF00996.9; Description=GDP dissociation inhibitor
MDEGCDVIVLGTGLKECILSGLLSVDGLKVLNMDKNDYYGGESTSLNVIQRFRGDDKPPSHLGASKDYNIDMNPKFIMANGNLVWVLIHTNVTKYLSFKAMHGSFVFNKGKMLDVLINCFACALVQVHKVPTNNMEALKSPLMGLFEKCRARKFFIYVQNYNESDPKTHEGMDLTRILMSQAQHLRCLHTLRKYFETGLGVITMAFSMSLSISLMQSYPARALGRRLQVDWARDPREGPRVLMSLRLLKEVFSKKLLKEVFSKKLLKEVFSRKLLKEAT

SEQ ID NO: 182205 - protein, 200 aa, Glycine max
  Coding DNA Sequence Number=SeqID_90520
ATCEYVSSVEGGQLGMLDLCVICGCGESTCTIARSPPSTTYDGVVPGDMLRGSGDLGDVRRALGSQPIKKQRPQSKEACVVAGQLWILSNIWNMTSGNRLPRLGGIDGNPVLRGTRIRGYVGVRELSGRWATEDGDLGDVRWGAIAQNQDWPIPTQPGHSQSVRTCDVPKKASSWQSTDKRTKTTKQGGLCGGWPAMDLE

SEQ ID NO: 182206 - protein, 85 aa, Glycine max
  Coding DNA Sequence Number=SeqID_90521
MHANIKNSSIGACRPRIFFINGFICFLEDEWQRNGERERERRRHFKEKMSLEEAHHHRRPWIRAWRKKEMNEGRGREEHEILCSK

SEQ ID NO: 182207 - protein, 270 aa, Glycine max
  Coding DNA Sequence Number=SeqID_90522
MQSQGLALPPEPLVGHSGPRVNTKKSCVDLSGNDSETHDSDRCGLYIEANPARLVALEPLFHEQPVVSPAKPPQKPDSEVDDPLYLMTMTIPELFLRPYQVTWDATIFGVFNPNFPLYIKHEDLSKIAHGCQCLSILVHLTERSMRVGNSDIYGFLEPQSIQRFGQSQFETKSYIKSWMQSSKCDVYLGAYLNGGHWQMVVILPKEHLVVWFCSLHNRPNNYLKGINNRQKGSTECGFYVMHWMSIIILGSFRNNWKRILTILDHWSQRD

SEQ ID NO: 182208 - protein, 218 aa, Glycine max
  Coding DNA Sequence Number=SeqID_90523
  Homolog annotation: Hit_ID=Q2HW90; Match level="QueryCoverage=79%, HitCoverage=39%, E-value=3e-14, Identity=29%"; Hit description =Putative uncharacterized protein
MGSSQKASLKKRFYQVKIKSLEVTSLGKLGQLMGQLQRQAFRKAYGKIWDLARVEVSMEPIASLSQYYDQPLRCFTFEDFQLVPTVKEFEEILRCPLGGRKPYLFSGFYPSTTRVAKVVKISAQELDRVKQNRNGVVGVPRKCLEERAKALANQGEGAFFYWHLGAFHAFHHGKESPVDAILAMYDTFDQRYEKSGARIVCCTPALYVWLVSHLFPQE

SEQ ID NO: 182209 - protein, 361 aa, Glycine max
  Coding DNA Sequence Number=SeqID_90524
  Gene Ontology: Mol. function=isomerase activity; Biological process =carbohydrate metabolic process
  Homolog annotation: Hit_ID=A7V777; Match level="QueryCoverage=100%, HitCoverage=61%, E-value=1e-145, Identity=66%"; Hit description =Putative uncharacterized protein
  Pfam annotation: Domain name=PMI_typeI; Domain location=38-321; Score= -155.5; E_value=0.012; Accession=PF01238.12; Description =Phosphomannose isomerase type I
MISTVALFDAFQQTVSAPFRVVPFFDPGPWGGQWLKEVCDLDRSLPNYAWGFDCVPEENSLLLGFGNQVVEIPSSNLVFFQPEALLGKEVYEGFGDEFPIRFDFLDTMEGGNLSLQVHPLKEYIKEKFGMSYTQDESYYMLDAKEDAFVYLGLKENIDPQLMMKELEAAQHDQVPFDAEKYVQKWPVRKHDHVSIPSGTVHCSGANSVVLEISATPYIFTFKLWDWGRMGLDGKPRPISLAHGKNVIQWDRTTSWTKENILNLTEPIAEGDGWREERTGLDALSFIETRRHWFTKKVVHHTGGVVNVLNLVDGREIIVESPEHFFEPYVIHYAETFIVPAHVGLYTISPYGESEGKEWGIL

SEQ ID NO: 182210 - protein, 145 aa, Glycine max
  Coding DNA Sequence Number=SeqID_90525
MSSTEDNRNMENHRFISKSDSAKVRSNRKRIRQQKVHLDVQHSVHAINICDSSENETSGSAEAGIAAHDVQRYVKESDWAAQCTRQDKMSNEELKLQDPRCRIQCPGHPARKYWTHKSVISLTDCAGSTMSDTMSRTSCPKILDT

SEQ ID NO: 182211 - protein, 109 aa, Glycine max
  Coding DNA Sequence Number=SeqID_90526
  Gene Ontology: Mol. function=RNA-directed DNA polymerase activity; Biological process=DNA integration
  Homolog annotation: Hit_ID=A5AYT3; Match level="QueryCoverage=58%, HitCoverage=6%, E-value=6e-16, Identity=59%"; Hit description =Putative uncharacterized protein
  Pfam annotation: Domain name=RVT_2; Domain location=13-109; Score= -180.5; E_value=0.0086; Accession=PF07727.5; Description=Reverse transcriptase (RNA-dependent DNA pol
MQGNDTIEWELEMKNEMTSLQKSKTWSLTKLLEGKKALQNRWIYRLKEESNGRRRYKARLVVKGGRHLYVMQSYPARALDRKLQVDWARDAREGPRVLMSLRVDFGPMG

SEQ ID NO: 182212 - protein, 219 aa, Glycine max
  Coding DNA Sequence Number=SeqID_90527
WSGGRLEYRATLYGDLVGYRSRIDHMESHEFGLQEDIPVDPMNLDLLHQIDMRDNHYIDWMEYHAGKNTTLFLYVVQQLHDPCTTITHNVAGPGVEQTHFEISHPQSMYSTPSPVHQTFGHTGESVTATTHEWMTDLFGVDFNTPNLAASYLSTLQQFDAPHSFGEHGQSSSAATTNIANTNIEQQHHHDMGEPVILERRNSRRNRRPPPCGTGHHLGH

SEQ ID NO: 182213 - protein, 238 aa, Glycine max
  Coding DNA Sequence Number=SeqID_90528
  Gene Ontology: Mol. function=glutathione peroxidase activity; Cellular component=cytoplasm; Biological process=response to oxidative stress
  Homolog annotation: Hit_ID=A6T7Q2; Match level="QueryCoverage=66%, HitCoverage=98%, E-value=7e-76, Identity=85%"; Hit description =Putative glutathione peroxidase
  Pfam annotation: Domain name=GSHPx; Domain location=84-191; Score =187.6; E_value=3.1e-53; Accession=PF00255.10; Description =Glutathione peroxidase
  Pfam annotation: Domain name=Redoxin; Domain location=76-238; Score= -12.3; E_value=0.035; Accession=PF08534.1; Description=Redoxin
  Pfam module annotation: Pfam domain module=GSHPx::Redoxin; Domain location=84-191::76-238
MANTPVQTHAESLACATGVYGTDQCAPSCAGGVAAEASECQCYCDNGAQKVMLCAPGYEARYWARVATSTSNLCCFEDTDMPPFYQFSATSLTGQPISMADYAGKVVLVVNTASHCGFTPQYAGLEALYQKYAAQGLVVLGYPCNQFGKQEPGNADDISQTCHVNYGVSFPMFGKVEVNGSAAHPIFRYLKAELPGVLGGRIKWNFTKFLIGRDGQPLKRFAPLTPPEKMEAAIIAAL

SEQ ID NO: 182214 - protein, 64 aa, Glycine max
  Coding DNA Sequence Number=SeqID_90529
  Subcellular localization annotation: CTP_CleavageSite=36; ConfidenceScore=5.01e-01
MESPTVTTYPSVRGRRGAHGCVFHGRKMRGVATNVYSRKTSKKLERVFPSLLRILNCDEEIRPT

SEQ ID NO: 182215 - protein, 164 aa, Glycine max
  Coding DNA Sequence Number=SeqID_90530
MMDQGRFEIVDANKGEQHVYMQSANKSPSKPKPLVIHFTRDVAACNPRGYQPIPGKKHVPFPYKSDKTVPWKYAPQKPDGKKDEFIGDDLSSAKVTNISGMSGVTRSGRIFVEPDPLVRPKDTKGKAKVGTKEGDKASSILDEEIPSGRFAKGEEDFGRKKISA

SEQ ID NO: 182216 - protein, 91 aa, Glycine max
  Coding DNA Sequence Number=SeqID_90531
MKKKELLILKVCVEEFMAYHASSKANQNSMKNHEIHFEIQVGDRAEAVIQFMSRREKYFVEVEAQEKSLVKEQESREKDEEKDELCVTFMK

SEQ ID NO: 182217 - protein, 263 aa, Glycine max
  Coding DNA Sequence Number=SeqID_90532
MFLCIPGRGFILNSEGHPGKILRKDMTTLAQVWSVLSYSNLAPTSHTSELTVDRARLIFGLVSCLDMNIGALISSQMTSIAQSNTSRLGFPALIIALCRATGVVSDNLTFERLSLVVAPPGSIPSVEQFREMVVWPGTQPSLHREDEGPTAQVPQHVEDESSEATIPEPFVIGEEAKETHMRQVAAATLERSLEATLEPSAQGEDIPSPQPAADPSTPILEMPEDLTTPVLAMDTSPPATLVLHLIDEEDVQTQDTQDQSQEF

SEQ ID NO: 182218 - protein, 76 aa, Glycine max
  Coding DNA Sequence Number=SeqID_90533
MVDECQQRVTLEDYSSSSVPQFFTSVARPKVQAHNINYPHSLIHLIQGNLFQGLPNDDPYAHLATLIEICNTVKIA

SEQ ID NO: 182219 - protein, 232 aa, Glycine max
  Coding DNA Sequence Number=SeqID_90534
  Homolog annotation: Hit_ID=A7P4R2; Match level="QueryCoverage=40%, HitCoverage=20%, E-value=6e-10, Identity=37%"; Hit description =Chromosome chr4 scaffold_6, whole genome shotgun sequence
MNVESKRKDEQEVKGWRKALKSVGNWLAHKDKDEWLKDMRGMLILLSTVIATMTFQSALNPPGGVRPGNESGVVQCPVNKADNNPCPGESILVVVYPDEYGKFLIWNTTSFISSLAVCLLLVGGTRRICPLPTPNCLNCLCLQAEWEQREVQLVSCMKKNEEEKVSLEKEIKILLYLLKETEQEANAKREEKAQLKEKLKEVAAEAIQMQEALKETTTHNMKLKENLLDKEN

SEQ ID NO: 182220 - protein, 70 aa, Glycine max
  Coding DNA Sequence Number=SeqID_90535
MGRLAGFTENNTGLSGTGVPLSGNCYAKGRLCLAALNWAKISLSYGGLANRNAQISKCHKEFPLAQEILA

SEQ ID NO: 182221 - protein, 67 aa, Glycine max
  Coding DNA Sequence Number=SeqID_90536
MWLKGVKTPVFLLEIAMNALSAPAAHSLFITTVKFLDLQMIALTLSLACQAKRHYASAKRESAALSP

SEQ ID NO: 182222 - protein, 140 aa, Glycine max
  Coding DNA Sequence Number=SeqID_90537
  Subcellular localization annotation: CTP_CleavageSite=62; ConfidenceScore=5.01e-01
MGCSKDPSSPWLCISAALGEKNYFREENPSRGASVTLSRRFRGRIREGFPSFFIVLHPFFVRSSFFNGRFSLEVSLDQLANNQSETKAKINSQIKNYVGLISSSQLRIHRSKSPAFVDHPKRSLMVQRLNVSLLSKTRDR

SEQ ID NO: 182223 - protein, 85 aa, Glycine max; identical to SEQ ID NO: 134624
  Coding DNA Sequence Number=SeqID_90538

SEQ ID NO: 182224 - protein, 212 aa, Glycine max
  Coding DNA Sequence Number=SeqID_90539
  Gene Ontology: Mol. function=3-isopropylmalate dehydratase activity; Cellular component=3-isopropylmalate dehydratase complex; Biological process=branched chain family amino acid biosynthetic process
  Homolog annotation: Hit_ID=Q7NUB8; Match level="QueryCoverage=100%, HitCoverage=100%, E-value=1e-97, Identity=80%"; Hit description=3 -isopropylmalate dehydratase small subunit 2
  Pfam annotation: Domain name=Aconitase_C; Domain location=1-133; Score=187.0; E_value=4.8e-53; Accession=PF00694.10; Description =Aconitase C-terminal domain
MKAFTTLNGLVCPLDRANVDTDAIIPKQFLKSIKRSGFGPYLFDEWRYTNYGEPGMDCSTRPLNPDFVLNQPRYQGAQVLLARDNFGCGSSREHAPWAIEDQGFRVIIAPSFADIFFNNCYKNGILPIVASAEQVDSLFKECFANEGYKLSVDLEAQTVTTPSGQSFSFEITPTRKHNLLNGLDEIGLTLQHADEIRTFEEKHKQSQPWLFA

SEQ ID NO: 182225 - protein, 317 aa, Glycine max
  Coding DNA Sequence Number=SeqID_90540
  Gene Ontology: Mol. function=aminoacyl-tRNA ligase activity; Cellular component=cytoplasm; Biological process=tRNA aminoacylation for protein translation
  Homolog annotation: Hit_ID=Q1GXC3; Match level="QueryCoverage=57%, HitCoverage=45%, E-value=2e-81, Identity=79%"; Hit description =Tyrosyl-tRNA synthetase
  Pfam annotation: Domain name=tRNA-synt_1b; Domain location=159-317; Score=40.0; E_value=1.4e-12; Accession=PF00579.16; Description=tRNA synthetases class I (W and Y)
  Subcellular localization annotation: CTP_CleavageSite=53; ConfidenceScore=5.61e-01
APWPPAAISRLRKSPTTVIPVNSTRRAWLPNCKPIAVTSLARSEDSASKPFTACAYSSARRLEITAAWCISSSAGTITASTPSRLVPDIRPINSRVEVGKAGEFIRHKFNTADKILMTDVTQLSAAAEVLSPEIVNALAIIKRGADELLIEQELVEKLKTGKPLRVKAGFDPTAPDLHLGHTVLINKLRQLQDLGHQILFLIGDFTGMIGDPTGKSTTRPPLTVEQVKLNADTYAEQVFKILDPAKTEIVFNSKWLSELGAAGMIKLAASHTVARMLERDDFSKRFKGNQPIAIHEFLYPLLQGYDSVALQADLELG

SEQ ID NO: 182226 - protein, 173 aa, Glycine max
  Coding DNA Sequence Number=SeqID_90541
MYASIAGGFIDKSLGEKLFLKLPGKLGQKIRDNWNDDQTDPVMNNLTVGIQHKMKVMEDTCTNIAINKQIKMADLEICKQIYTPQQYHKEIRRKRPQYRPPNKQPSKKKNPTSRYSIRAFNSRKPTLNKERHVGKLRDNKHIQRNKNVMLAINQDITPEIVQTKPIYLQEKQN

SEQ ID NO: 182227 - protein, 108 aa, Glycine max
  Coding DNA Sequence Number=SeqID_90542
MKYLGSDPRSSPNEQWLQGFIPNQFNHFVATYPLAGGRRETRGMRVPRKEYARSRHQRLFEENVGKTGKDAIYELLSERFGSCIYARGRVFPFAPTYSSIWDEKIRPT

SEQ ID NO: 182228 - protein, 301 aa, Glycine max
  Coding DNA Sequence Number=SeqID_90543
CKSLGKQKGQLQRQAFHKTYGMILDLAMIKVSIIAIASLAQYYDQPLRCFTFGDFQLVPVVEEFEGILGCPLGGRKSYLFSGKHLEKKAKALAGQGEWASFIDVLALLVFRVVLFPNVDGLVDLVVIDANPSVPYKVIACVPRKGKVPKCSLDGNEGKDKELRGSNNGVIGGYHKWLRAWTQGITWLPKLKIYNEEEAEILEESDEVQALKVELQRMRVVKEKFKTTAIRVRKECDKLRVVNVATAEGQVESGKYDIRGQVEGLSKVEEELDRIVEKDGREHGSKGECDIFITQRSYDVDG

SEQ ID NO: 182229 - protein, 238 aa, Glycine max
  Coding DNA Sequence Number=SeqID_90544
  Gene Ontology: Cellular component=extrachromosomal circular DNA
  Homolog annotation: Hit_ID=A1G1J8; Match level="QueryCoverage=100%, HitCoverage=55%, E-value=1e-124, Identity=97%"; Hit description =Putative uncharacterized protein precursor
MREYRIGDSLRQLDWKATARARKLISREYQDEKNQQLLLMLDSGRRMLASEGGLSHFDHALNASLVVAYLALRQGDAAGLFAAGGERRWVAPQRGMGTVEHLLRASYDLQPRAVATDYLAAATEVSLRQRRRALVMLVSNVRDEDIEDLLAAVRLLQKRHLVCVASLRERELDGALEGEVQTLEDATQAGAAALYLQQRAKAHEALRSEKVMVLDVTADALPAALVERYLAVKREGLL

SEQ ID NO: 182230 - protein, 301 aa, Glycine max
  Coding DNA Sequence Number=SeqID_90545
  Gene Ontology: Mol. function=metalloendopeptidase activity; Cellular component=extracellular region; Biological process=proteolysis
  Homolog annotation: Hit_ID=A0N0A6; Match level="QueryCoverage=65%, HitCoverage=57%, E-value=2e-97, Identity=86%"; Hit description=Zinc metalloprotease
  Pfam annotation: Domain name=Peptidase_M4_C; Domain location=34-201; Score=104.3; E_value=3.6e-28; Accession=PF02868.6; Description =Thermolysin metallopeptidase, alpha-helical domain
MVFGDGDGEIFNRFTIAIDVVAHELSHGVTETEAGLIYFEQSGALNESLSDVFGSLVKQYHLKQTADKADWLIGEGLLAKGINGKGLRSMSEPGTAYDDPLLGKDPQPAHMKDFIKTREDNGGVHLNSGIPNRAFYLAATAIGGYAWEKAGYAWYDTVCDRNLAQDADFEAFAKLTIAHGEKRSGSDVGAAIKQAWEQLAREGGVAFIPKLSGQRTIALSSLNEAQRQRLVSILEQAFPRGQPPGQASSPGSGDQRYFRIQIIWTGQNQAHYTDIIVLVPEQEAPESLVELWKKGEGCVCD

SEQ ID NO: 182231 - protein, 176 aa, Glycine max
  Coding DNA Sequence Number=SeqID_90546
SEFLIGGYVGARASLLSTTPPFVAITQELVARGDTLRLSAPRHSVTPSVIDEQRPMWSSGLFRRCQHFPMETFQVSQVIQNYVGLSSSLEDTGGGPDDKQRPKTKFGHSAHMIRGDTLRLSAPLCYLDTVVSDGKQRPSSETKFGHSAHMIRGDTLRLSAPLCHSDTVVSNGTQRP

SEQ ID NO: 182232 - protein, 129 aa, Glycine max
  Coding DNA Sequence Number=SeqID_90547
MVVSFFLTHLLLEVASPLSLPFSIPLPFIFQEAKESIDEEDPRPASSNGAYIRSPYISPNPPSSMVVQYSPQQLVNPPTLVHEIPADPSTPLLEIPEDPATPVLGLTTTPPDTPLIYFSDEEGTQDQDT

SEQ ID NO: 182233 - protein, 44 aa, Glycine max
  Coding DNA Sequence Number=SeqID_90548
MAHGGQTLTFNEVKLVVACLSLSYPNFVRGPLLDDVRPFFGPRE

SEQ ID NO: 182234 - protein, 200 aa, Glycine max
  Coding DNA Sequence Number=SeqID_90549
  Homolog annotation: Hit_ID=Q6WAY6; Match level="QueryCoverage=91%, HitCoverage=29%, E-value=1e-21, Identity=37%"; Hit description =Putative uncharacterized protein
MVRDSAREFDRMKQTRNGVVGLPRKYLEGKARDMASQEKWVPFADILALLIFGVVLFLNVDGLVDLAAIDAFLAYHHSKQSPVVAILANLFDTFDRRCEKNSARIVCCLPALCVWLVSHLFQQDIRHPCLLQSYRSCIEKRRVDWDQHLAGIGGSTINWFPRWKEGKEGVLFSCGDYPNVPLIGTRGCISYNPALAIRQL

SEQ ID NO: 182235 - protein, 207 aa, Glycine max
  Coding DNA Sequence Number=SeqID_90550
  Gene Ontology: Mol. function=transcription regulator activity; Cellular component=nucleus; Biological process=regulation of transcription
  Homolog annotation: Hit_ID=A7QN80; Match level="QueryCoverage=63%, HitCoverage=30%, E-value=4e-27, Identity=51%"; Hit description =Chromosome undetermined scaffold_131, whole genome shotgun sequence
  Subcellular localization annotation: CTP_CleavageSite=42; ConfidenceScore=5.53e-01
ALASVAVTLRVTTTPAALNAPLQGASHSPFRLRNCWEGRSVRASSLLRQLAKGGCAARRLSWSDRASVVGDAINYIRELKRTVEELKLLVEKKRLEKQRVMMRHKVETEGESSNLDPAEYSESLRSSWIQRKTKDTEVDVRIVDNEVTIKLVQRKKIDCLVHVSHLLDQLNLDLQHVAGGHIGDFCSYLFNTKVGVYMQKNATSCVC

SEQ ID NO: 182236 - protein, 198 aa, Glycine max
  Coding DNA Sequence Number=SeqID_90551
  Gene Ontology: Mol. function=chorismate mutase activity; Cellular component=periplasmic space; Biological process=aromatic amino acid family biosynthetic process
  Homolog annotation: Hit_ID=UPI00005F8022; Match level="QueryCoverage =75%, HitCoverage=82%, E-value=2e-40, Identity=53%"; Hit description =COG1605: Chorismate mutase
  Pfam annotation: Domain name=CM_2; Domain location=48-116; Score =33.3; E_value=9e-07; Accession=PF01817.12; Description=Chorismate mutase type II
PEPRADPAPGLNIGSISMEMQLRSATLALLICSCSAAAAELSSPSPGQLINTRLSSMKDVAGYKAQHHQPIEDLGQERKVLDKALAEARQLGMDDATVQPFIQAQMDVAKAVQYRYRADWLATPEPHWQPRPLDEVRKSIGHYSDAILTQLAAQLKQGATLQAPQKAEFMRDIQQRNVSSQDKELLWRTLSAVTLRQP

SEQ ID NO: 182237 - protein, 65 aa, Glycine max
  Coding DNA Sequence Number=SeqID_90552
  Homolog annotation: Hit_ID=A5BSC1; Match level="QueryCoverage=70%, HitCoverage=1%, E-value=2e-08, Identity=56%"; Hit description =Putative uncharacterized protein
MTKSDENNKEDSVRKKWYIDSGCSKHMTGDVSKFKTISPKKSGHVTYNDNNISKISKEKIIVEIG

SEQ ID NO: 182238 - protein, 131 aa, Glycine max
  Coding DNA Sequence Number=SeqID_90553
  Subcellular localization annotation: CTP_CleavageSite=74; ConfidenceScore=5.45e-01
MARTCSPLKARTCSSLKARTCSLLKARMCSPLKARTCSPLKVRTCSPLKAIGVIVHATLSQPTLLRASEARLTCASSKGGKCAESPPTFICGKRQKNRRKPVMKNFPDSGVVFTFEEGISTSHVCPKGQQP

SEQ ID NO: 182239 - protein, 180 aa, Glycine max
  Coding DNA Sequence Number=SeqID_90554
KDRELRGSSNGIIGGYHKWLRVRTQGLDWLPNLKTVRDDEVKASEESDEVQALKAELERARVVEEKFKAAIVSSSSEEGICGPFIDKCKEKLNLAATHEQRLEDEYAKISAEREARERVIDSLHQEATMWTDRFALTLNRSQELPRLLAKAKAMADTYSAPEEIHGLLSYCQHMIDLMDI

SEQ ID NO: 182240 - protein, 55 aa, Glycine max
  Coding DNA Sequence Number=SeqID_90555
MTKARQKGVRKFDFGNLPVEDRRTTKNERRTVENHREITHENVTEAPRLGFSSQK

SEQ ID NO: 182241 - protein, 96 aa, Glycine max
  Coding DNA Sequence Number=SeqID_90556
MTKARQKGVRKGKRGRWLPPSSPRRARLLPLEDTAFSWKAQNFTDCALTLPFISRHVVKLHGLPNDGCQVPQSGQARVASQQTDGPQTKLGYDSRK

SEQ ID NO: 182242 - protein, 126 aa, Glycine max
  Coding DNA Sequence Number=SeqID_90557
FYSRRPETFKPNDAQDSSLLGRDDRVQWHREVSWLSNFVTFKTLKVASGGSNPARLGELGSNLLPHFPTNRRRGAVPKIPNPLGYAFQLRGASVTLPRRFREQIREGFPSFFTVLNPFIVRSSFFN

SEQ ID NO: 182243 - protein, 135 aa, Glycine max
  Coding DNA Sequence Number=SeqID_90558
MALPLTSSPLSSAASPWCLCEEQTWALRVIFAKFIDLDHFWNFSTPPPAQPVQNSRSEPSLEDLMKQIATSNILFQQNQQGSGNIPAQLIISPKGNMNAITLRSGRELPKPIDDSAKTDFAPKQIPLPFPSRLFL

SEQ ID NO: 182244 - protein, 85 aa, Glycine max
  Coding DNA Sequence Number=SeqID_90559
MVIDAAVWKVVARIDMGGVRKFEESTDGYNKMATYRGMLLDLARVLRNKLGVGGLTMEDRMLVYIITYILAPRSNNHSQVTDDDL

SEQ ID NO: 182245 - protein, 167 aa, Glycine max
  Coding DNA Sequence Number=SeqID_90560
MENNVSKVNEEGPVRGADSDGAGKGVGAEVGAGKDEAGADGDGAEEFGKVDEEGAEASGVAKVGGASDLLPLAFLGPLNVTVGSSRFQQFFFIYAKLMAGLRLSNDLESDVTPLALHKVVIKCDVRSVGGGDQVGVRKNTLSLSECGHVLFEDLQRLTINIKLKSPP

SEQ ID NO: 182246 - protein, 1030 aa, Glycine max
  Coding DNA Sequence Number=SeqID_90561
  Gene Ontology: Mol. function=transmembrane receptor activity; Cellular component=intrinsic to membrane; Biological process=innate immune response
  Homolog annotation: Hit_ID=A2Q1X9; Match level="QueryCoverage=85%, HitCoverage=78%, E-value=1e-177, Identity=43%"; Hit description=TIR
  Pfam annotation: Domain name=FNIP; Domain location=684-721; Score =16.6; E_value=0.0087; Accession=PF05725.3; Description=FNIP Repeat
  Pfam annotation: Domain name=FNIP; Domain location=726-763; Score =5.6; E_value=0.19; Accession=PF05725.3; Description=FNIP Repeat
  Pfam annotation: Domain name=LRR_1; Domain location=544-562; Score =0.4; E_value=2.6e+02; Accession=PF00560.24; Description=Leucine Rich Repeat
  Pfam annotation: Domain name=LRR_1; Domain location=566-587; Score =1.1; E_value=1.9e+02; Accession=PF00560.24; Description=Leucine Rich Repeat
  Pfam annotation: Domain name=LRR_1; Domain location=589-608; Score =2.8; E_value=92; Accession=PF00560.24; Description=Leucine Rich Repeat
  Pfam annotation: Domain name=LRR_1; Domain location=646-667; Score =16.3; E_value=0.12; Accession=PF00560.24; Description=Leucine Rich Repeat
  Pfam annotation: Domain name=LRR_1; Domain location=691-710; Score =6.1; E_value=22; Accession=PF00560.24; Description=Leucine Rich Repeat
  Pfam annotation: Domain name=LRR_1; Domain location=712-737; Score =12.1; E_value=1.8; Accession=PF00560.24; Description=Leucine Rich Repeat
  Pfam annotation: Domain name=LRR_1; Domain location=754-776; Score =11.1; E_value=2.7; Accession=PF00560.24; Description=Leucine Rich Repeat
  Pfam annotation: Domain name=LRR_3; Domain location=566-585; Score =36.4; E_value=1e-07; Accession=PF07725.3; Description=Leucine Rich Repeat
  Pfam annotation: Domain name=NB-ARC; Domain location=171-430; Score =84.9; E_value=2.7e-22; Accession=PF00931.13; Description=NB-ARC domain
  Pfam annotation: Domain name=TIR; Domain location=26-153; Score =163.1; E_value=7.4e-46; Accession=PF01582.11; Description=TIR domain
  Pfam module annotation: Pfam domain module=FNIP::FNIP::LRR_1::LRR _1::LRR_1::LRR_1::LRR_1::LRR_1::LRR_1::LRR_3::NB-ARC::TIR; Domain location=684-721::726-763::544-562::566-587::589-608::646-667::691 -710::712-737::754-776:...
  Pfam module annotation: Domain location=:566-585::171-430::26-153
MAEKMINVVASSSGSASKVFPKKYDVFLSFRGEDTRRNFTCHLYEALMQKKIKTYIDEQLEKGDQIALALTKAIEDSCISIVIFSDNYASSKWCLGELFKILECKKEKGQIVIPVFYNIDPSHVRKQIGSYKQAFAKLEGEPECNKWKDALTEAANLVGNDVELLKDIVRAVSEKLPRRYQNQSKGLVGIEEHYKRIESFLNNGSSEVRTLGIWGMGGIGKSTLATALYNELSPEFEGHCFFINVFDKSEMSNLQGKRVFIVLDDVATSEQLEKLIGEYDFLGLGSRVIVTSRNKQMLSLVDEIYSVEELSSHHSLQLFCLTVFGEEQPKDGYEDLSRRVIFYCKGIPLALKILGKSLRQKCKDAWESELRKIQKILNVEIHNELKLSYYDLDCSQKEIFLDLACFFKGGKRDWVAGLLEAFGFFPASEIEVLLDKSLIRISKYNEIEMHDLTQEMGREIIRQQSIKDPGRRSRLCKHEEVVDGTDVVEGIILNLHKLTGDLFLSSDSLAKMTNLRFLRIHKGWRSNNQFNVFLSNGLESLSNKLRYLHWDECCLESLPSNFCAEQLVEISMPRSKLKKLWDGVQNLVSLKTIDLQESRDLIEIPDLFMAKKLEREFTVTSEEMIDLMLSHTAICTLSSPIDHLLSLEVLDLSGTNVEILPANIKNLSMMRKLKLDDFCTKLMYLPELPPSLTELHLNNCQRLMSLPKLPSSLRELHLNNCWRLVSLPKLPPSLRELHLNNFWRLMSLPKIPPSLRELHLNNCRRLVSLPKLPPGVKEVSAINCISLKTDITQRLVLQHMYQSRIPYLNKDPTYREDEYFFFPGDHVTNSKYGFHTEESSITIPYLPKSHLCGFIYCIILLEGSVLKDNRFSCAIYRDDMLISLDHRRIIGCEKLISDHQDSEDSVTVTVVVVDQRIISQECVDHLQEVLLSLVSSVRLAGTDRKQKRPVQIMRTQDLVSGMCACGNKGIMTLLRDQTIRLWSDQNNNHKFVSSKILLGYTSFVGPLEWIPPNTSFLQGHSGLCLGLKHG

SEQ ID NO: 182247 - protein, 41 aa, Glycine max
  Coding DNA Sequence Number=SeqID_90562
MADSAMMNNEVAKAMRGKGIGMNGDCWNEWRDARLGGGGDE

SEQ ID NO: 182248 - protein, 199 aa, Glycine max
  Coding DNA Sequence Number=SeqID_90563
  Homolog annotation: Hit_ID=Q8LGC7; Match level="QueryCoverage=20%, HitCoverage=11%, E-value=6e-07, Identity=65%"; Hit description =Putative uncharacterized protein
RRVMKKSIAHARGNPDGEGEHGVHAAKTLVGGGEQGGDRAVQLSTASQPPAEWEVPHKEGRIESAVITVHGEGEQDQGGEGGDHEGAGGADGGLRVEHGGQARVALVEEGGMPVLVEIIEVGTQRQKEITVVILLQVSDDFDGEEHHREDAANSDVGSQVEVVCDGGVLVVGFLLRRHIFPCWFLTAETQSMATVAAGV

SEQ ID NO: 182249 - protein, 70 aa, Glycine max
  Coding DNA Sequence Number=SeqID_90564
MTDVVPDVTTSRFRTCRLYLTRPSPSATLKLCLGDRFGHGFKFGNSLFAYAKGKAAYNHPTSYLRIAKAF

SEQ ID NO: 182250 - protein, 105 aa, Glycine max
  Coding DNA Sequence Number=SeqID_90565
MSLWGRIASFAHDPKVLHCKVRLMRTLGPSPASLAQSSWSLLSNAFGVWDCIKPHHDLEFSYHVVPMDMAKVIKDRGDHSNMKSEEIEEYKKTIVAVRAFNREGV

SEQ ID NO: 182251 - protein, 66 aa, Glycine max
  Coding DNA Sequence Number=SeqID_90566
MAKVQKTMLVSACHRTQLCLDGKSAEDDVSLCVPSDTIVSGWQKGQYDRDCGAADKSEALALTYPQ

SEQ ID NO: 182252 - protein, 68 aa, Glycine max
  Coding DNA Sequence Number=SeqID_90567
MANQEEWVPFMDVLVLLIIGVVLFPNMDGLVDLAAIDAFLAYHHRKESPVVAVLADLLDTFDRRCEKS

SEQ ID NO: 182253 - protein, 55 aa, Glycine max
  Coding DNA Sequence Number=SeqID_90568
MIIIGEDGGAASSLGEDGSATGEYGSAGTDSTCNKLCSIVVVIWELWASGPADAD

SEQ ID NO: 182254 - protein, 131 aa, Glycine max
  Coding DNA Sequence Number=SeqID_90569
GPGVSGSYHGPLPVLRSSCHPNKVIRLPITRAFIEKYCTPRQAQGDAHQDAGTPPPPRPADLAGPLGVEHYLQHLVRQQVANHCGQVAWPGDWPNAQAGEEPAGSPGEADESCMDEDMTDLLGFLGGTGAI

SEQ ID NO: 182255 - protein, 27 aa, Glycine max
  Coding DNA Sequence Number=SeqID_90570
MLAPMAHGRQALTFNKVDLVIACLSPL

SEQ ID NO: 182256 - protein, 281 aa, Glycine max
  Coding DNA Sequence Number=SeqID_90571
  Homolog annotation: Hit_ID=Q6WAY4; Match level="QueryCoverage=84%, HitCoverage=41%, E-value=5e-10, Identity=26%"; Hit description =Putative uncharacterized protein
MGTRGCINYNPVLAIRKLGYPMRRALLEDELAPVISRGFNKTNVETLQKVRKAWEVLQRKDKELRGSNNGPIGGYRKWLKAHVQGLDWLPSLRTAKREEVEASEEDEEVQALRAELEQAQTVKERFKSAALKIRKENAELRDINIATTKALEQETKRARKEKHGHEKFRGALWGSNCELKLRREERDQSRALSMVLKEYQEELNLATAHEHRVADEYAQVHTEKEARGRVIDALHQEATMWMDRFALTLNGSQELPRLLAKAKAMADTYSAPEEIHRLLSY

SEQ ID NO: 182257 - protein, 100 aa, Glycine max
  Coding DNA Sequence Number=SeqID_90572
MIMRGQDIYSSQDEATNSPSFSESEEVKGEESSEEIYPQEEGQCLMVKKECKKISVSSKKLPLLDNLHIFSFCKKTLVSTATPFGLEIIPQVKELLDEGL

SEQ ID NO: 182258 - protein, 88 aa, Glycine max
  Coding DNA Sequence Number=SeqID_90573
MGSGRSRRRLPVNVPSCRRFRKAAYYRARVWLGPARIEKRGESLRRNSQVQRSIYEVQSLDKKEDFEPLGNSNWCMDESKSRQQEFWT

SEQ ID NO: 182259 - protein, 75 aa, Glycine max
  Coding DNA Sequence Number=SeqID_90574
  Subcellular localization annotation: CTP_CleavageSite=20; ConfidenceScore=5.14e-01
MKGLGMKMNPWKRIDSQRLSSSPNSSSKVLFLSKHEHPFFFMFFSLKNHYELRFYAEGVCTLSVSKWLGAKRTFT

SEQ ID NO: 182260 - protein, 63 aa, Glycine max
  Coding DNA Sequence Number=SeqID_90575
  Subcellular localization annotation: CTP_CleavageSite=41; ConfidenceScore=5.16e-01
MWRKSKRGVFAQSMVPPEGCCFWRKQPGSPGRAGRQASPLRKKRVQPLRHFPLFRICLEKLFL

SEQ ID NO: 182261 - protein, 244 aa, Glycine max
  Coding DNA Sequence Number=SeqID_90576
  Homolog annotation: Hit_ID=A7MPS4; Match level="QueryCoverage=45%, HitCoverage=97%, E-value=4e-47, Identity=81%"; Hit description =Putative uncharacterized protein
MKRGAGGRRQQLIAVGVDEKGFAAVFIHDQLIAIAETGDGDLIAVLQTRALLPGGNLEMPGWPHQRAEPVGGTRYRHGGAARAGDLEFAFAPRGGNLAGHQERGKGYRLHGGFSTEVSHCGQEERLHTTDFALFARLAQSPFRRRFHLGAKERQYCIEKGPAVIDQHAADFIQQRLAAAEPKNDGKQTPMRGHPVFIAQHATATCCRGCLAKWHGIAAHQPLTAEQQQYMVRVIHRWLVGEING

SEQ ID NO: 182262 - protein, 64 aa, Glycine max
  Coding DNA Sequence Number=SeqID_90577
MTKCVTEVTVAQACANLIAEPKISENSTTYAVCFAAGWLCQRAGKTGDAGEKYAINPGAAVESE

SEQ ID NO: 182263 - protein, 80 aa, Glycine max
  Coding DNA Sequence Number=SeqID_90578
MKNTISLMEKLMKNNSKAKKEVQLCTLGAPAFIMEEPKFSSKGNPPAMLAIRLALRSAPSVIGTRQFDWRFPTLSAYRQL

SEQ ID NO: 182264 - protein, 77 aa, Glycine max
  Coding DNA Sequence Number=SeqID_90579
MAFIPRGYNKMKPCKVSYQNIKQKMKFGNQELHVLTNEFHYCHNLPFCGRARRGSRMRLPWEENAQSRQQCLLKGKR

SEQ ID NO: 182265 - protein, 149 aa, Glycine max
  Coding DNA Sequence Number=SeqID_90580
MSHHSSNVNGEGTSHKNPLSRILDELSSLKLWKAKLERKEKGKERVEINQDEREQIKEEEIRKILKKLRKAKHASYSSHDFCKSLSEELRDYYEGRHRSHLRPRFHRREKERKPQEANINLPYFHGKNNVEVYFDWEIRVEQQLKRKST

SEQ ID NO: 182266 - protein, 109 aa, Glycine max
  Coding DNA Sequence Number=SeqID_90581
MGETHEAPQDHNLADFEPHLEYAAEGQTFCGVPLSNTFGGPQYCPQPQPLHFAVGRVPPAMVEIKKFDHIKERLRVIEGGENYAFADMAELCLVPDVVIPPKFLVDGYR

SEQ ID NO: 182267 - protein, 276 aa, Glycine max
  Coding DNA Sequence Number=SeqID_90582
  Homolog annotation: Hit_ID=A5B5G7; Match level="QueryCoverage=75%, HitCoverage=14%, E-value=4e-10, Identity=27%"; Hit description =Putative uncharacterized protein
MTSKKRKEPATPSQVCYDQSRFTSPKAWERYTNIVVPRKLLPKRNVVIYHTEFDEFKEELERRKWDEELTSFDEGSIDVAIMKEFYANLYDPEDKSPKQVRVRGHLVKFDADTLNTFLKTPVIIEEEEELSAYSRFSLLRPDPQELVAKLCIPGRGFELNADGLPLKILRKNLTTLAQTWSVLSFSNLIPTSHTSDITMDRAKLIYGIIQKMDMNHESSRLGFPALITALCKARGVTSDSRTLESLIPAINVAYVKKNYWNLDDPTVTFRGSQRPR

SEQ ID NO: 182268 - protein, 66 aa, Glycine max
  Coding DNA Sequence Number=SeqID_90583
MCGFNHTWMRFFSKSFIKLLELPNLEYPTFMEREKQMNNHLLPQAIEDISWDDQEYSSLCRSVRLI

SEQ ID NO: 182269 - protein, 253 aa, Glycine max
  Coding DNA Sequence Number=SeqID_90584
MTRIKKTGQMTSEATKEIADKIVRFLGGAGLTGFLCTHGRQDVLTAAIGRPDHLGRVRTAGVSVMIEQFFRLAPRTSRTSSSMAPEDLEQLKESIIEKELALPSEPEVGPSAARVSTKESCVDPSRNDPDMGDSEKCGSYIEENLPHLVALGRLYEGSTSVHNIPLCHSQVKVGVEEVRDVDVSIPIPIQKVQLVGQVLNTFVAGPTHLVKRLSEQGAVGLTKPVMWDANMFGVFNDNFPLYIKHEDLSEIAY

SEQ ID NO: 182270 - protein, 23 aa, Glycine max
  Coding DNA Sequence Number=SeqID_90585
MSRASSSSVFVLPGNTQDLEGIL

SEQ ID NO: 182271 - protein, 143 aa, Glycine max
  Coding DNA Sequence Number=SeqID_90586
MAAQLIHDRVEMECLEGAWETLEGNTRCRFRGTIRFTATSLVHRDEPVRTLQRTVERILPTPTPYRLVEPIQVIEVMSSEEDPEEDPEELPAEPAVDALDFLEGDEDPLPEVDSPKEVMSASEADSTEDSGPREMATSGGSSS

SEQ ID NO: 182272 - protein, 209 aa, Glycine max
  Coding DNA Sequence Number=SeqID_90587
NGPIGDYHRWLKAYAQGLDWLLNLRTTQEVEGEAPEEDEEVQALKTELEKAQTAKEKFKSAAVRIRKENTELRDVNIATIKALEQETKRASKEEHGRNKFRGALWGSNRELKLLKRGKGPIASRWHNSKGQIEDLPKVKEEFVSAVRVYTKKEARGRVIDSLHQEAMMWMDRFALTLNGSQELPRLLVKAKAMADTYSALEQIHGLFSY

SEQ ID NO: 182273 - protein, 77 aa, Glycine max
  Coding DNA Sequence Number=SeqID_90588
  Homolog annotation: Hit_ID=A5BA10; Match level="QueryCoverage=97%, HitCoverage=7%, E-value=3e-09, Identity=42%"; Hit description =Putative uncharacterized protein
MVFDGLGVSKDMMFISANQVVTSLKEYAQVYMILSNLEIETKVSMCDLPVVREFPEVFPEDISGLPLEREIEFSIDL

SEQ ID NO: 182274 - protein, 39 aa, Glycine max
  Coding DNA Sequence Number=SeqID_90589
MVPPPFYSDMLCLSSTGKGRRSVGRDPILHLHSSLSTCK

SEQ ID NO: 182275 - protein, 64 aa, Glycine max
  Coding DNA Sequence Number=SeqID_90590
MTQPPTNMSNLHVDEDDDDDDDYLVSNLYVEESLDEDDSVDGISNIDDEVTDMIQPLKIVHPVE

SEQ ID NO: 182276 - protein, 139 aa, Glycine max
  Coding DNA Sequence Number=SeqID_90591
MALTRSFFLGTLLMSILMSCLFLFGPEYCNLRWSSPQQQQQQPAPSFQNAAGPSRPYIPPPIQQQQQPQKQPTIEAPPQPSLEELVRQMTMQNMQFQQETRASIQSLTNQMGQLATQLNQQQSQNSDKLPSQAVQNPKN

SEQ ID NO: 182277 - protein, 215 aa, Glycine max
  Coding DNA Sequence Number=SeqID_90592
  Subcellular localization annotation: CTP_CleavageSite=32; ConfidenceScore=5.12e-01
MWLKGVKTPLASRKRKAPFTPTQARFDRSRFTSQEAWERYTDIMVPRKLLPERNVVVYYTEFDEFKEELERRHWDEQLTDFLDDNIDVSIVKEFYANLYDPEDKSPKQVRGHLIKFDEDTLNTFLKTHVVVEEGKTLCAYSRFALLRPDPLAAKLCIPGRGFELNVDGQPLKILRKNMRPRLLRLGAFFPFLTTSPLPTLLMSLMTEPNSFMASS

SEQ ID NO: 182278 - protein, 74 aa, Glycine max
  Coding DNA Sequence Number=SeqID_90593
  Subcellular localization annotation: CTP_CleavageSite=56; ConfidenceScore=5.74e-01
MATPPASPPPPSPPALPPPPDASASPSTVKQTCKATRLRLLATRSPGAERQMVNIDPATVGSSGLGIIKKGGLN

SEQ ID NO: 182279 - protein, 155 aa, Glycine max
  Coding DNA Sequence Number=SeqID_90594
MEFFQTIGYAMTQPEFFRHYRKLQEDNPHDTANAMITSGQVYTVIAANFITKKETKSNTHFVQQFDHQRFQFQVEERVNTRDRHRIQETLVATETDNAFRSLDTMNQNSMPQGRETMESDLRGSKMEGEGAKVCKLSPALGGLIERIEGIFVEIR

SEQ ID NO: 182280 - protein, 84 aa, Glycine max
  Coding DNA Sequence Number=SeqID_90595
MEVEKSLLGLWLPLHYGADKGGWCLVLNVPPVDVVADLGVAFVADMVFLALDLLHQWSPLLLEDEWQWNGDGRKMIGDDTSRRR

SEQ ID NO: 182281 - protein, 59 aa, Glycine max
  Coding DNA Sequence Number=SeqID_90596
VPQGNSATAFVNKEDTSYESKDSCTGIPSSISSKTQIVEEEEQFPMVFVLHLDTWGQLV

SEQ ID NO: 182282 - protein, 226 aa, Glycine max
  Coding DNA Sequence Number=SeqID_90597
  Gene Ontology: Mol. function=motor activity; Cellular component=cell projection
  Homolog annotation: Hit_ID=UPI00016621D1; Match level="QueryCoverage =89%, HitCoverage=41%, E-value=2e-17, Identity=32%"; Hit description =UPI00016621D1 related cluster
MTVPLNESISCFLIRVNPWVLVSIAFRGLHSLAFRGLHTPAFRGLDALDFRGQHILDFRGLYALAFRGLQVLTFRGLHVLAFRGLHVLVFRGLHALAFRGLHVLTFRGLHVLTFRGLHALAFKGLHVLPFKGLHVLAFSGLHVLAFRGLHALAFRGLHVLAFRGLHVLAFRGLHALYFRGLHALTVKGLHVLAFRGLHLLAFRGLHVFAFRGLHICTFRELKVLHP

SEQ ID NO: 182283 - protein, 151 aa, Glycine max
  Coding DNA Sequence Number=SeqID_90598
KSNRALGFPALITGLCQSFGVPVAPTKRQAQGDAPQAAGAPPPPHQDGQAGAFDMEQYLPHLVRQQASNHRAHVQTHDCLYQMSLSMQSQGFASFSCPTPDQFRAKVAWPGDWPEAQAGEAPPEAPGGGEEAHEDEEMADLLDFLGGSGDT

SEQ ID NO: 182284 - protein, 225 aa, Glycine max
  Coding DNA Sequence Number=SeqID_90599
  Homolog annotation: Hit_ID=Q6WAY6; Match level="QueryCoverage=95%, HitCoverage=39%, E-value=9e-13, Identity=25%"; Hit description =Putative uncharacterized protein
MCAEKGKANWEHLLAGMVGASVNWFPRWKEVGAGVLSSCEGFPNVPMMGTRGCINYNFVLAIRQLGYPMRRAPSEESIAPFIARGFSDPNARMLQRVRKAWNVVQRKDKELRGSSNGIVGGYHKWLKARTQEIDWLPKLKVSSEEEVQALKAKLERTQVVKEKFKTTTIKVWKECDELKDVNMATIEALEWEMKRARKQEWGLNKFQGALWGNNNKLKLQRAKRD

SEQ ID NO: 182285 - protein, 129 aa, Glycine max
  Coding DNA Sequence Number=SeqID_90600
MYAFVVCLFVDVAILCTSPCSAFACLHHVVMHVWYIGLVFCHGKLEGPYHLLNCTHGALCPQMRNCHSLDYKVEPSSCFLEKVHQVKLKYGSNHLAKNWGKRWIELHRYFVYCQTHLGLLMSLLLPVSL

SEQ ID NO: 182286 - protein, 56 aa, Glycine max
  Coding DNA Sequence Number=SeqID_90601
MENWRTALSNDIRGDPDSKLGNDIHGAPNESGGMENWRTALGDDIRGAPDSKVEDT

SEQ ID NO: 182287 - protein, 178 aa, Glycine max
  Coding DNA Sequence Number=SeqID_90602
  Homolog annotation: Hit_ID=Q2HW90; Match level="QueryCoverage=90%, HitCoverage=34%, E-value=4e-20, Identity=34%"; Hit description =Putative uncharacterized protein
MANQEEWVPFADVLALLIFGVVLFPNVDGLVDLAAIDAFLAYHHSKESPMVAILGDLFDTFDRRCEKSSAQIICCLPALYRIVDWDQYLAGIGGRTINWFPRWKEGKEGVLFSCGDYLNIPLIGTRGCINYNPVLAIRQLGSTDGREPLSFPCEIFRRAKFQDFTKSPQGVGKPVKER

SEQ ID NO: 182288 - protein, 271 aa, Glycine max
  Coding DNA Sequence Number=SeqID_90603
VDSRGSPTDNVLGRNILPERKVELYHTELDDFKTELERCNFHKRLTNLVNGSIDLALVKEFYANLYSSECPSPKQARVRGHLVKIDANSLNTFLETPVVLAEGETLPTYSRYCRLPTDYREIEVAFCIPGRGFILNTEGHPGRILRKDLTTLAQVWSVLSYCNLDPTSHAADLTVDRARLIFGLVSRMDMNVGALISGQMTSITQSNSSRLGFPALITALCRARGVVSDSLTFKRLSPVINLAMARPAELPSTSSAPTPASTSVAPSVPAQ

SEQ ID NO: 182289 - protein, 70 aa, Glycine max
  Coding DNA Sequence Number=SeqID_90604
MGKWLRRNSPRRGLEETPWEKGPMPPSSLIVIVSRVPSTSNASRPSEDGRSTGRGVSSSGRMSIRTFRRR

SEQ ID NO: 182290 - protein, 95 aa, Glycine max
  Coding DNA Sequence Number=SeqID_90605
MDNEEGMQEQMKADLSALKDQMASIKQAMLKLHKTLEDNATATASNAVREAEPVLQPTINLGRDRNPTVFGRRYSPQAYPYGLPPDFTPRAAPED

SEQ ID NO: 182291 - protein, 83 aa, Glycine max
  Coding DNA Sequence Number=SeqID_90606
AALQELSENGTDRAKIKAGSILELLQRMEGGPAIKSAATAEPGSQNGKKLEGGRTTLFDSEIQMADNFLGELSQQQIQPNRED

SEQ ID NO: 182292 - protein, 210 aa, Glycine max
  Coding DNA Sequence Number=SeqID_90607
MEGSSVAKPKPLVIYFTKSQLRKCPDTQLNMPNLFLSRTKIRHAVPWRYTPPREKEEEATDVSSLSAKWSCVRTSGPTSPTRGHQRKRKSGGGTRWSISRFLHKCECQKIFRLKGRKKGRHLMVPISTRNINPELARFIPGIAVLSPDPGRAGTQHVASTQSIATQPIVLSRKPPPTTEEKRKLDLLEERIESRGRIWGLFVPDMTDLFA

SEQ ID NO: 182293 - protein, 43 aa, Glycine max
  Coding DNA Sequence Number=SeqID_90608
MVGIDVIREPTSQGYTREDADEFIFCSYNGHNWVSSKVEWFHE

SEQ ID NO: 182294 - protein, 81 aa, Glycine max
  Coding DNA Sequence Number=SeqID_90609
MYPPLELIHKRCTLSYSQYNNPSRCTLYLCHKGFSGGEGKNQKNSQAVSPLNSLGKRERRHKRIQAVSPSILLAKGEEKKR

SEQ ID NO: 182295 - protein, 158 aa, Glycine max
  Coding DNA Sequence Number=SeqID_90610
GSRPQDAQWARRSPTGPWGFQLWNRTHKDTQWTRRSPIGPWGFQLWLRASVVLQGVRSTRQGHVIIGSRLQDTQWTRRSPTGSWSCQALITNLCQFYGVPVTSSKGIRPLTNRAFIKKYCIPRQAQGETPQQPGDGRQRATDTPPSPLEFTSAHPQKG

SEQ ID NO: 182296 - protein, 76 aa, Glycine max
  Coding DNA Sequence Number=SeqID_90611
MDEFIELMKEHNLETLGCLSAHLAVAMTNFARCFQIIIVTRALWNNMEAHPEIDTLTPKFVSPQISRLGSHDKRPH

SEQ ID NO: 182297 - protein, 122 aa, Glycine max
  Coding DNA Sequence Number=SeqID_90612
MDQRVTAGEIQQSIYGIVDLEAAPTPEEEPRSSEASSSFPIAGHSHIEPVEDTIMVEEDYSSSNVPQFFTSIAQPEVQAQTITYPPSLIQLIQNNLFHGLQNGDPYAHLAIYIEICNTIRLA

SEQ ID NO: 182298 - protein, 55 aa, Glycine max
  Coding DNA Sequence Number=SeqID_90613
MEDCLEGPLLGNHGTQLQTRNAIMETQLPTQNGGHMNDNAIHSWGSEKDENGGLP

SEQ ID NO: 182299 - protein, 126 aa, Glycine max
  Coding DNA Sequence Number=SeqID_90614
  Homolog annotation: Hit_ID=Q6WAY4; Match level="QueryCoverage=92%, HitCoverage=21%, E-value=8e-16, Identity=35%"; Hit description =Putative uncharacterized protein
MIEVCVEAIASLTQYYDQPLRCFTFEDFQLVPTVEEFGEILGCPLGERKPYLFLRFYPSMARVAKVVKISVQELDRVKQNRNGVVGIPRTHLEEKAKAWANQGEWASFIDVLALLIFGVVLFPNLE

SEQ ID NO: 182300 - protein, 111 aa, Glycine max
  Coding DNA Sequence Number=SeqID_90615
MEREMITMIVDTLLVFYYEKMVGYMPSSFVDLVFVGERIEVGLRRGKFDYPALINGKPSANGENKKEGGTHAVTVIPTWPNFPPAQQYQYSTNITHSHSRPPYQPRTPNHP

SEQ ID NO: 182301 - protein, 375 aa, Glycine max
  Coding DNA Sequence Number=SeqID_90616
  Gene Ontology: Mol. function=mannose-6-phosphate isomerase activity; Cellular component=cytoplasm; Biological process=carbohydrate metabolic process
  Homolog annotation: Hit_ID=A4W9X9; Match level="QueryCoverage=94%, HitCoverage=90%, E-value=1e-140, Identity=71%"; Hit description =Mannose-6-phosphate isomerase
  Pfam annotation: Domain name=PMI_typeI; Domain location=1-356; Score =513.4; E_value=2.6e-151; Accession=PF01238.12; Description =Phosphomannose isomerase type I
MQKLNNSLQNYAWGSKTALTELYGIENPQGLPMAELWMGAHPKSPSTVEVNGITRSLRDVINDDPLATLGAAVAQRFGELPFLFKVLCADQPLSIQVHPSKTAAEAGFARENAAGIPLSAAERNYKDANHKPELVYALTPFQAMNGFRELPEIVSLLEPVAGAHPQIAHFLENASEAALAKLFATLLSLKDESKTHALGVLKSALNAREGEPWQTIKTIASDYPDDNGLFSPLLLNVITLQPGEAMFLFAETPHAYLKGVALEVMANSDNVLRAGLTPKFIDIPELLANLKFEAKPAATLLTQPQTQGDSLIFPIPVEDFAFAIHTLSATPQTLAQHSAALLFCIEGQAVIEKARAAAGTATGRILLYRQPASRR

SEQ ID NO: 182302 - protein, 180 aa, Glycine max
  Coding DNA Sequence Number=SeqID_90617
MTSIAQSNSSRLGFPALIIALCRAKGVVSNSLTFERLSPVINLAYIRKNCWSPDDLTVSIRGARRARARLAKLPSTSTAPTPTSTSAAPSIVAQSDSQRFEAMLQSIHQGQIILLQNEGPTAQVPQHVEDESSEATIPEPFIVEEETGETQVRQKVVATPKRSLEGTSKPPALVVDLSSP

SEQ ID NO: 182303 - protein, 66 aa, Glycine max
  Coding DNA Sequence Number=SeqID_90618
MASYLLMERTRQRHRKQQQRGGKEEVNAILPRKGLVTRAMSKRLQEDWARAAEEGLRILMNRRIDF

SEQ ID NO: 182304 - protein, 259 aa, Glycine max
  Coding DNA Sequence Number=SeqID_90619
MARTKKTGQMTSEAAKEIANKIASQGSFVACGRQDVLIAAIGGPEHPSLVRAAGAGVTIKQYFGPVPRSSRTSLSIGPKDLEQLTQKIKDQLEESITEKPEVGPSAAHISRKESCVDPSGHDLDTGGLTTIHNIPLGNHQVKVGVEEVQDANAHILVPTQEVQLVGQEKQGAQGPVKLVDRPDPNVDPIYLMTLTIPQLFLKMLQVMWDAIVFGGMPMSMDSSSHSSYRDLGNHNLNQKVILRTGCRIQRRCVPKSLLG

SEQ ID NO: 182305 - protein, 73 aa, Glycine max
  Coding DNA Sequence Number=SeqID_90620
MRVCVVIVRWRGSAELQCSTPVTAQSKGSHSVLIKNTKGYQGKGQNGLFLVFSRPQLVQASIWLACAMELPLG

SEQ ID NO: 182306 - protein, 248 aa, Glycine max
  Coding DNA Sequence Number=SeqID_90621
MDRARLVYGLVTRMDMNIGGKISGQITIMAQSNSSLLGFRTLITALCRSRGVGSDALTSYKSLRPVINLAYIKRKCWDVNDQAVNFPRARKTRSRAAGVASSSAPAVDIPSYSTPAPPPTSTTPSAQSSQTSDAKLQSLFEGQILIMQSLQELAHQRPIMSVEQFIKQAAYPEPIPVPADPPSPMVDPSSPAPEAALPSTPIIISDDPTVQAPGLAPTLPATPELKFSDKEGGRITTPPGTPMLHFDD

SEQ ID NO: 182307 - protein, 118 aa, Glycine max
  Coding DNA Sequence Number=SeqID_90622
MCVAQSKVPKRPREGQCTFALHEHTQHPTYERGPKQVPKTLEENNGGLWWLMVAVGDGERAWNVGNGFGRKKGEEMAFFQSYLDYKAQNAQMSNALGNGNGNIAHTPDIFSKIPTVRS

SEQ ID NO: 182308 - protein, 132 aa, Glycine max
  Coding DNA Sequence Number=SeqID_90623
  Homolog annotation: Hit_ID=A7P875; Match level="QueryCoverage=24%, HitCoverage=10%, E-value=3e-07, Identity=78%"; Hit description =Chromosome chr3 scaffold_8, whole genome shotgun sequence
MTSSCRRASFMKGKIWFKAICPKFGGVYWVKASNGEKVIMSCADSNGQITMSREETTNWFGSYTMRSANGGRIAVVCRCPACLEVVEVLLLMAASSRGVDGSWKNGMREEYIDFSATLDSLRGTIIANNAPH

SEQ ID NO: 182309 - protein, 432 aa, Glycine max
  Coding DNA Sequence Number=SeqID_90624
  Gene Ontology: Mol. function=oxidoreductase activity; Cellular component=cytoplasm; Biological process=metabolic process
  Homolog annotation: Hit_ID=Q9ZRF1; Match level="QueryCoverage=16%, HitCoverage=19%, E-value=3e-24, Identity=82%"; Hit description =Probable mannitol dehydrogenase
VARQHLGADSFLLSRDQHQMQAAMGAFDGIIDTVFAVHPLLPLIGLLKSHGKIVMVGAPEKPLELPVFLLLAEAFKRFGKNLEEIENKLIEKNNDETLRNRYGLAKMPYTLLYPSSDEGLTFRGIPNNPHSTRHFFDETSLDLKSVSSILPSSNNYQSVCTHNKVKSALERAEKEPIVRKRTSFLKSPQREINYMDLAAIDAFLAYHHSKESPVVAVLANAYNTFDRRWEKSGAKIVWCTPALYVWLVSYLFHHEGRPVCPLQGHRMCAEKGKANWEQLLADMVGASVNWFPRWKEGEARVLSSCEGFSNVPLMGMRVCINYNLVLAIRKLGYPMRGALSEESIASFIARGFSDPNARMFQRVLKAWSAVQRKDKELRGSSNGIVGGYHKWLKARTQEITWLSKLKLSIEEEAETPEKIEEVQALKAELERA

SEQ ID NO: 182310 - protein, 132 aa, Glycine max
  Coding DNA Sequence Number=SeqID_90625
MDSSSSSHTVVYKTKVERKDIELVEEEEPRIGADCSSATFNKSEIYKEEAGNAAQKHKAKRVASVNVDAEAFGDHWESSVCSMHSEAEALEHMKKRDTGHQSESLENKTGDSTVLKIGDSTKVVIKQYMKGG

SEQ ID NO: 182311 - protein, 81 aa, Glycine max
  Coding DNA Sequence Number=SeqID_90626
DLIPIDLEINATCRRRNEERIRNFLQDLGEAAIPEEEPQSSEASSSFPIAEHSHLYPSEDYIMAEEPRRVTLEDYSSSNVP

SEQ ID NO: 182312 - protein, 193 aa, Glycine max
  Coding DNA Sequence Number=SeqID_90627
MAEPSKKGKGTSSWSQRHSGSQETPIPPSIPSGSLFSSEEQRIREGVPFEGALIDDWKFDFSVHDALWLVCTNQADMTGRLLVGSLAFESRILHYLIVRILLPRSSNLAQVSEEDLIVMWAFHKGLQIDWAHLVRYRMHKALRLNSPLPYPHLITLSFNTSTSLLIMNPMFQSKRSFLIGASVIASFGYIKGA

SEQ ID NO: 182313 - protein, 71 aa, Glycine max
  Coding DNA Sequence Number=SeqID_90628
HHMCAEKGKANWEKLLAGFLNVPLMGTRGCINCNLILAIRQLGYPMRGAPSEEIIVPFIAWGFSEGNAKML

SEQ ID NO: 182314 - protein, 128 aa, Glycine max
  Coding DNA Sequence Number=SeqID_90629
  Homolog annotation: Hit_ID=Q6WAY3; Match level="QueryCoverage=58%, HitCoverage=3%, E-value=2e-07, Identity=46%"; Hit description =Gag/pol polyprotein
MNFAVKKPVEFTPIPVSYANLLPYLLDNSMVAITPAKVHQSPFFRGYDSNATCARHGEAPGRSIEHCGALKRKVQGLIDAGWLKFEENHMIFKCKPLVSLLKRPVLLSLDFQDRSIIDYSSCTLVGLP

SEQ ID NO: 182315 - protein, 141 aa, Glycine max
  Coding DNA Sequence Number=SeqID_90630
  Homolog annotation: Hit_ID=Q6L477; Match level="QueryCoverage=49%, HitCoverage=11%, E-value=3e-08, Identity=35%"; Hit description =Putative uncharacterized protein OSJNBa0009L15.8
  Subcellular localization annotation: CTP_CleavageSite=30; ConfidenceScore=5.63e-01
MASPPASPLPLPSPPSDASTSSFAVKRTCKASHQRSLSTRPPGAERPVVHVDPAIGKTDGPHRKKLRTYLGIMARDKMDVTYENWKEVPTTQKDLIWEDQAEFEIPEASDSRTKNKLLHTVDKRWRQFKLDLMRKWALVAD

SEQ ID NO: 182316 - protein, 137 aa, Glycine max
  Coding DNA Sequence Number=SeqID_90631
MEHLLADGLRDQRNLGNKGDGAWKRAIGHGTEIAMDVHEAMSRETNEVEFMGLGATTTIDLEEPSSNTKGKRQGLTSSSTDSHRRKIGEKEGITISLDKMVNSFDRMVEKMDGKIDDEDSQEMLREVALIPDLSRQQ

SEQ ID NO: 182317 - protein, 290 aa, Glycine max
  Coding DNA Sequence Number=SeqID_90632
  Pfam annotation: Domain name=Transposase_23; Domain location=125-195; Score=-5.4; E_value=0.0046; Accession=PF03017.5; Description =TNP1ENSPM transposase
FIGGAGLTRFVCRPWTLGCIDCCHWATRTPWSCVCYWSWCHNQAILWTDSKDLSHVFLRDSQRPVAADATNQGLAGRVDHRKSDSTANMQSQGLVLSLELEVDPSAARVSTNESCVDPLGNNPDTGDSDKCGLYIEKNPHRLVALGRLYEGSTTVHNIPLLHDQVKVGVEEVRDANAPIPVPTEEVKLVGQTLNTFLAWATHLVNRLSEQGVVGPVKPADRLDHDVDDPIYLMTLTIPQFFLKLLQVMWDVVVFRVYNDNFPLYIKHEDLSEIAHGGQCLSIYVIQLWIL

SEQ ID NO: 182318 - protein, 52 aa, Glycine max
  Coding DNA Sequence Number=SeqID_90633
MASNRQQMHRHHLQSPSAHPLKGWSIAYDTWRTNRRPSPKPKVARYLGYPSI

SEQ ID NO: 182319 - protein, 105 aa, Glycine max
  Coding DNA Sequence Number=SeqID_90634
MIRGDTLRLFAPFCHPEAAGPMTSRDQVWSFCTLVSSRGGGPDDTRKYPSGYPYKHSFAISPRPIWALQKVPPEGGCFWRKQPCSPGRAELAWASWAASISPILL

SEQ ID NO: 182320 - protein, 44 aa, Glycine max
  Coding DNA Sequence Number=SeqID_90635
MTSWRSLRRNTELAMASFMARMPAIAQTRKAAITVRNQFGQLIN

SEQ ID NO: 182321 - protein, 104 aa, Glycine max
  Coding DNA Sequence Number=SeqID_90636
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=56%, HitCoverage=30%, E-value=3e-21, Identity=79%"; Hit description =Chromosome chr4 scaffold_32, whole genome shotgun sequence
  Pfam annotation: Domain name=APC10; Domain location=1-100; Score= -64.9; E_value=0.0011; Accession=PF03256.7; Description=Anaphase -promoting complex, subunit 10 (APC10)
LIVLYVVFKLHESYTPNKVSIRAGDGFHNLKEIKTVELVKPTGWVYLSLSGADPRLSYLCLPVSKIKWLQDLGSCHCHIPKQHSEFQSPEKAPQAWNSAVGLWF

SEQ ID NO: 182322 - protein, 96 aa, Glycine max
  Coding DNA Sequence Number=SeqID_90637
MNCLQPSLITSLESPLDSNYEKIKNKKVAVAGVSLSEAYALSEQHPLSETSARLASQENLEENLPHMHALAHHQLAQRVICLFWRLTRLTRSAKNH

SEQ ID NO: 182323 - protein, 83 aa, Glycine max
  Coding DNA Sequence Number=SeqID_90638
MKGGVEPATKASKGAFGCCLESTSRKGDSAKVVIKQDLKGRKHKYGFNNNKCEKPEKVRVVDDETGDKHQLDEVLRMPSKTKY

SEQ ID NO: 182324 - protein, 184 aa, Glycine max
  Coding DNA Sequence Number=SeqID_90639
KTLARFPYKSDKAVPWKYGVQGPDGRRDASVIRVGNGMSAAKITNISDTSGMTRSELIFAPPELPTRSKDKGKAKANIGEREKTDPIENDEAPIGKIAEEGDDFSKREISAEEATEFLRIIQQSEFKVIEQNSSQDLSIRATHEFRASSGIVVNNIIANNYLTFADEEMPVKGRGHNKDLHVSV

SEQ ID NO: 182325 - protein, 132 aa, Glycine max
  Coding DNA Sequence Number=SeqID_90640
MGCINYNPALAIRQLGYPMRGAPAKESLSPFLVRDFGAQGFKVIQRVHKVWEGPLRKDKELRGIRNGIIDGYHEWLKVRTRGLDWLFKLKIINEENFEAPKEDEEVRALKTELGKARLAQEKFKLVATDIRK

SEQ ID NO: 182326 - protein, 219 aa, Glycine max
  Coding DNA Sequence Number=SeqID_90641
MVTLTIENGWSVNRNFLQETRDLRRPSYKKPTLILLVGSSGLRIIKKRGVELIIPRTLPIKNYSFKAFTKLLRERGVEEKLKRNTNPGLPPVPKRPAVLEISFNIVKNHLQAMIHKGWNGKNQKNSQTVSFEFLTREKGDTKEFRRLVLCSFGKGRRETQKEFRRLVLSEFFLEKGEENEKMNSTSFQGLENQKTSESFWYKEEEEVQRDSRLVKDCMK

SEQ ID NO: 182327 - protein, 252 aa, Glycine max
  Coding DNA Sequence Number=SeqID_90642
  Gene Ontology: Mol. function=motor activity; Cellular component=cell projection
  Homolog annotation: Hit_ID=UPI00016621D1; Match level="QueryCoverage =97%, HitCoverage=42%, E-value=8e-24, Identity=36%"; Hit description =UPI00016621D1 related cluster
GLHVLAFRGLHVLEFRGLHIFAFRRLHVLAFRGLQVLTFRGLQVLAFKGLHVLTFRGLHALTFSGLHVLAFRGLHVLTFRGLHNFSFRGLHVLAFKGLHVLTFRGLHVFAFRGLHVLAFRVLHALTFKGPHVLNFKGLHVLAFRGLHVLAFIGLHVLAFRGPHVLIFRGVHTLAFRGLHVIAFRGLHVLAFRGLHILAFRGLHVLTFRGLHALAFRGLQVLAFRGLHVLSFRGLHILTLCLGSRMPHEKKHK

SEQ ID NO: 182328 - protein, 133 aa, Glycine max
  Coding DNA Sequence Number=SeqID_90643
MAGVPKELRRSDFLIPKIEEYVGAKGKTPLVDHKKEKNIKKGIKDIKNIKGNIKIKVMFAHSIKGCRPLGRTCGVLIPSPSRLFRFFRRFPQINVGGDSARIPFVEHASRESRVALPPKGRLRQLATPLGTIF

SEQ ID NO: 182329 - protein, 166 aa, Glycine max
  Coding DNA Sequence Number=SeqID_90644
  Gene Ontology: Mol. function=diacylglycerol kinase activity; Cellular component=mitochondrial inner membrane; Biological process=activation of protein kinase C
  Homolog annotation: Hit_ID=A5AU23; Match level="QueryCoverage=59%, HitCoverage=15%, E-value=5e-32, Identity=63%"; Hit description =Putative uncharacterized protein
MISAYGLHGRGEEAIITYYKMLQQGFKPDMITVVGVLSAYSKAGLVDEGISIYKSLMTKYKIKPTVEICACVVDMLGRSAQLDQALEFIKEMPLDPSPILNKKIFYNDGSECSVTSGHASRIVIPYKGSALDHEPNYELLPLARGDFSLDQEAEIPIEIPKRMNIE

SEQ ID NO: 182330 - protein, 99 aa, Glycine max
  Coding DNA Sequence Number=SeqID_90645
MVMLQDLPHNPCLIKTRLESEGRLVMGFRKASSVMSSDQVSLKKSWYIVRGWSKHMTGDASKFTHISPKKSGHIIHQIMINVFLVKMMILGYGIEELPI

SEQ ID NO: 182331 - protein, 77 aa, Glycine max
  Coding DNA Sequence Number=SeqID_90646
MAVRSKTMAQRLEAFLVPQSVSTSSPNKETKKKKKKKKQKKTTKTKVLAVTKKKKKKKLYLGSVAMCHGRKEVVQRT

SEQ ID NO: 182332 - protein, 110 aa, Glycine max
  Coding DNA Sequence Number=SeqID_90647
MNNIITLQDTKIKVFHVHVARYVVGSIPLDIVHMFWQKLSFSDQGLSESNVCITEEMEVISKWFEDLDACEKVTLKSKLQEIAYPDLNSMCAPPKKVWVKVHGLWLGIIS

SEQ ID NO: 182333 - protein, 162 aa, Glycine max
  Coding DNA Sequence Number=SeqID_90648
  Subcellular localization annotation: CTP_CleavageSite=30; ConfidenceScore=5.28e-01
MGSGGDSKWVIVDWCFVHRFKGERSMLSTRSDSARNPDLSSSHSRFVVASRFLPLIASLVAPSSTLFHTASVVSKMSYRMSRHHASEHADYLCVQYFRAGCQDIVSDIVDPAHSVKDITDLCVQYFRAGCQDIVSDIVDPAASILHLTFYLALCIVQPDLIP

SEQ ID NO: 182334 - protein, 135 aa, Glycine max
  Coding DNA Sequence Number=SeqID_90649
MDRSWMQASHISDEYENGVEQFLQFTELNPPSLWDNPSVSQTKSVDVDMGYHIEEMIHDLGQDGFQQAHAPLYDKIENDSKMPFVEAMTSKIILMMPKNQELSKFKNNQDQDSREVDFKIQEMKSRSNSQDFTRE

SEQ ID NO: 182335 - protein, 329 aa, Glycine max
  Coding DNA Sequence Number=SeqID_90650
SVEHQQRFEAIKGWSFHREKRVQLRDDEYTDFQEEIARRHWTSLVTPLAKFDPDIVLEFCANVWPTEEEVRDLRSWVRGQWIPFDADALSQFLDDPLVLEEGQECEFCQRRNRVDGFDEEAIAQLLCTPGQDFPRTVEGRRVRIKRTSMTTLTQMWMTLLLSNVLPSDHNSDLPLPKCQLVYAISTRMSVYMAQLIADAIYLFAGMPPTRHPLDPDKSNRALEFPALITGLCQSFGVPVTPSKVIQPPITRAFIEKYCTPRQAQGNAPQATDALPPPHQANPAGSLNMERYLQHLLSLSQQGQGFAPFACPAPDQFRAEVAWPGDWPEA

SEQ ID NO: 182336 - protein, 195 aa, Glycine max
  Coding DNA Sequence Number=SeqID_90651
MVWCMESQREVYLGAYLNQAHWQLLVLCPTKDVVVWFCSLHKKPDNHIKAVANNAMKTLKSSLDGHIDKVATQWIEIKSHVQTGRYECGYYVMHWMWNIDKLLLHDQTAHFTSHCVAEDVDSVDDSPINLNKYEHCVRVSKFNKCHVIGKRGDFPRLCHGDHSHLLSDHVVKDLTYKRHTTNWLWGQSLPGTYYG

SEQ ID NO: 182337 - protein, 146 aa, Glycine max
  Coding DNA Sequence Number=SeqID_90652
  Subcellular localization annotation: CTP_CleavageSite=65; ConfidenceScore=5.63e-01
MPCTRDRSLSSLRSLSSLLLPHNAPQNFSRPYSSLRALLVSCSRALAVAAFSSCNSVHSFRMCVAADLNFSLASLAFPSSNFRARWSRELSQRALRGRARARLTGALSKGGKVCGVATNVYLWKTSEKSKETGQNENSKFGSCIYA

SEQ ID NO: 182338 - protein, 63 aa, Glycine max
  Coding DNA Sequence Number=SeqID_90653
MTSPATDTIPDGGITLISNGEFSTGNSDLQQQHIPLSFPQRAISNKKMEEVEKEILETFRRVE

SEQ ID NO: 182339 - protein, 56 aa, Glycine max
  Coding DNA Sequence Number=SeqID_90654
MEDRVTTDRSSSLPGAGQAENVAAKQPMSYPNFVRGPLLDDIRLFFGPCEVLGTHH

SEQ ID NO: 182340 - protein, 71 aa, Glycine max
  Coding DNA Sequence Number=SeqID_90655
  Subcellular localization annotation: CTP_CleavageSite=52; ConfidenceScore=5.07e-01
MLATHSGYRATTKKPTSNYFLTSSLIFKDISGLILRNFCLTGEHPGFNGNLCCTMSRSRPGMSWYDHAKMS

SEQ ID NO: 182341 - protein, 52 aa, Glycine max
  Coding DNA Sequence Number=SeqID_90656
EEAMQGDMLMVRRLLGNQMQPLDDNQRENIFHTRKLYQCCKFQISDQTEFGN

SEQ ID NO: 182342 - protein, 124 aa, Glycine max
  Coding DNA Sequence Number=SeqID_90657
PQKPILFPRLRIHLRLPAYMSIDQRLFTLETDAVMSTTGRGRHSVLRIFKGRRGRTGHHATCGALPAAGPYLRLSRFQAHLALSFNRCAARQTPHLTMSSARIDRPKPTLGPKRGAVPRFRFTE

SEQ ID NO: 182343 - protein, 176 aa, Glycine max
  Coding DNA Sequence Number=SeqID_90658
NNETFSSLTSYPELRRSEFLIGGYVGARASLLSTIPPFVAMTQELVARGDTLRLSAPRHSVTPSVIDEQRPKTKFGHSAPMIRGDTLWLFAPFCHPEAAGPMTSRDPKTKFGHSAPLYHPEAAGPMADIVFCTFCSSGNNKSFTCGNFMVTRDSRQPRGAELVSYTDFRGPLLDDM

SEQ ID NO: 182344 - protein, 120 aa, Glycine max
  Coding DNA Sequence Number=SeqID_90659
MSHHSSSGNGEGTSHKDPQSRILDVLSSLNSHDPCKSLSEELRDYYEGRHRSHLRPHSKRREKERKPQEANINLLYSHGKNNVEAYLDWEIRVEQKLKRKSTSKSYGPHSYPKMAKVKAS

SEQ ID NO: 182345 - protein, 96 aa, Glycine max
  Coding DNA Sequence Number=SeqID_90660
  Subcellular localization annotation: CTP_CleavageSite=41; ConfidenceScore=5.29e-01
MAEPSKKRKGSSSTAAAAAHRHHGPSEAPTTPIHPSLSSPRSSTLFSSDDQRLRYLSQFSSRIILDPKYLDIDFFNDEHLIAIKCFKILVWLISCH

SEQ ID NO: 182346 - protein, 122 aa, Glycine max
  Coding DNA Sequence Number=SeqID_90661
MASRKRKSIGSRPTAQYNTRRFSFLDAWTRYTDNVLGRNILPERKVEIYHSELDEFKAELERHNFYKRLTNLVDGSIDLALVKEFYADLYSSEDHPPKQSRVRGHLMKIDADSLNTFLETPV

SEQ ID NO: 182347 - protein, 143 aa, Glycine max
  Coding DNA Sequence Number=SeqID_90662
MAAQLIHDRVVMECLEGIWETLKGNERCRFRGTIQLTATSLVHPEQPARTLQKPVKWILPTPTPYRLVEPVQVIEVSSSEEDLEEDPEELPPEPAMDAPDLPEDDEDPLPDVDSPEDIMSASEADSTEESGPGGTVNSDDSSS

SEQ ID NO: 182348 - protein, 88 aa, Glycine max
  Coding DNA Sequence Number=SeqID_90663
MMGSSSIKQSIAKNSLRDLEWKTQNTWATPMNTSCYLDKDESGQPVDPKQYRDTKNQLADIFTKPLSKDTFYNIRRELGLLDASDLSK

SEQ ID NO: 182349 - protein, 145 aa, Glycine max
  Coding DNA Sequence Number=SeqID_90664
MGDQEETQEQMKADMSALKEQMASMMEAIPHLGYNRVAYPYGLPPNYSPPVLQEDAGHIASLVHEREPPQQPDEVHKDPQDYARRDVEFYPPIPEGPAPGTLPQPNIAASPIVLSMEGPPLATEERRKLDLLEERLRAVEGFGDY

SEQ ID NO: 182350 - protein, 240 aa, Glycine max
  Coding DNA Sequence Number=SeqID_90665
  Homolog annotation: Hit_ID=UPI00016621D1; Match level="QueryCoverage =87%, HitCoverage=39%, E-value=3e-12, Identity=30%"; Hit description =UPI00016621D1 related cluster
MRGPLKESTSCFLVRLKSFGTCTYWLAFRGLHVLTFRGLHALAIRGLHVLTFRGLHALAFRGLHVLTFRGLHVLTFVGLHALTFRGLHVLTFKGLHTLAIRGLHVLTFRGLHALAIRGLHVLTFKGLHALAIRGLHVLTFEGYTPSPLEDHPHLQRATCPRHQRTACPHLRGLHTLTFRGTPSPTEVHALTLRGLHVLANRGLHTLTSRGLHILTLRGLHALTFRGLRVLTFSVCSTSAP

SEQ ID NO: 182351 - protein, 226 aa, Glycine max
  Coding DNA Sequence Number=SeqID_90666
  Homolog annotation: Hit_ID=UPI00006A2D9E; Match level="QueryCoverage =82%, HitCoverage=98%, E-value=9e-19, Identity=19%"; Hit description =UPI00006A2D9E related cluster
GLHALTFRGLHVLAFRGIHAITFRGLHILTFRGLHVLTFRGLHVLTFIGLHTLAFRGLHFLAFRGLHVLAIRGLHVLTFRGLHALAFRGLHDLTLRGLHVLAFRGLHAPFFKGLHILVFRGLHALAFRELHALTFKGLHILIFKGLHILTFRELQALNFGGLQRTTRPHLQRAARPHLQRTTRPRLERVARPRLQRATCPPPQRTTRPRLQRTTRPYLPRTTRPHL

SEQ ID NO: 182352 - protein, 18 aa, Glycine max
  Coding DNA Sequence Number=SeqID_90667
MNAGMEKPYDQYAENACT

SEQ ID NO: 182353 - protein, 201 aa, Glycine max
  Coding DNA Sequence Number=SeqID_90668
MLKGRRITSLAIWSSLSFSEEEIQHVCHVLIVLGFVPTSKGPRRPCQRLKLGLVHRLGHRGLELLGSGPRERTEVLTLLVQRRTSKMVPPLVAAVAHLPLAADPPRATAVPGDAVLLDEGSGNGRPNDLAGGDRHSDVAEQQHHPYLGKGGHADLTLPLAEFALLALFQDQRVAQELTEGVCIKGDPLAPHSGAHISSSLF

SEQ ID NO: 182354 - protein, 30 aa, Glycine max
  Coding DNA Sequence Number=SeqID_90669
DKIEPVSRAEALIPDDANLTRNGSLDTGYE

SEQ ID NO: 182355 - protein, 121 aa, Glycine max
  Coding DNA Sequence Number=SeqID_90670
MFDRGDEVLNALPRQEVLLGLRFELGSIIGDNGVWEAMPSYEVFLGEVVASRYLTAPGAFVNGPTPGRACRPWIFIINGVLFFLRYDCNRMEKEKDDWRSHFKEKMSLKEAHHHRKPWIRV

SEQ ID NO: 182356 - protein, 160 aa, Glycine max
  Coding DNA Sequence Number=SeqID_90671
  Subcellular localization annotation: CTP_CleavageSite=73; ConfidenceScore=5.26e-01
MGNQQRQGYNQGGFSGFQHGPYNQQGQWRSHPGNQFNKDQSGPSNRLPQQGPNIFQRTTKLEETLTQFMQVTMSNHKSTESTLKNLEVQVGQLAEQLVEKSSNSFGANTKKNPKEECSVVMTRNKKRLVVEDEDRVALEKQIVVKDGTEKKKEEVTDLTN

SEQ ID NO: 182357 - protein, 201 aa, Glycine max
  Coding DNA Sequence Number=SeqID_90672
  Gene Ontology: Cellular component=integral to membrane
  Homolog annotation: Hit_ID=Q9ZRS1; Match level="QueryCoverage=65%, HitCoverage=29%, E-value=1e-38, Identity=58%"; Hit description=Amino acid carrier
MVVEYWTAWTASAHIITAVIGAGVLSLAWAMAQLGWIIGIALMLLFAIVNLYTSNLLADCYRSPDPITGKRNYAYMEAVRSNLGGKMHMVCAFVQYSNLVGLAIGYTITTAISVVFFEFRTSEVASELLCSSQLLRHCSSGLENWDRWSALMKSLFGAQEVSDLVQNGYEDLGANPTEAQRLMFKEAKKNDCKALFTFSRM

SEQ ID NO: 182358 - protein, 78 aa, Glycine max
  Coding DNA Sequence Number=SeqID_90673
MNVEERRESRQNRGGACHPARPGDLSSPRRGRLLPPEATAFWRKDLEGPTFEEVTETHRLRKTPLFDFRHITEFSQIA

SEQ ID NO: 182359 - protein, 122 aa, Glycine max
  Coding DNA Sequence Number=SeqID_90674
MEDNNDDSRNEPVSDDSILNWTTVYQASGVGEPRTYWTENVEKKRLLRKAQEQLQPQKGKWLKIMKKWNLIILKNPKKNYLTLKIWKRKKSATTVKWSCQRSEVAAGTVHPRRTACPKAGKK

SEQ ID NO: 182360 - protein, 288 aa, Glycine max
  Coding DNA Sequence Number=SeqID_90675
  Subcellular localization annotation: CTP_CleavageSite=17; ConfidenceScore=5.34e-01
PLDPTPLASTEVSTPIVAAVVVVPTDVVVITSAPPPPSTMPIQEATPTVVVSTLSTSACSIVVPSSIIVAPLLSMGVATTSAHVLPPLSSLAPPALASTLLVMASPSMSYCPNVSFDHLYIYNETNSLWGANYKLDLVILEENEKQHQEAMRKVASLEVEVAKWRATARIVWRVERPKVANATVAFIETVKSNHQFSSKEEKKDLAGKVEGIAVERDELAKVVVKQHEKGFNKVIRQARFFAKDLDLGLFDPLKDVNNMVMLDEEDIVVQEEAGEEEDVEGQGDDANV

SEQ ID NO: 182361 - protein, 128 aa, Glycine max
  Coding DNA Sequence Number=SeqID_90676
  Gene Ontology: Mol. function=protein serine/threonine kinase activity; Biological process=protein amino acid phosphorylation
  Homolog annotation: Hit_ID=A5B6Z0; Match level="QueryCoverage=75%, HitCoverage=53%, E-value=3e-19, Identity=51%"; Hit description =Putative uncharacterized protein
  Pfam annotation: Domain name=LRRNT_2; Domain location=26-64; Score =33.9; E_value=6e-07; Accession=PF08263.3; Description=Leucine rich repeat N-terminal domain
MPFTFVKFPFHILLFLVLSLPSPVISQDQQTTLLGIKRQFGDPPALRSWKSSSPPCAWPEIRCSGGFVTELHLAGKNISAVQLPAAICDLAHLAHLNLSDNNIAGQFPAFLSNCSNLNTPRPLPELPR

SEQ ID NO: 182362 - protein, 111 aa, Glycine max
  Coding DNA Sequence Number=SeqID_90677
LITGLCELFGVPVTPSKVIRPTITRAFIEKYCTPRQAQGDAPQAADAPPPPHQANPAGSLGMERAEVTWPGDWPEAQAGEALAGAPGDAEEARMDEEMTDLLGFLGGSGAT

SEQ ID NO: 182363 - protein, 141 aa, Glycine max
  Coding DNA Sequence Number=SeqID_90678
  Homolog annotation: Hit_ID=Q2HW20; Match level="QueryCoverage=90%, HitCoverage=77%, E-value=2e-08, Identity=28%"; Hit description =Putative uncharacterized protein
MMLNINASTSDVRIFKLIWKMNIPPRAATFTWRLLKDRLPTKGNLLRRNVITQDADCPLCGQVVGPLPLVPASHLAQFCEGFRVNVNHSRWNNLIFQGNQFDSSKVMEEAMFSAWSWLKTREKGFNTSFNHWSSNIKDHFV

SEQ ID NO: 182364 - protein, 161 aa, Glycine max
  Coding DNA Sequence Number=SeqID_90679
  Subcellular localization annotation: CTP_CleavageSite=41; ConfidenceScore=5.51e-01
MAEPSKKRKGSSSTATAAAHRRHGPSGAPTAPIPPSLSSPRSSTLFSSDDQRLRQGAPFEGTIVDDWKFDYSSHDARRMVCNDQAEMTAQASEEDLILMWAFLTGRQIDWAHLVRYRMHKALRANAPLPYPHLITLFLRHFQIPLDDEPFVQVKRCFAIGA

SEQ ID NO: 182365 - protein, 70 aa, Glycine max
  Coding DNA Sequence Number=SeqID_90680
MKNPTLLGYPPVATCPFAGERGEAHRCAFQMRKDARSRHQRLFVENVGKNRRKPVKTKILSSGVVFTFEE

SEQ ID NO: 182366 - protein, 77 aa, Glycine max
  Coding DNA Sequence Number=SeqID_90681
MCAQVCSKSKRLEMAPKKLSANRSRRDAAAEGSSATPEFDSHRFQSAEHQQRFEAIKGWSFHSERRIQLREDEYTDF

SEQ ID NO: 182367 - protein, 40 aa, Glycine max
  Coding DNA Sequence Number=SeqID_90682
MATPPSSPPPTPPTVDMTYENWKQVPVAQKDLIWEDIQEF

SEQ ID NO: 182368 - protein, 119 aa, Glycine max
  Coding DNA Sequence Number=SeqID_90683
ELERCCWHKALTRKLDGHIDVALVKEFYTNLYDPEDKSPRQVRVRGKLIKFDAESLNAFLDTPPVLEPGEQYTTYTRFCHSRPNPQEFTARLCIPGRDFVLNTEGAPWKLLRKDLTMLA

SEQ ID NO: 182369 - protein, 68 aa, Glycine max
  Coding DNA Sequence Number=SeqID_90684
MVGYAPSSFADLVFVGERSQQENEEDENEGETLAMIAIPTQSNFPSAQQCHYSANNSPSHPIIPKVHP

SEQ ID NO: 182370 - protein, 129 aa, Glycine max
  Coding DNA Sequence Number=SeqID_90685
  Homolog annotation: Hit_ID=A5BSW9; Match level="QueryCoverage=48%, HitCoverage=4%, E-value=1e-09, Identity=50%"; Hit description =Putative uncharacterized protein
  Subcellular localization annotation: CTP_CleavageSite=28; ConfidenceScore=5.19e-01
MGPKSILRLMRTLGPSLASLVQSSSSLLSNALGGSNQHKNTKKGVPTDPKRIKVIPKWPTPPSIRKIWGFHDLTNFYKRFVPYFSILVAPLIELVLRKKSPEFQEPRDLRSNPFQGGGNDAILSRKGIG

SEQ ID NO: 182371 - protein, 66 aa, Glycine max
  Coding DNA Sequence Number=SeqID_90686
  Gene Ontology: Mol. function=4 iron, 4 sulfur cluster binding; Cellular component=integral to membrane; Biological process=electron transport
  Homolog annotation: Hit_ID=P52636; Match level="QueryCoverage=43%, HitCoverage=8%, E-value=3e-10, Identity=100%"; Hit description =Putative electron transport protein yccM
MNIYIAITFWYWVRYYETASSTTFVARPGVTVRPRRRDAVIGRFYRHQSITQKGLLLMVMPGWYAF

SEQ ID NO: 182372 - protein, 70 aa, Glycine max
  Coding DNA Sequence Number=SeqID_90687
MMHAPDSTLICNVGTVLSLSRPPGCARNSPPPIGDQHGSPKVFPTRSKVNAKDHGPIKAPKHPLRNAYIL

SEQ ID NO: 182373 - protein, 83 aa, Glycine max
  Coding DNA Sequence Number=SeqID_90688
MWLRMPLDSWVTVTKGGVVDKSSAFAPTISFLNNHLEEALGSTKIEENHSKCINLTQCEANKSPMHRILVGNQRKRTTSGGIL

SEQ ID NO: 182374 - protein, 53 aa, Glycine max
  Coding DNA Sequence Number=SeqID_90689
MSEPHMDNPSLVFRNPLQQETLGLSVLTKSILATGNRLHPLVIDYQRVNLNLK

SEQ ID NO: 182375 - protein, 104 aa, Glycine max
  Coding DNA Sequence Number=SeqID_90690
MDHDGRVWGRGFALQTFPVMLLGLGKPLVEILPPGQTSWFLPVVGLARVGGAGLWPRAKFRIGWPPPPPRFVGDLEGRDESKRQGLNLSGSWQQGHSATYNTPS

SEQ ID NO: 182376 - protein, 108 aa, Glycine max
  Coding DNA Sequence Number=SeqID_90691
MARHKVTRTHTHTHSRRHKGEEGLGRFVGDLEGAEKITLSGAPADVSGLPNVPSAATSRFRNFNPIPFRSTRTERYQTGFPRPLGSTNPCASAVHMEPFPSSAFKVLI

SEQ ID NO: 182377 - protein, 96 aa, Glycine max
  Coding DNA Sequence Number=SeqID_90692
MCSDETSTKHQRSTKRDPSYWEYVDALHSMQNINSPIKHSASSSDQAKPRRTMPMLDQFHPCIHDSIENIVDVKADGKGEDSWSLVCNHLLKELAK

SEQ ID NO: 182378 - protein, 72 aa, Glycine max
  Coding DNA Sequence Number=SeqID_90693
  Subcellular localization annotation: CTP_CleavageSite=16; ConfidenceScore=5.03e-01
MVNLVTQLAMNQKSTSAPVVGGIIQNMRWTSPPQQQQPIPPFQNIVGPSKPYVPPPMQQQQQQSQQRQQAIR

SEQ ID NO: 182379 - protein, 122 aa, Glycine max
  Coding DNA Sequence Number=SeqID_90694
  Subcellular localization annotation: CTP_CleavageSite=30; ConfidenceScore=5.26e-01
MSHLLFSVTTTQVDVPSTCTTKDVPSNVLRQSSQAGNGRIKRILRLCHFEFFEKGEGRHKRIQAVSLSFFWKREKRDTKRIQAVSPWRILFGKGRRETQKEFRRLVLVELFLAKGEENEKDE

SEQ ID NO: 182380 - protein, 60 aa, Glycine max
  Coding DNA Sequence Number=SeqID_90695
MVIFHHGDVAQDKGEEPWKEKLHPQESVLDKKLREEASMEEENERERKWHGKLKVERERS

SEQ ID NO: 182381 - protein, 67 aa, Glycine max
  Coding DNA Sequence Number=SeqID_90696
MIQTKICIHEIAHKVFSASAEKLGIVPIIFLMMMRWREFMQDGGLCFGGCCSVSMSGAERDVAARFG

SEQ ID NO: 182382 - protein, 66 aa, Glycine max
  Coding DNA Sequence Number=SeqID_90697
  Subcellular localization annotation: CTP_CleavageSite=23; ConfidenceScore=5.10e-01
MKYDLYTEVVKYVGVGIRPKLAQASLNWVSSPRRAKFRSRESCRKSKCTEEKFEWRKVQVFLWRKQ

SEQ ID NO: 182383 - protein, 366 aa, Glycine max
  Coding DNA Sequence Number=SeqID_90698
MALSSSSVFLPIKAKYDVSTSTSRYLMTGIRVDSVGGDLESQEGSPVQDICGIALVDKDPRHHEVCNDDGDNHGVILVDGDNMQMMFSGLARLPSIGKAACDGVDYTSDVLDKFLFFWRLSLTSLLLLSLSASYLVASDPNLGGFVWGSRMGTSRLKASSKIVVQLVVRIDFGASFALFAFMSALEHGMQCYLGIKILDLDGCAPKYVHEFSKGLVVCLSQTCQGGQGHAVRPAGGILRTKLFDEGVEAVYEPGWESTVKKASRCSFGFVVPLYRSRLTGFHLKGMSASIVRLAKGCRRKVHPAGWCMWERLKSFAVLPMCWGCDSPWVRSSKMWTECSSPWGRLAVFVFVIAVGEDENLQGGSRI

SEQ ID NO: 182384 - protein, 101 aa, Glycine max
  Coding DNA Sequence Number=SeqID_90699
MAKCIEDPGTNQNVAERTTKNQQHYLKPEIRNGRGVLNFWHFLYSWKHSSEWLNVRENFWCEDLEGQQRLKRKLSCEVLDESLSDCEVSRGEGDILTTCTS

SEQ ID NO: 182385 - protein, 69 aa, Glycine max
  Coding DNA Sequence Number=SeqID_90700
MAVSKLRNDAKGSSWCGVSTENNGGLWWLRVAVVDEEKAWYIGNGFGRRKEKKWHFSKATWTTRLKTQK

SEQ ID NO: 182386 - protein, 81 aa, Glycine max
  Coding DNA Sequence Number=SeqID_90701
MVVIIKKGENGENVNVWIHDFDDAKEELNKVASKVKHCFKINTRLFQQTKPCFKINSRSSLVSKQSVSKTSKALVIDYQAV

SEQ ID NO: 182387 - protein, 99 aa, Glycine max
  Coding DNA Sequence Number=SeqID_90702
  Gene Ontology: Mol. function=nucleoside-triphosphatase activity; Cellular component=chloroplast
  Homolog annotation: Hit_ID=Q2PMM5; Match level="QueryCoverage=90%, HitCoverage=3%, E-value=1e-38, Identity=84%"; Hit description =Protein ycf2
METLILDDQDTSQKSKFLINGGTISPFLFNKIPKWMIDSFHTRKNRRKSFDNTDSYFSMISHDPDNWLNPVKPFHRNMNIPDSEGKNLHQYLNFNSGIL

SEQ ID NO: 182388 - protein, 139 aa, Glycine max
  Coding DNA Sequence Number=SeqID_90703
  Subcellular localization annotation: CTP_CleavageSite=32; ConfidenceScore=5.20e-01
MASSRGMFTSTFLKVSKISFSASSIFLFGIALGGNGKGIGGCNFEWRLLSLAEIAYSRWSFASLILLRKVEKEPQLLVVFVVTAVVLEEEHMACLDQQHSGKEGQAVVVDASSIGACRPRIFFINGFLCFLEDEWQRNG

SEQ ID NO: 182389 - protein, 125 aa, Glycine max
  Coding DNA Sequence Number=SeqID_90704
MVTARPERVLRQFGYIQSIPPPLVSASLSYNDIDDRWMHFADHVSAYYMEWFFRISHPFMIPTQAGDQPRHAPAADPEEYMQPPIPQVPMAFDAPPHAVDCLTVARGGASADGSVRARQRRRTEH

SEQ ID NO: 182390 - protein, 241 aa, Glycine max
  Coding DNA Sequence Number=SeqID_90705
  Subcellular localization annotation: CTP_CleavageSite=25; ConfidenceScore=5.49e-01
MRSDCLVQFSILNPFSKPMNCVFIQVSSTFEFGAMRSDCLVQFSILNLFRSPMNFVFVHESCTFEFGALRSDCLVQFSIFNLFRSPMNCVFVHVSSSFEFGAMRTDCLVQFSILYLFRSPMNCVFVHVSSSFEFGAMRSDCLVQFSILNPFSKPMNCVFIHESSTFEFGAMCSDCLVQFSILNLFRSPMNFVFVHESSTFEFGALRSDCLVQFSILNLFRSPMNLRFRSCVLHLRVWSYAY

SEQ ID NO: 182391 - protein, 59 aa, Glycine max
  Coding DNA Sequence Number=SeqID_90706
MEGNDGFEQRECESREVNEAVILMSSYKSFSKSMNMEGSKENVRDGEGRNLEDEVEREI

SEQ ID NO: 182392 - protein, 114 aa, Glycine max
  Coding DNA Sequence Number=SeqID_90707
MAAQLIRDRVEMECLEGVWETLEGNTRCRFRGTIRFTATSLRTVEWILPTPTPYRLVEPVQVIEVTSSEEDPEEDLAELPLEPAVDALDFLEGDEDPLLEVDPLQCLGKEFSDG

SEQ ID NO: 182393 - protein, 60 aa, Glycine max
  Coding DNA Sequence Number=SeqID_90708
MLRGSGDLGDVRWGAIAQNQAWLIPTQPGHSQSVRTCDGDRGLVINYQLGVIDYTVLPAT

SEQ ID NO: 182394 - protein, 106 aa, Glycine max
  Coding DNA Sequence Number=SeqID_90709
MEIALEDPFTHSSKPEGGGHMNENAIHGAPKRMRMENCTKQSLRIAPNSKLQTRRWRTHESKTQFMGLRKVLRMENCTKQSLRMSSKLEGGGHMNENAIHGAPKMG

SEQ ID NO: 182395 - protein, 95 aa, Glycine max
  Coding DNA Sequence Number=SeqID_90710
MRILLIVQGQNKFGCQGVGLGPNSHITPQGTRDNDDLKTTCKISHGYSQVGTQASRLWHCDTTVGNLHKQTQRFPIMFFYQFNEFIHPYLGYSGK

SEQ ID NO: 182396 - protein, 185 aa, Glycine max
  Coding DNA Sequence Number=SeqID_90711
MLESFQQQYQMSVLELYVKKDVAGGSMFHSANSLTSCGNNLSNNEAQPPRNVSNLHGDDDDDYLVFNSYVEESLDEDDSIDSISDTDDEVTDMIQPVRIVHPAKGVQGIQNPFWNDVLHYNNINWSHPDEEDICGLEMPSSFNVGQELYVGMDFDSKDAVKNAVKQYVMKVNQSFKVVESKWNKP

SEQ ID NO: 182397 - protein, 175 aa, Glycine max
  Coding DNA Sequence Number=SeqID_90712
  Homolog annotation: Hit_ID=Q2HSI4; Match level="QueryCoverage=62%, HitCoverage=52%, E-value=2e-10, Identity=35%"; Hit description =Putative uncharacterized protein
MARTRGLGRAIGRVIGRDRQDDHDDVPERRRPTASARRQRVHQMTQDVLVEDAPDIAEDAPEMTADVQGADGAEGSHADDAEGFPGGPRDPSVLTSFADHVAHAVWSGQERPDLKLVSHGKKVTLIGRPVPEIEGLVGAIGLSPLIDCSVVTGDPGLVSAFVEKWHSETNTFHLP

SEQ ID NO: 182398 - protein, 227 aa, Glycine max
  Coding DNA Sequence Number=SeqID_90713
  Homolog annotation: Hit_ID=A5CA85; Match level="QueryCoverage=60%, HitCoverage=24%, E-value=6e-12, Identity=34%"; Hit description =Putative uncharacterized protein
MAQPPPREKTLREMVAPNFTYESLCIQYPHEDVPYVLKTGLIHLLPKFHGLAGEDPHKHLKEFHIVCSTMKPLDVQEDQIFLKAFPHSLEGVAKGWLYYLAPSVENDAIVIRGVHEVATNSSSSGETKKLEGKLDALVNLPEAYAANIYNRPPQPQQQNQPQQNNYDLSSNRYNPGWRNHPNLRWSNPSQQQQQQQQQQPYFQNVAGPSRPYIPPPIQQQQQQQPQK

SEQ ID NO: 182399 - protein, 27 aa, Glycine max
  Coding DNA Sequence Number=SeqID_90714
MSARKDDRSRLQRFWMTPLPVKEDKSG

SEQ ID NO: 182400 - protein, 129 aa, Glycine max
  Coding DNA Sequence Number=SeqID_90715
MRARARVMSEIEEVQEQMMTDMEAMKEKMTTMMEAIMSMRRMVEVNAATVVAASTATEVAPTHPPGFNQVQNKHSFPPYGLPPNYTPPNVAHTPDENVDNSAPIPIESQQPQSDHAHVSQSMGETHEAP

SEQ ID NO: 182401 - protein, 78 aa, Glycine max
  Coding DNA Sequence Number=SeqID_90716
  Subcellular localization annotation: CTP_CleavageSite=32; ConfidenceScore=5.44e-01
MDNHSGISACHVTPGSVCVATYPSAGGRRVTRGMRVPRKEYARSRHQRLFEENVRKTRKDAIYELLSERLGSCIYARG

SEQ ID NO: 182402 - protein, 20 aa, Glycine max
  Coding DNA Sequence Number=SeqID_90717
MNRFFWTMETSAGLWQPAMA

SEQ ID NO: 182403 - protein, 153 aa, Glycine max
  Coding DNA Sequence Number=SeqID_90718
MAYPWWDDNKVKSNEDHKGKMKEQNQPGKSHNEHGYISGYVKGYVSCYEHGYKHGKSECGDDLLESHIGYELSHGHNSDDGYEYDYYSDYSEDDYEYDSESDYNESNDLESDYGGSNSSGSSSECDDVVLESHHGYEHGHGYGYNDDLLEYHN

SEQ ID NO: 182404 - protein, 189 aa, Glycine max
  Coding DNA Sequence Number=SeqID_90719
MKIDESERGNTSNEKGLVQFFSVEMPNIVKLMLAAGVSLSEACALSENHALSKALNSLSELGESGGESEKHMGALSASSACSARRLSLPTLSAPSSLSGYSLTRAKHENGAKRAFKDRKPFLRLKLEKSREEVSKESVDWNVESITEAKNRARKPKTSAFKRILGLGVISRFLEVEETSPPLCNLLFSS

SEQ ID NO: 182405 - protein, 199 aa, Glycine max
  Coding DNA Sequence Number=SeqID_90720
  Gene Ontology: Mol. function=phosphotransferase activity, alcohol group as acceptor; Cellular component=cytoplasm; Biological process =isoprenoid biosynthetic process
  Homolog annotation: Hit_ID=Q2HTL9; Match level="QueryCoverage=63%, HitCoverage=32%, E-value=1e-37, Identity=63%"; Hit description =Mevalonate and galactokinase
MALLWEKDLDLVNKLAFKGEKIIRGNPSGIDNTLPPLFGNVIIFKSGNLTHLKSSVSIKILITNTKVGRNTKAFVAGVGERMLRHLDIMAFVFSAIDSINNELISILKSPTPNDLLVIEKEEKIEELMDIDLNATLSCVNDCLPNNEKGKKAGVIPNRIIDLEIGVEDNLNHQVTSVPSPKYYLDLTPEVHTIKKSWFN

SEQ ID NO: 182406 - protein, 145 aa, Glycine max
  Coding DNA Sequence Number=SeqID_90721
  Homolog annotation: Hit_ID=A7PB81; Match level="QueryCoverage=100%, HitCoverage=19%, E-value=3e-24, Identity=40%"; Hit description =Chromosome chr16 scaffold_10, whole genome shotgun sequence
MKSLGSTLHEVSTEAREAKENLLHIQPESESYDAHIEDLKLVLKSTNEKYNSMLDEAEWEQREVQLVSCIKKNEEENVSLEKEIKILLYLLKETEEEANAKREEKAQLKEKLKEVEAEAIQLKEALKETTTDNMELKENLLDKEN

SEQ ID NO: 182407 - protein, 217 aa, Glycine max
  Coding DNA Sequence Number=SeqID_90722
  Homolog annotation: Hit_ID=A5BSR3; Match level="QueryCoverage=77%, HitCoverage=56%, E-value=5e-08, Identity=28%"; Hit description =Putative uncharacterized protein
  Subcellular localization annotation: CTP_CleavageSite=2; ConfidenceScore=5.06e-01
IMASPPASPPPPPPSAPSDASASPPLGAERPVVHVDPATGKADGPHRKKLRTYLGIVSRDKVDVTYENWKEAEFEILEASDSRMKRKLLQTVGERWRQFKSDLTRKWALAADQDDPSWEDVRKKAQAIQKQNIAPHVLSHGGSVDGVIDPPSPVRRHVTWKMARTKKTREMTTEAAKEIAEKIDVLTAAIGRPEHPGCVCAAGAGVTIKQYFGSAPR

SEQ ID NO: 182408 - protein, 38 aa, Glycine max
  Coding DNA Sequence Number=SeqID_90723
MGNCSMKGTTGECHHSIRVMCDSGSCFSTFARATEFKL

SEQ ID NO: 182409 - protein, 100 aa, Glycine max
  Coding DNA Sequence Number=SeqID_90724
MLANPKTSYQAVVSLHFVPPWQCLVFSSIYGQQEQAQEVAPVCIKNKLKRLLKRLALTDPVKLLQEHNKGLDETYLREVAKEKKYRLVTMLECDEHDARP

SEQ ID NO: 182410 - protein, 80 aa, Glycine max
  Coding DNA Sequence Number=SeqID_90725
MSRCFTTSDVGYCIFYSDEDMTKSKGKDPLEGLEGPMTRARARKAKEALQQVLSILFEYKPKFQGEKSKVVSCIMAQMED

SEQ ID NO: 182411 - protein, 105 aa, Glycine max
  Coding DNA Sequence Number=SeqID_90726
MKPPDVQEDHIFLKAFPHSLEGVAKDWLYYLAPSCPHHQISEQFLLQYLFEGLCNMERSMIDVVIGGALGDMTPVEARNLIEKMASNSQQFSARSDAIVLEECMK

SEQ ID NO: 182412 - protein, 124 aa, Glycine max
  Coding DNA Sequence Number=SeqID_90727
MEEYMKTMMIFLVSGKYVALQLCDDEDVETMIGSFQQQQQMSVLELYVEKDVAGGSIFHAANSVTSCGHNVSHHESELPRNISNLHDDEDDDDDDYLASNSYVEESFDEGDSVDGISDTDGGIL

SEQ ID NO: 182413 - protein, 115 aa, Glycine max
  Coding DNA Sequence Number=SeqID_90728
MEWFFRISHPFVTRTEETVAPRHPPPPHHEEFVEPPIPEVLVATDLSTHSVVHCEGCQGMAQDLGAIVEDLERVINLRMVTEGTDLHDSMTRCLRRARGDTADGSLRPRQRRRID

SEQ ID NO: 182414 - protein, 138 aa, Glycine max
  Coding DNA Sequence Number=SeqID_90729
MVGVRELVKQRQPRDGMRGTQYAEVVAQRLRITGNIENTRIGLHHLHRLVIQPAARRIDKDGLALIAIEIDAFQTVKAAHAVHRLGKLFGCHTNNLHVVDVVGRDVVLRRSHRRFGDFRRQYAAEVTRQRQRKVAIAT

SEQ ID NO: 182415 - protein, 217 aa, Glycine max
  Coding DNA Sequence Number=SeqID_90730
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=ATP synthesis coupled proton transport
  Homolog annotation: Hit_ID=A6YE89; Match level="QueryCoverage=99%, HitCoverage=41%, E-value=7e-94, Identity=83%"; Hit description=ATP synthase F1 subunit alpha
  Pfam annotation: Domain name=ATP-synt_ab_N; Domain location=24-92; Score=86.4; E_value=8.9e-23; Accession=PF02874.14; Description=ATP synthase alphabeta family, beta-barrel domain
  Pfam annotation: Domain name=HAS-barrel; Domain location=24-90; Score= 50.3; E_value=6.7e-12; Accession=PF09378.1; Description=HAS barrel domain
  Pfam module annotation: Pfam domain module=ATP-synt_ab_N::HAS-barrel; Domain location=24-92::24-90
MALHLSEMSTLLEQKILKSYSKLNIDEIGRVLSIGDGIARVYGLNKIQAGEMVEFESGVKGMALNLESDNVGVVLFGSDTAIQEGDIVKRTGAIVDVPVGKGTLGRVVDALGQPIDGKGPLTDVKRQRVEVKAPGIIARKSVSEPMQTGLKAVDSLVPIGRGQRELIIGDRQTGKTAIAIDTILNQRAVNSGENGSGQKLYCVYVAVGQKRSTVAQL

SEQ ID NO: 182416 - protein, 136 aa, Glycine max
  Coding DNA Sequence Number=SeqID_90731
MVAATKANPLVFLKGRLYTHRFHRFHSVSKALHPIGLTGLTGLPGAGITGLPGAGLTGLTGAGLTGLKGQSSQDRGRGPRPRAFSLNGPTPKGVQSEGQGPCPVQRNAEPLGGKGVPLDGQGPMPKGVSLNGPFIP

SEQ ID NO: 182417 - protein, 227 aa, Glycine max
  Coding DNA Sequence Number=SeqID_90732
  Gene Ontology: Mol. function=isomerase activity
  Homolog annotation: Hit_ID=Q57GA7; Match level="QueryCoverage=53%, HitCoverage=44%, E-value=5e-25, Identity=47%"; Hit description =Putative uncharacterized protein
TRIIQELEKDHQLTRTKGPSPVKQLQKQKKLTRNEKMMQDRTGEKPSKKVIQEAIDAILTFFDTITIEDFIYELKKQNISASANIASTGKMNGFSFEHRGVAFKASQLSKAYSWSNISKRIIVTLPMDAVAPVSFTANENVSTPIEVQPTATSHTAHSSDHTRPRWLQWIPYLDEFLSSMKALGSTILKPAKKAALIKKIMDENPKPMQFSEVNSQDLVRKSHFKPV

SEQ ID NO: 182418 - protein, 58 aa, Glycine max
  Coding DNA Sequence Number=SeqID_90733
MGVIVLRFGCSEDDAVRLTDELLFCIDSKASTYSQFLFIGFFDAPFVLTFARGGHIEF

SEQ ID NO: 182419 - protein, 83 aa, Glycine max
  Coding DNA Sequence Number=SeqID_90734
MKLAKYRLKAQVEKDEGPSGDGQSPRVEKDEGPSNPCGVYPDLSSFTGSGVYPDLSSFTGSGVIQTFVACIKRSAPTQELKRE

SEQ ID NO: 182420 - protein, 191 aa, Glycine max
  Coding DNA Sequence Number=SeqID_90735
  Homolog annotation: Hit_ID=A7UQU7; Match level="QueryCoverage=75%, HitCoverage=25%, E-value=8e-19, Identity=38%"; Hit description=IMP dehydrogenase/GMP reductase, putative
  Pfam annotation: Domain name=DUF1723; Domain location=125-174; Score =45.5; E_value=1.9e-10; Accession=PF08330.1; Description=Protein of unknown function (DUF1723)
MFRSSDTGNRLLPSGNRLPESITLWQQETAPVAEDDPVLTEDVHAHAKEVVDNAEGFPGGPRDPSVLTDYGDHVAVIVWNKEERPELKLSSHGRKVQKFERPAPEIEGLVAVTGLSPLIACSVDTGDRGLISTFMEMWHKETSSFHLPIGELTITLDDVASLLHLPTIGAFYSFEPLQVDEAVLMLVELLE

SEQ ID NO: 182421 - protein, 244 aa, Glycine max
  Coding DNA Sequence Number=SeqID_90736
  Homolog annotation: Hit_ID=UPI00006A2D9E; Match level="QueryCoverage =72%, HitCoverage=96%, E-value=1e-14, Identity=20%"; Hit description =UPI00006A2D9E related cluster
SLDTVATRRVVTLHVLAIRGLHILAFRGLHVLTFRELHALTGRELRVLPLMWLHALAFRGLHVVAFRGLHALAFRGLHALSFRGLLVLTFRGLHALAFRGLHVLTIRGLCVLTFKGPHILTFRGLHVLAFRGLHVLAIRGLHALTFKGLHVLAFRGLHASPSATRPHLKRSTHPHLQRATCPRLQRITRPHLQKATRPRLQIATRPHLRGLYVLTFRGLHILTFRGLHALAFKGLHVLTFRRLH

SEQ ID NO: 182422 - protein, 73 aa, Glycine max
  Coding DNA Sequence Number=SeqID_90737
MTSKNLPRWSECILPRSHLKIDATEQMNRVDSKRIRSRGLPRIRNEKWRNRQESDEKPKKEGRKLGNRNEIGE

SEQ ID NO: 182423 - protein, 162 aa, Glycine max
  Coding DNA Sequence Number=SeqID_90738
PGHFLYYTGSRIGHPGPSIALIGALSWSSLALAPLTDLRPPDQVPQQEGGWRSHDSEIGLRGYMRRSFSRRVSGPFRRSLVFAMKSTIQMDLRMRSQTALPGLTARKLPENEPGHVLPCISLEPQKVSPRSSLLWLNTSLTYAKESSSENKHPGWLSSSEAP

SEQ ID NO: 182424 - protein, 387 aa, Glycine max
  Coding DNA Sequence Number=SeqID_90739
  Homolog annotation: Hit_ID=A0TWN6; Match level="QueryCoverage=28%, HitCoverage=8%, E-value=9e-17, Identity=47%"; Hit description =Putative uncharacterized protein
CFQLRSGGLHRLAQHPQFGLVAADVLAQFSQRLLGFIARLVQALRQLALVLDLLFQARQRAADLVDRRLRGVERIGGLFAAYPRGLDAGLGVALVGDQLLQLGLFLREAFAQLRQASVETTEFQRLPLGILDPALFLQRLVLLGLLGLALQVFELLADLVAQITQTVQVFAGVADAGLGLLAALLVFGDAGRLFQVDAQVFRACLDDLADHALLDDRVAARAQAGAEEQIGDVAAAALGAVEVVVAGTVAADRALDRDFVERGVLARDRVVGVVEDQLDRGLRDRLAGVGTGKDHVGQRVAAQAAGRTLAHDPAHGVDDVRLAAAIGPHHAGHVGRQVQGGRIDERLEAGQLDRGKTHRGSGLGPASGLRLPSKPLILLGSMPVERV

SEQ ID NO: 182425 - protein, 98 aa, Glycine max
  Coding DNA Sequence Number=SeqID_90740
MAVEELNEKQLESPVEEVVTNVDGFSGGPHDTSVLKDFENHIDLREHPELKLSSHGRQMAKFGRLASEIEGLVAASGLSPLIAYSLDTGVEAKLQELF

SEQ ID NO: 182426 - protein, 78 aa, Glycine max
  Coding DNA Sequence Number=SeqID_90741
MHLAVAPLVRASIVVVSTYYMHHKTPAQLLVFMHMVEREADGGNGDPNVKSPTTYLKKLFVSSGIYTALNLYTPNFEP

SEQ ID NO: 182427 - protein, 722 aa, Glycine max
  Coding DNA Sequence Number=SeqID_90742
  Gene Ontology: Mol. function=sequence-specific DNA binding; Cellular component=nucleus; Biological process=regulation of transcription, DNA-dependent
  Homolog annotation: Hit_ID=A7QJZ6; Match level="QueryCoverage=96%, HitCoverage=96%, E-value=0.0, Identity=78%"; Hit description =Chromosome undetermined scaffold_109, whole genome shotgun sequence
  Pfam annotation: Domain name=Homeobox; Domain location=25-81; Score =83.3; E_value=8e-22; Accession=PF00046.20; Description=Homeobox domain
  Pfam annotation: Domain name=START; Domain location=224-448; Score =208.1; E_value=2.1e-59; Accession=PF01852.10; Description=START domain
  Pfam module annotation: Pfam domain module=Homeobox::START; Domain location=25-81::224-448
MEFGSGSPGDHHHHHDGSSDSQRRKKRYHRHTANQIQRLESMFKECPHPDEKQRLQLSRELGLAPRQIKFWFQNRRTQMKAQHERADNCALRAENDKIRCENIAIREALKNVICPSCGGPPMNDDCYFDEQKLRLENAQLKEELDRVSSIAAKYIGRPISQLPPVQPIHISSLDLSMGTFASQGLGGPSLDLDLLPGSSSSPMLNVPPFQPACLSDMDKSLMSDIASNAMEEMIRLLQTNEPLWMKGADGRDVLDLDSYERMFPKANSHLKNPNVHVEASRDSGVVIMNGLTLVDMFMDPNKWMELFPTIVTMARTIEVISSGMMGSHSGSLQLMYEELQVLSPLVSTREFYFLRYCQQIEQGLWAIVDVSYDFPQDNQFAPQYRSHRLPSGVFIQDMPNGYSKVTWIEHVEIEDKTPVHRLYRNLIYSGIAFGAQRWLTTLQRMCERIACLMVTGNSTRDLGGVIPSPEGKRSMMKLAQRMVTNFCASISASAGHRWTTLSGSGMNEIGVRVTVHKSSDPGQPNGVVLSAATTIWLPIPPQTVFNFFKDEKKRPQWDVLSNGNAVQEVAHIANGPHPGNCISVLRAFNSSQNNMLILQESCVDSSGSLVVYCPVDLPAINIAMSGEDPSYIPLLPSGFTISPDGQADQDGGGASTSTSTGSRVMGGGSGPGSGGSLITVAFQILVSSLPSAKLNMESVTTVNSLIGNTVQHIKAALNCPSS

SEQ ID NO: 182428 - protein, 67 aa, Glycine max
  Coding DNA Sequence Number=SeqID_90743
  Pfam annotation: Domain name=zf-CCHC; Domain location=47-64; Score =17.6; E_value=0.0033; Accession=PF00098.14; Description=Zinc knuckle
EEEMLVMEMGESALLTTAFGKNKTTKSQANQKGNGKVPPQADIKKVTKCFFCKKKRHMKKNCPRFQK

SEQ ID NO: 182429 - protein, 520 aa, Glycine max
  Coding DNA Sequence Number=SeqID_90744
  Gene Ontology: Mol. function=zinc ion binding; Biological process =intracellular signaling cascade
  Homolog annotation: Hit_ID=Q2HTA0; Match level="QueryCoverage=67%, HitCoverage=63%, E-value=4e-31, Identity=29%"; Hit description=IMP dehydrogenase/GMP reductase, related
  Pfam annotation: Domain name=DUF1723; Domain location=174-223; Score =44.0; E_value=5.1e-10; Accession=PF08330.1; Description=Protein of unknown function (DUF1723)
MHGVRVYYTDVNKNDLFLRFLNQGLLTIVSQIHKDEQIMIRTRGLGRALGQRRRRTASTRRQRVTVTADHVDEPVIPDPDIQDDPMEAPAAVEDIPADAGAEAAKDQHQGFPGGPSDSSVLTAYADHVACSERPELKLSSHGRKVHSLGRLVPAIEGLIAGTGLSSLIACSVNTGDRGLLSAFVEWWHRETSSFHLPVGDLTITLDDISSLLHLLVIGDLYAFQPLHVDDAVQMLVDLLVVSPESARAETVQCREPYVRLQWVHDIYQRRCQAGHWTAAACAYLRHLLGCTLFANKSATNVHVVYLEALRDLSMTERYAWGVAPLVHMYDQLNDVDCDEEDREENSHAVVQGAPGSTPDSGCLLDPLWGASGERVVRQFGYTQTIPAPPIDSWVSYDDIHDRWMHYEDHIVPAGEVCVVPGACSSDYIDWFFCISHPFMTSGHALDPLPHGHAPQPRVVPEAPQTDIPRVPEPGASSTSTEEPRHSVKVCDDITERLERHLSPGVVTPGSSTHEVIEECL

SEQ ID NO: 182430 - protein, 85 aa, Glycine max
  Coding DNA Sequence Number=SeqID_90745
MEGEAKGCGCWKGEGRLLVSEGRGKATGAGREGGEGRSCEGEKEGEKSSTKKKPRVAFAMEEDTHIISSWLDSLTDQIVGVGQRK

SEQ ID NO: 182431 - protein, 303 aa, Glycine max
  Coding DNA Sequence Number=SeqID_90746
MHRSPTGNLVPLDLEIEATLRRNRAKRRRKLLQDRTIASILEEQTHFSDSLSPGSPSSRESATQLPETTIMANEQHQRITLEDYSSSSVPQFFTSIAHPKVQAHNINYPHCLIHLIQRNLFQGLSNEDPYAHLAMLQVVPFVVRLMKQANVFPLKKTLKKFIIWEINSDKGILKEAFQASRPIQQGPYIFQRTTKLEETLTQFMHVTMSNHKSTESTLKNLEVQVGQLAKQIADKSSNSFVANIEKNPKEECKAVMTRSKRFVEAEDEETVVHKKKAAEKKGTDGKKNDVRGESNQEKEKQIM

SEQ ID NO: 182432 - protein, 183 aa, Glycine max
  Coding DNA Sequence Number=SeqID_90747
  Homolog annotation: Hit_ID=UPI000065F7CF; Match level="QueryCoverage =67%, HitCoverage=18%, E-value=6e-08, Identity=33%"; Hit description =Homolog of Homo sapiens "Leucine-rich repeats and IQ motif containing 1
  Subcellular localization annotation: CTP_CleavageSite=54; ConfidenceScore=5.09e-01
MSSSSEDYMSSPLEGYTPSAPRTIRPHLQRTTYSHLQRATRPRHQRTTRPHLKRATRPRHQRTACPHLQRAARPRHQRTACPHLQRATRPRLQGYTPSAPRTIRPHLQRTTCPHLQRATRPRLHRATRPHLPRTTCPHLQRATRPRLRRATRPHLPRTTCPHLQRATRPRLRRATRPHLPRTT

SEQ ID NO: 182433 - protein, 94 aa, Glycine max
  Coding DNA Sequence Number=SeqID_90748
MLLWCLALRPSGGAVLLDESSISRGPDALAGGDRVVMLVRMIHTRLFATARVKSCPGMHSSCVIASLSGCARTVGPPPISGGGPGTVKRKLLVP

SEQ ID NO: 182434 - protein, 95 aa, Glycine max
  Coding DNA Sequence Number=SeqID_90749
  Homolog annotation: Hit_ID=A6FJQ2; Match level="QueryCoverage=40%, HitCoverage=84%, E-value=2e-11, Identity=92%"; Hit description=50S ribosomal protein L5
MTLTYKNRRITRPFRLARFGDDGETSDTCSSRRRHSLSMRKEKIPHQAPFAIQAAQLLGRAIGAGLFAITPAGERGMCCKAIKLGNARVFPVTTL

SEQ ID NO: 182435 - protein, 216 aa, Glycine max
  Coding DNA Sequence Number=SeqID_90750
MVLKEELAVCSRSKRNLSQHLCETETNMLAIITKYQEELSLATTHEHRVADEFAQVYAEKEARGRVIDSLHQAATMWMDRFALTLNGSQELPRLLAKAKAMADTYSAPEEIHELLDYWKNTITKRAPRHPYRTRSKSRTMGDQEETREQMKANMSALKEQMASMMEAMLGMRQLMEKNVATAATVSSAAEADPTHLATAHHPPPNAVVLVLSFTEL

SEQ ID NO: 182436 - protein, 368 aa, Glycine max
  Coding DNA Sequence Number=SeqID_90751
  Homolog annotation: Hit_ID=Q2WEK8; Match level="QueryCoverage=80%, HitCoverage=57%, E-value=3e-50, Identity=41%"; Hit description=MchC protein
LIEENNRHAIFDDGTPLLNDEKVFFAERYGGGAISRNGGGARCGFDGRWQVKGIGANALVGQGAKHVDGELTMTGAVLEALWGNVMAKLLPYGAVPNKAILLTDNPIATLSPASAGDVHNRKALLVREPVVRPAHFCRAPYYHPHDAMQRQPSDIERTEKLIVAAPSFLPRPSEFDAVRWLALPQEERAFYGLCELARRLATQIAYCRTRHLVMMTSPSNCDMAGRLLDFHGVRSVFPAERRDPGRSYIQHNKLNEDAPLLLRGMQDLAFYLAKHQFGPAFLAAAHQGIGAAFSMAYKRACLLDNLGMAGFAPAFLQRLPLTAEWFALGERLQKMFDLAPGVFSRRQGLGQGNAHPAIALLHRLIDSP

SEQ ID NO: 182437 - protein, 268 aa, Glycine max
  Coding DNA Sequence Number=SeqID_90752
EIVVGALDRRLVAGVQPLGAQSALLFAPGRAEGAHLLGAHARQRLPDRVGVPRPLAGIGAAAGAGNRRIDQHQPPHAGGLQNGGAQGEAGAHRMAEQGVTVQAQRGGEGVDVLRAGLRVISQFRAAGRQTAAAHVEHVDVVFFPQPLGDETPGSAPGRGRRSAALARTGHSRRPRPDLPGCAGRCWRWTPPAPWMRVPCGWLHTAGRRCGSRRGRFPAGSGSAWRRLRSPSPRPAPYAASSGGRHRRAAPGGPRSTAAAVCGSAMAIW

SEQ ID NO: 182438 - protein, 266 aa, Glycine max
  Coding DNA Sequence Number=SeqID_90753
ECEYGQRRNQADGFDEEAIAQLLCIPGQDFAWTAAGRRVLIMRTNMTTLTQTWMTLLLSNILPSDHNSDLPLPKCQLVYAILTRMNIHVAQLIADAIYLFVGMPPTRYLLDPDKSNRALGFSTLITGLCQSFRVPVTPSKVIRLPITRAFIEKYYTPRQAQGGDPQAPDAPPPPPQANPAGRPTTGRTLQTHDCLYQLNLSLQSQGFPPFPCPTPDQFRAEVAWPGDWPEAQAGEAPAEAPGDADEARMDEEMTDLLDFLGGSKAT

SEQ ID NO: 182439 - protein, 94 aa, Glycine max
  Coding DNA Sequence Number=SeqID_90754
MDFKPMLVKGLMLWNNKWTCDLTRWTQGSPRIVIIKKGEIVEASFMMMNQRIQDSRKVDFKIQEKTSRRIKIQEKMNSREEIKKQQVKTSHGKY

SEQ ID NO: 182440 - protein, 69 aa, Glycine max
  Coding DNA Sequence Number=SeqID_90755
MDQLKRLSIPSEMLRFSNHACHPRLGHPTRSVHFAPHKHTQHPMYERGPKQEPKTVEGMTTFRACACFI

SEQ ID NO: 182441 - protein, 325 aa, Glycine max
  Coding DNA Sequence Number=SeqID_90756
  Homolog annotation: Hit_ID=Q6WAY6; Match level="QueryCoverage=76%, HitCoverage=40%, E-value=3e-08, Identity=24%"; Hit description =Putative uncharacterized protein
MGMRGYISYNPVLAIRQLGYPMRGAPLEEEIVPVISRGFNKTNVETLQKVRKPWEVLQKKDKELRGSNNGPIGGYREWLKAHVQGLDWLPSLRTTKREEDKAPEEDEEVQALRTELKQAKTVKERFKSAALKIRKENAELRDVNMATTKALEQETKRAHREEHGRNKFRGALWDSNSELKLQREERDQSRVDSLILKDELKACSRSKRSLSQWLCETETNMLTIITKYQEELSLATAHEHRVADDYAQVYAEKEARGRVIDSLDQEATMWMDRFAFTLNRSQELPRLLAKAKAMADIYFASEEIHGLLSYCQHMIDLMAHIIRNR

SEQ ID NO: 182442 - protein, 46 aa, Glycine max
  Coding DNA Sequence Number=SeqID_90757
MKHSSKLEGGGHMNSARHDIHGAPKKQSRSIASKLEGGGHMNSARQ

SEQ ID NO: 182443 - protein, 99 aa, Glycine max
  Coding DNA Sequence Number=SeqID_90758
  Homolog annotation: Hit_ID=A5AKY6; Match level="QueryCoverage=84%, HitCoverage=7%, E-value=2e-27, Identity=71%"; Hit description =Putative uncharacterized protein
MALEEGKIEDYLYQKKLYQPLSGVKPDDMKQEEWNLLDRQTLGVIRFTLAKNVAFNIVNEKTTASLMKTLSDMYEKPSATNKVYLMRRLFCWIKWPRNN

SEQ ID NO: 182444 - protein, 99 aa, Glycine max
  Coding DNA Sequence Number=SeqID_90759
MSISPCRCIGPRVCSGRDRAYKTSSGPEAVQQGLRVFYGVPVTSSKGIRPPTNRDFIKKYCVPRQAQGEIPPQPGDGRQRATDAPPSPLGFTSAHPQKG

SEQ ID NO: 182445 - protein, 186 aa, Glycine max
  Coding DNA Sequence Number=SeqID_90760
  Homolog annotation: Hit_ID=Q6WAY6; Match level="QueryCoverage=51%, HitCoverage=16%, E-value=4e-09, Identity=32%"; Hit description =Putative uncharacterized protein
MEHTSEGARRVVHGSSAAYPLFVYGSRTINWFPRWKEGNKGVLFSCGDYPNISLIGMRGCINYNLALAIRQLGYPMRGAPAEESLSPFLVRDFGAQSFKIIQRVHKAWESPLRKGKELMGIRNGIIGGYHEWLKVCTRGLDWLSKLKIINEENFEAPEEDEEVRALKTELGKARLAKEKFKLVATE

SEQ ID NO: 182446 - protein, 75 aa, Glycine max
  Coding DNA Sequence Number=SeqID_90761
  Homolog annotation: Hit_ID=A5C693; Match level="QueryCoverage=56%, HitCoverage=19%, E-value=2e-09, Identity=61%"; Hit description =Putative uncharacterized protein
MKFGYLSHKLDHVGIFEEESGCSKHMTGDASKFTHISPKKNGHVTYGDNNKGRILGVGKIAKMMIHGYGIKELLT

SEQ ID NO: 182447 - protein, 99 aa, Glycine max
  Coding DNA Sequence Number=SeqID_90762
MKNTEERSKTFAKSLTETLRKRYGSASAWIFFTETIFLSKFERERKNWGRSLPPSSPRRAGLLPPEATAFWRNLLEGPSGLDFYLHPHFLLSTPPAFFL

SEQ ID NO: 182448 - protein, 172 aa, Glycine max
  Coding DNA Sequence Number=SeqID_90763
MTGVSLVGSHGGKKEGQECYAHKIHKAWNRVGRKDKELRGSSNGVIGSYHKWFKSKTRGITWLPKQKSLSGKEVEVLEESEEVHALKVELEKTRVVKEKLKTTITRVKKECDEMKDVNMTTTEALERETKRAQKEEWSRNKFRRALWGSSNELKLRKAERDKSRIESMVLED

SEQ ID NO: 182449 - protein, 434 aa, Glycine max
  Coding DNA Sequence Number=SeqID_90764
  Homolog annotation: Hit_ID=A5BAL1; Match level="QueryCoverage=90%, HitCoverage=85%, E-value=6e-47, Identity=35%"; Hit description =Putative uncharacterized protein
  Subcellular localization annotation: CTP_CleavageSite=63; ConfidenceScore=5.66e-01
MKLLTSSSSSYSSTPSSSSSLSLDPSLCNSKSVTAGCLTAILRRILCSGGLPTHPSDQIRELDSMSKMSGKVQELKTKQNTESTTTVTFSTTTTTTITRGIVERLMGLESMVERDTNTTNEATSSSSLPRSKSMNSMDYLGEYKRMEGLHKRAKSSSFREVPTFHLHENENFLVLSFESGCDGGEFRSQKGIKKEKASKERSELKKNKREKVHDEKEKGNLSDMSSANVGKHGLEFANTSALFMACSEKEYVGSETERFSHPVKRKEVTNDEKVKRKKKGTTCYAEEKVDTECSSEDSSPVSIFDFERQAPGTEVDSFGVDTSWRRKLSPELENEQLDNLMIEEMKVNTIEDNKHEGSKKNEKQSQECVDIWGEICRLVEGELGSNKLEEGLWKQDDIESVCAGFESQIFYHLLYELIDQLVGNPLKALQLQNL

SEQ ID NO: 182450 - protein, 241 aa, Glycine max
  Coding DNA Sequence Number=SeqID_90765
MLWKLGRIDGDPVLRKMRIWATWEYVSSVGEWYLKICHGGQETLGTSGGVLLPKTKLDQSRPNPGIVGQLENEVRKLGELLVIDYQASKGNWNTVEASGNRLPDCVIDYTEEWVTGNRLPDELARTLQRTVEWILPTPTPYRLVEPVQVIEVTSSEEDPEEDPKELPPEPAADALDFLEGDEDPLLEVDSPEEVMSASKADSTEDSGLGEMAISGGSLSQWTALWISFVYFFRVGVSRTDC

SEQ ID NO: 182451 - protein, 1186 aa, Glycine max
  Coding DNA Sequence Number=SeqID_90766
  Gene Ontology: Mol. function=protein binding; Cellular component =cytoplasm; Biological process=protein metabolic process
  Homolog annotation: Hit_ID=A5BFH6; Match level="QueryCoverage=99%, HitCoverage=99%, E-value=0.0, Identity=38%"; Hit description =Putative uncharacterized protein
  Pfam annotation: Domain name=AAA_2; Domain location=816-968; Score= -17.9; E_value=0.00025; Accession=PF07724.5; Description=ATPase family associated with various c
MPTPVSVVRQCLTDEAARALDDAVAVARRRSHAQTTSLHAISALLALPSSALRDACGRARSGAGAGTSAARFSAAYSPRLQFRALELSVGVSLDRLPSSKSTSAGEEEPPVSNSLMAAIKRSQANQRRHPESFHMFQQSQQGTASTSFLKVELKHFVLSILDDPIVSRVFAEAGFRSCDIKLALLQPPLPPVQHRFNWSPPVFLCNLDPAQPDENIRRIMEVLARKNKRNPLLMGVYAKSALKGFVEMVRNGRGGSALGSELRVVRLEREIGEFVKKGGSGEEKFGVRLKELEQQCEGSGSGVVVSFGEIEVFVGEDVDVDVVRFVVSGLTRLLEIRGEKVSLLGVAETSHAYSKFLGLFPNVENDWDLHLLTVTSATPSMEGLYSKSRENGDVYYSGSCTLIRVNNNINVTEFREEQCKIVAWGSQAWWRPCTNKWWECRFEFNKCMDGRDEQYFDEWFDSISALQGLFSLSLMGSFVPFGGFFSTPEIRSPVSCANGSFTRCDTCNKKCEQEVADLLKVDPSSSYSTSSHWLQKVVNMDAHRGSDVAKKELHHPVQTNEENTSLNDKILGFQKKWSDICQRLHHTSSLPQFDISQTRSQAPTVEVLRFGLAFKESSNKDPSHSEFQYSSQISCMPKELHSIFPSKQLSVPLPSDTVCINTGTDHVPKVSETLQIHMNTPWVAPSLMANKSALDHRSSSFRTPVTTDLGLGTLYTSTAQDPDTPKLQDQRKHLQHLSDSVSTDCDGMNENTSHRIARFSCSGSNLEGKFDLADFKSLDRLLTEKVGWQDQAICAISQTLSLCKSGAGKRRGSNGRADIWLAFLGPDRLGKRKIASVLAETIFGNPESLISVDLGFQDSFYPLNSVFEYQKSRCYDVLRRKTILDYIAGELSKKPHSVVFLENVDKADVLVQNSLLQAVRTGKFSYSHGRVISINNTIFLVTSTVCKGNGSFVLEESKMFSEERILEAKRCQMQLLLGHASEDAGRIGSTNVKVVPGKGFSKSSSLNKRKQADISDSKEGATSKMQKQDSEASRSYLDLNMPVEDGEEGVNDDHESESITENTDAWLSDFFDQIDEKVVFKSFNFDELAEEVLKRIGMLFQRTFGSELQLEIDYEVITHILAAAWLSDKKNAVEDWVEHVLGKGFVEAQQKYLPAAQYVVKLVNCESIFVEEQAPDVCLPARINTD

SEQ ID NO: 182452 - protein, 59 aa, Glycine max
  Coding DNA Sequence Number=SeqID_90767
MVLMTGRRDGIEDESRKNNGGEGTDSQHNREGKKALMVLWCNMREGGMSEWKNNPKAFI

SEQ ID NO: 182453 - protein, 65 aa, Glycine max
  Coding DNA Sequence Number=SeqID_90768
MVQQDKATGSTHFCRKMKARIHGKEVIQAMDIVDMVVITGMGFKQSNPVGIVMDVMEEFVVYCLW

SEQ ID NO: 182454 - protein, 345 aa, Glycine max
  Coding DNA Sequence Number=SeqID_90769
  Gene Ontology: Mol. function=DNA binding; Cellular component=nucleus; Biological process=response to DNA damage stimulus
  Homolog annotation: Hit_ID=A5BX89; Match level="QueryCoverage=93%, HitCoverage=56%, E-value=1e-143, Identity=76%"; Hit description =Putative uncharacterized protein
  Pfam annotation: Domain name=WD40; Domain location=136-174; Score =20.6; E_value=0.006; Accession=PF00400.23; Description=WD domain, G -beta repeat
  Pfam annotation: Domain name=WD40; Domain location=244-279; Score =4.5; E_value=8.8; Accession=PF00400.23; Description=WD domain, G -beta repeat
  Pfam annotation: Domain name=WD40; Domain location=90-129; Score =15.3; E_value=0.23; Accession=PF00400.23; Description=WD domain, G -beta repeat
  Pfam module annotation: Pfam domain module=WD40::WD40::WD40; Domain location=136-174::244-279::90-129
MRFNPTNDCMVYSASSDGTISCTDLETGISSSPMNLNPDGWQLLDYLDMAKGPNTWKMLNGMDINSEKGLVLVADSFGFLHMVDMRSNNRSGDAILIHKKGKVVGIHCNPIQPDIFLTCGNDHFARIWDLRQIKAGSSLYDLKHKRVVNSAYFSPISGTKILTTSQDNRLRVWDSIFGNMDSPSREIVHSHDFNRHLTPFKAEWDPKDPSESLAVVGRYISENYNGAALHPIDFIDTSTGQLVAEVMDPNITTISPVNKLHPRDDILATGSSRSLFIWKPKEKSELVEEKDERKIVVCGKAEKKRGKKNGNISDESDDEGFMSKSKKSKTKKTESKLSRFTKDNC

SEQ ID NO: 182455 - protein, 317 aa, Glycine max
  Coding DNA Sequence Number=SeqID_90770
  Gene Ontology: Mol. function=transferase activity; Cellular component= endoplasmic reticulum membrane; Biological process=metabolic process
  Homolog annotation: Hit_ID=Q56Y11; Match level="QueryCoverage=72%, HitCoverage=74%, E-value=2e-75, Identity=57%"; Hit description =Dehydrodolichyl diphosphate synthase 2
  Pfam annotation: Domain name=Prenyltransf; Domain location=90-313; Score=316.9; E_value=3.9e-92; Accession=PF01255.10; Description =Putative undecaprenyl diphosphate syntha
  Subcellular localization annotation: CTP_CleavageSite=56; ConfidenceScore=5.54e-01
MLSLTLPIPLLKTLTPPSPNINNPSLSPYSHYQPRSRSLTRGLIVPKHSSATAPPSATLRDDGTSLAGDSPEPLPEELVAELMPKHVAVIIDGHGRWAKLRGLPASAGHQAGVQPLRTVVRLCCSWGIQVLTVFVLSTENWFRPKVEVDSLMKLFETTINSSIACMKKEGIQIYVIGDSSKLPESLRSTIANAEKSTKHNSRLQLIVAMNYGGKYDVVQACKSVAKKVKDGLLHLDNINEKIIEKELETKCTEFPYPDLLIRAGGELRLSNFLLWQLAYTEFYFNKTPWPDFGKEEFVDALRSFQQRQRHYGGERHS

SEQ ID NO: 182456 - protein, 71 aa, Glycine max
  Coding DNA Sequence Number=SeqID_90771
MNSLGVESSMMYFFCGLFVFQLMKLKIWVGIVAGGMFSSWNDTKKSLIILVNEGRPLRAETSRDKKCLTVM

SEQ ID NO: 182457 - protein, 427 aa, Glycine max
  Coding DNA Sequence Number=SeqID_90772
  Gene Ontology: Mol. function=RNA-directed DNA polymerase activity; Biological process=RNA-dependent DNA replication
  Homolog annotation: Hit_ID=A5BKK4; Match level="QueryCoverage=77%, HitCoverage=69%, E-value=7e-15, Identity=22%"; Hit description =Putative uncharacterized protein
MEAFNKFIGDMEAFNKFIGDMEVEDIPMVGRKFTWYRLYESLPTMKSSIMGWGQSLSMCCIAGKVERLKNDLKKWNVESFRDVNKQIKEVVKKLNALDVIDEAEGLDEVEMQNRWSLMGEFWSVSRRNESHLHQKSRVDERWEDEPIKIVKKNFMSMMKEFWENARMPRGANSSFITFIPKKENAQGLDEDRPITLICCIYKVISKVLAKRVKRGGHGFQSRLPKDMTQCHEIFLLYDAEVEVGPFNEFILQRGLGVRRVATKALRCFEMGSRLKHAKLQVDDHLAAGANPRRVPPCVVKRIIKLQRNFLWRGEENKRKIAWVKWEEWRLALDQSSLWAVVLKSKYGKFGNAEVQRSSRNDSLWWRDLVEVCRVGKNKECYDKSVAWKEKCSDSEGAVEMHILPNGGGGYYTFAIQHLERVEREEVK

SEQ ID NO: 182458 - protein, 464 aa, Glycine max
  Coding DNA Sequence Number=SeqID_90773
  Gene Ontology: Mol. function=nucleoside-triphosphatase activity; Cellular component=integral to membrane; Biological process=protein catabolic process
  Homolog annotation: Hit_ID=Q9FIM2; Match level="QueryCoverage=97%, HitCoverage=54%, E-value=1e-139, Identity=60%"; Hit description=Cell division protein FtsH
  Pfam annotation: Domain name=AAA; Domain location=370-464; Score =31.1; E_value=3.2e-08; Accession=PF00004.20; Description=ATPase family associated with various cellular activities (AAA)
  Pfam annotation: Domain name=FtsH_ext; Domain location=166-344; Score= 55.3; E_value=2.1e-13; Accession=PF06480.6; Description=FtsH Extracellular
  Pfam module annotation: Pfam domain module=AAA::FtsH_ext; Domain location=370-464::166-344
  Subcellular localization annotation: CTP_CleavageSite=39; ConfidenceScore=5.27e-01
MSALEYLYLSPLTYTKIYLNSHTWRRRSPLRQNACRFVPNSAVVRVPGQWRDFSGRVDLWRLRRVHGGAARASGGQEGDSGEKSGEGQGVTDKGSTRSGSNRRREKQDKGWWFGSKSGKWRWQPIVQAQEVGVLLLQLGIVVFVMRLLRPGIPLPGSEPRAATSFVSVPYSEFLSKINGDQVQKVEVDGVHIMFKLKSDVEASEVASSAATPSESESLVKSVAPTKKIVYTTTRPSDIRTPYGKMMENEVEFGSPDKRSGGFFNSALLCPTAMPQSKGPLSLGYIALFYCALLAGLLHRFPVSFSQHTAGQIRNRKSGTSAGTKSSDQGESITFADVAGVDEAKEELEEIVEFLRNPDRYIRLGARPPRGVLLVGLPGTGKTLLAKAVAGEADVPFISCSASEFVELYVGMGASRVRDLFARAKKEAPSIIFIDEIDAVAKSRDGKFRIVSNDEREQTLNQLLT

SEQ ID NO: 182459 - protein, 64 aa, Glycine max
  Coding DNA Sequence Number=SeqID_90774
MNGVLQHGDGEALHVTMLGDDEVGFCTRIWLSRVVCTRRDLWVGAYNCGGCGGGVMHGSDVLGV

SEQ ID NO: 182460 - protein, 485 aa, Glycine max
  Coding DNA Sequence Number=SeqID_90775
  Gene Ontology: Mol. function=hydrolase activity, hydrolyzing O -glycosyl compounds; Cellular component=integral to membrane; Biological process=carbohydrate metabolic process
  Homolog annotation: Hit_ID=A7NYK5; Match level="QueryCoverage=98%, HitCoverage=89%, E-value=1e-138, Identity=59%"; Hit description =Chromosome chr6 scaffold_3, whole genome shotgun sequence
  Pfam annotation: Domain name=Glyco_hydro_3; Domain location=27-166; Score=17.4; E_value=5.1e-10; Accession=PF00933.12; Description =Glycosyl hydrolase family 3 N terminal domain
  Pfam annotation: Domain name=Glyco_hydro_3_C; Domain location=268 -480; Score=129.5; E_value=9.6e-36; Accession=PF01915.13; Description= Glycosyl hydrolase family 3 C terminal domain
  Pfam module annotation: Pfam domain module=Glyco_hydro_3::Glyco_hydro_ 3_C; Domain location=27-166::268-480
APHNGRFEKVLVLSSDSADMVDGFQKLALESRLAIPIIYGVDAIHGNSSVYGATRFPHNVGLGATRNNVVACGKHFVGDGGTEKGVNEVDCIAKGVSTIMVSYSRWNGNKLHGHHFRLNEVLKEKLGFKGFVISEWEEIDECQPYGSDYRHCISTAINAGIDMVMVPFRFEIFIEELMSLVQLGEIPIAGTDDAVERILRVKFAAELFEFPLTDRSLLDVVGGKSDQTELVSTSSWCLNNNLIQWRIQKFYLVELHRDLARKTVQKSLVLLKNGKDPSKPFLPLNRNAKRVLVAGTHAHDIGYQCGGWIGTKYESSGQITIGTTILDAVKEAVGNETEVIYEQCPSTDIIERSDVSFAIVVVREGPYAECGGDNSELVIPFNGDGIINLVADKIPTLVILISGRPFLSEQCLLEKIDALVAAWLPVTEAQRITDVIFGDHDFKGQLPMTWFRRVEQLDQPVGVSSCDPLFPLDYGLKYGKENLHD

SEQ ID NO: 182461 - protein, 24 aa, Glycine max
  Coding DNA Sequence Number=SeqID_90776
MAFYSSFDITGVEPKLSNENDARN

SEQ ID NO: 182462 - protein, 705 aa, Glycine max
  Coding DNA Sequence Number=SeqID_90777
  Gene Ontology: Mol. function=ribonuclease activity; Cellular component=cytoplasm; Biological process=carbohydrate metabolic process
  Homolog annotation: Hit_ID=A7Q2X2; Match level="QueryCoverage=95%, HitCoverage=75%, E-value=0.0, Identity=55%"; Hit description =Chromosome chr12 scaffold_47, whole genome shotgun sequence
MNNGSGQFAFSGKSATSVDELCKIIWTVEADLEDGHLLFITGDPAVLGCWKPNMAVLLSPTEHANIWKAEFQGKFGSSSDVLWRPGPAFSLSVPLMVLEDNKIVVRDSWIRSDSQMSSAHAWSPFTEETYLLEQPSISFLSKDDGRIESPLENDVLKFETLLLEDQLLYNNDDMVIANDKDFQSTNVLSENYQPVEEPWLYSFCSVVSNNKMESNVSETGDTAKEKVKLADREQLLLEEILEDEKLVELLLEPVKSNVQCDSVYVGVVTKLVPHMGGAFVSIGNSRSAFMDIKQNKEPFIFPPFRQRTKKQEIDLEGKNDHTSHVIDVSDGTSDINSEDGCLKSVHNDYDEHEGDDDFYISEVLKENVNGSMVDDEVEADFEDDIEGSDVHIEGETNNSSLLLGMNGSVTSHILQTKDTKKATHVTSGENKWIQVRKGTKVIVQVVKEDLGTKGPTLTAYPKLKSRFWVLIACCDKIGVSKKISGVERTRLKVIAKTLQPEGFGLTVRTVAAGHSFEELQKDLEGLLSTWKNIMEHAKSAALAADEGVEGAVPVILHRAMGQTLSVVQDYFNENVKKMVVDSPRTFHEVTNYLQEIAPDLCDRVELYDKKVPLFDEFNIEGEIDNILSKRVPLANGGSLIIEQTEALVSIDVNGGHGMLGHGNSQQQAILDVNLAAAKQIARELRLRDIGGIIVVDFIDMTDEGK

SEQ ID NO: 182463 - protein, 625 aa, Glycine max
  Coding DNA Sequence Number=SeqID_90778
  Gene Ontology: Mol. function=transporter activity; Cellular component= integral to membrane; Biological process=transport
  Homolog annotation: Hit_ID=A7NYL3; Match level="QueryCoverage=76%, HitCoverage=92%, E-value=0.0, Identity=69%"; Hit description =Chromosome chr6 scaffold_3, whole genome shotgun sequence
  Pfam annotation: Domain name=MFS_1; Domain location=97-468; Score =174.1; E_value=3.7e-49; Accession=PF07690.7; Description=Major Facilitator Superfamily
  Pfam annotation: Domain name=OATP; Domain location=95-558; Score= -332.8; E_value=0.054; Accession=PF03137.11; Description=Organic Anion Transporter Polypeptide
  Pfam annotation: Domain name=Sugar_tr; Domain location=93-517; Score=- 146.8; E_value=0.003; Accession=PF00083.15; Description=Sugar (and other) transporter
  Pfam module annotation: Pfam domain module=MFS_1::OATP::Sugar_tr; Domain location=97-468::95-558::93-517
  Subcellular localization annotation: CTP_CleavageSite=94; ConfidenceScore=5.68e-01
MAALSSAVTLAAKPLSLPQNHRARVAAALHSPKRHLKRTEFKFFANGSSASLRSLPRLYVSSNDARFNSGPEESQQQQSSSFAEFITSERVKVVAMLALALALCNADRVVMSVAIVPLSLANGWSRAFAGIVQSSFLWGYLVSPIAGGVLVDHYGGKVVMAWGVALWSLATFLTPWASQTSLLALLTVRALLGVAEGVALPSMNNMVVRWFPQTERSRAVGISMAGFMLGCAIGLTLSPILMSQGGIFGPFVIFGLSGFLWVLVWLSATSSTPDQSPQISKYELEYILNRRQKSFSVETAKPKKVKVIPPFRRLLSKLPTWSLIIANAMHSWGFFIVLSWMPIYFSSVYRVDLRHAAWFSAVPWALMAVMGYFAGLWSDMMIQSGTSVTLTRKIMQCIGFVGPGLCLIGLATAKNPAIGSAWLTLAFGLKSFSHSGFLVNLQEIAPRYSGVLHGISNTAGTLAAIIGTVGAGFFVELVGSFPGFLLLTSLLYFLAAIFYCLFATGERVNFDDPGELKYITLSWHTSLAFVDTGILGVLCVVLQTPLPTNQMYGAYQLAVTKYGSLGDRKSRSVVSFRQTNLNRRNISINAPQRPTLLTTDRAHKPSINKPPDGHDESNPLSNLDS

SEQ ID NO: 182464 - protein, 112 aa, Glycine max
  Coding DNA Sequence Number=SeqID_90779
MGLDDKAAEDELVFDDDPLTWGAVADATRANTNFQVSHIASCSVESKCRRGSSNYLSPSSNLARAFNASFGIAPSSVPLFHIVISFNIESLHTAQNMEKQCKGCEFATSQWH

SEQ ID NO: 182465 - protein, 97 aa, Glycine max
  Coding DNA Sequence Number=SeqID_90780
GLFLGVTRHCHWRQRWREAGIVTGSDDIDRARAISPLALARCSLFMTGAASPSGGIGAMLSLFMMRLNIRSEIGFKASCRCSQVAHALLVHDETKHK

SEQ ID NO: 182466 - protein, 505 aa, Glycine max
  Coding DNA Sequence Number=SeqID_90781
  Gene Ontology: Mol. function=DNA binding; Cellular component=nucleus; Biological process=regulation of transcription
  Homolog annotation: Hit_ID=Q8L8G0; Match level="QueryCoverage=72%, HitCoverage=73%, E-value=5e-51, Identity=38%"; Hit description=Nam -like protein 1
  Pfam annotation: Domain name=NAM; Domain location=1-64; Score=62.3; E_ value=1.6e-15; Accession=PF02365.6; Description=No apical meristem (NAM) protein
DRKYPNGHRLNRATNHGYWKATGKDRKIKSGSTLIGMKKTLVFYTGRAPKGKRTNWVMHEYRPTLKELEGTNPGQNPYVLCRLFKKQDESLEASNGDDVERTASTPTTANYCPDEIQSDSALVPASSSQVTEDDKPLPVISENSEEAISNIITPGDIHSDECDAPDAQYQIVEPVAEEDQLLSVDIFYDPTNQQLDDKLFSPVHAHFPADFYYQANNQSELQYGTSENISEFFDSVVNWDSFSYATSSLDLGSSFLNPKDNGSGSDSDVEMANMLHLQALHDYPKEAVEEKFNVGLFQNNPQMAFSNDGPMGQVHNVANYCEQPRNFDAFVNGDTGIRIRTRHGRNEQPNMNMMIQSQGIAPRRIRLGVVRRPLGSQETAKDGSCACAPEDHNSKTIISAEKKASENHAADESSTVSDESSTVTDDSDEPEEASPKSTDPRKISQQHVATAESISGSKDLLVSRRGCYTSKVSSNCAMWSYVLAVSATVLVSAILLVNIWAYVRS

SEQ ID NO: 182467 - protein, 345 aa, Glycine max
  Coding DNA Sequence Number=SeqID_90782
  Gene Ontology: Mol. function=molecular_function; Cellular component =membrane; Biological process=auxin mediated signaling pathway
  Homolog annotation: Hit_ID=A7QGC1; Match level="QueryCoverage=75%, HitCoverage=74%, E-value=3e-82, Identity=54%"; Hit description =Chromosome undetermined scaffold_91, whole genome shotgun sequence
  Pfam annotation: Domain name=DUF6; Domain location=1-129; Score=23.1; E_value=0.001; Accession=PF00892.11; Description=Integral membrane protein DUF6
  Pfam annotation: Domain name=DUF6; Domain location=167-296; Score =17.4; E_value=0.007; Accession=PF00892.11; Description=Integral membrane protein DUF6
  Pfam annotation: Domain name=Voltage_CLC; Domain location=59-339; Score=-185.3; E_value=0.1; Accession=PF00654.11; Description=Voltage gated chloride channel
  Pfam module annotation: Pfam domain module=DUF6::DUF6::Voltage_CLC; Domain location=1-129::167-296::59-339
MVCGTGLGIPDTRRIQGWDHKLKPVGYRVRIWGYVEESGGRTKDFTPKVWFWLFVNALMGMTLAQGLFYYGLKDTSATYAVNFLNLVPICTFFTSIIFRLEKLGLHTWAGRAKCGGAILCVGGALVTSIYKGKKFYLGHQSHHVQTVATAHETHMLRGTFVLICSCFSYTAWFLVQVQLLKVFPLRYTGTMLACVLAAIQGGIIGVCIDSSKAAWKLEWNLQLVTIVYSGALATAATFTILSWAITIKGPSYPPMFNPLALIFVAFSEAIILGEPLTVGTLLGMVLIMVGLYSFLWGKNNETMRRVQQLASTKISNITNLSIRTESMTTIVSSSSPMNSVGLART

SEQ ID NO: 182468 - protein, 140 aa, Glycine max
  Coding DNA Sequence Number=SeqID_90783
MVKRYMDRSGMKGMYETRYTSMNKEMTIIVDDVSHLLHLLITGRFLDHMNSTYTRKEIKGILRLELGIMTDQEVDVTMSSGNTMALALLEKLYRTMLLMSCSSRGTSKVDGTKALLDRLQMTDVVWSPYASHKDLRPFED

SEQ ID NO: 182469 - protein, 153 aa, Glycine max
  Coding DNA Sequence Number=SeqID_90784
MHPHKPKAQLGQYIRGGSPQIPLLFGLMYTKEAYKLSTKEPFGIASDPLAENERTKLHLRQILPTPILVEASFMMMNQGTSFVIQVEGTSTWVVVTENKRGYISCGSVQVEDTSTWLFKENNGGYIPCGSLLVKDFTRLKRNLKDRRLLEDWM

SEQ ID NO: 182470 - protein, 207 aa, Glycine max
  Coding DNA Sequence Number=SeqID_90785
  Gene Ontology: Mol. function=transcription factor activity; Cellular component=nucleus; Biological process=red, far-red light phototransduction
  Homolog annotation: Hit_ID=A5B614; Match level="QueryCoverage=34%, HitCoverage=8%, E-value=9e-11, Identity=45%"; Hit description =Putative uncharacterized protein
MPYFSFVITQILTLQASPNSNCELYCNAATHKLKVINNTMIGKQHTKDVMEGRSVGDHVQEVWINDHAFMQMGLEKNGISFQEEAFDKDVEKEGVRFENEREETTCKGIIKDELCVGLKQEPVKFANENGDHVAQKIDNNDIAGLEANGGQEPYMGMKFESHEYAYFFYNHYAKCVGFGMLTKTSHRSKSSRQFIDVKYVCTRYRKK

SEQ ID NO: 182471 - protein, 468 aa, Glycine max
  Coding DNA Sequence Number=SeqID_90786
  Gene Ontology: Mol. function=mismatched DNA binding; Biological process=maintenance of fidelity during DNA-dependent DNA replication
  Homolog annotation: Hit_ID=A7QET1; Match level="QueryCoverage=95%, HitCoverage=74%, E-value=1e-132, Identity=53%"; Hit description =Chromosome chr16 scaffold_86, whole genome shotgun sequence
MKAETYAKAKAKASIHHDSLRVLEWDKLCDLVASFACTSLGRQALKDQLWSLNQTFEESLALLEETNAAVEMNKHGSLRLHLGHLDAMLVKTAIQQARRSIPVSGYEAWAIVALLQCAETLPGDLKAAIKEDKDWHNRFMPLTEVIMEFVINRSLIKAIEQVVDEDGSIKDSAVGIEFLFLMMVFIGSGSGVGSTIEPLSAVPLNDELQRARSLVVKAEADVLLTLTKKMQLDLEDIENTLNSLVELDVMVSNVVPMQINARATYGLSFGWSSPHIFLPDRGSSSTAEAFLPRKENPYGPLPSKREWMLYLLKAYPPLLLQRHKEKLRKAKKDVNIAASVKSQMTCVEFEVVAFPGLGMFDKKTSALLNAALDNAQPVPVDFSVSQKTRVIVITGPNTGSKTICLKTVGLAAMMAKSGLYVLASESAQIPWFDFVFADIGDEQSLSQSLSTFSGHLKQISVGNNVLIV

SEQ ID NO: 182472 - protein, 313 aa, Glycine max
  Coding DNA Sequence Number=SeqID_90787
  Homolog annotation: Hit_ID=A7Q3D0; Match level="QueryCoverage=100%, HitCoverage=100%, E-value=8e-79, Identity=50%"; Hit description =Chromosome chr13 scaffold_48, whole genome shotgun sequence
  Pfam annotation: Domain name=C2; Domain location=6-90; Score=17.6; E _value=0.0032; Accession=PF00168.21; Description=C2 domain
MAKIWIEVCLISARGVRGSPSLWKRQWYAVGWVDPKSKYCTKVDTSGNTNPIWRTKFAVHVDDSEPDLALHVEVYSIDPVFLTEKLHGSATVVLREFLAKEVHNNSEEVGSYQLRKKKSNKPSGFVDVSIRVSEDKEEPNFHPQGDGGGIVLLDYGNNSTIHLTTGTGFGQPYPQQKAQASFHGPQKQAQTNVPHSHPVPFPADYATNPYVGGPSYAPAGPSYQPPRTTTPSPSNVNYAPNFFPSSGGMAPSYFNMPSSSSSGAGPRPRGPPGFAIGAGAGALAAGAVIFGDNIMSGFDVGDPTLTIATDPLF

SEQ ID NO: 182473 - protein, 188 aa, Glycine max
  Coding DNA Sequence Number=SeqID_90788
  Homolog annotation: Hit_ID=A7QER9; Match level="QueryCoverage=98%, HitCoverage=47%, E-value=4e-48, Identity=51%"; Hit description =Chromosome chr16 scaffold_86, whole genome shotgun sequence
  Pfam annotation: Domain name=Peptidase_C78; Domain location=4-164; Score=-14.6; E_value=3.9e-07; Accession=PF07910.4; Description =Peptidase family C78
MDWSSCAALLCSFGLQVRVVNFGAKELVRINDARKRKAPNTYGPMEIYLSRAVAQASCCQDAKTCSSFIQIRDTVDKESSDDRVRRVLISHKTPLYFQHDGHSRTIVGIQVKHPRSGIPQYSLLVMDPGHRTAALERSIREKVGWQKFIKRGVHTLRKLQYQLCYVDPGIASEEMEKLKTIDGVFLEF

SEQ ID NO: 182474 - protein, 155 aa, Glycine max
  Coding DNA Sequence Number=SeqID_90789
  Gene Ontology: Mol. function=pyruvate dehydrogenase (acetyl -transferring) activity; Cellular component=mitochondrial matrix; Biological process=metabolic process
  Homolog annotation: Hit_ID=P52904; Match level="QueryCoverage=81%, HitCoverage=30%, E-value=2e-46, Identity=76%"; Hit description =Pyruvate dehydrogenase E1 component subunit beta, mitochondrial precursor
  Pfam annotation: Domain name=Transket_pyr; Domain location=39-155; Score=22.1; E_value=6.7e-08; Accession=PF02779.15; Description =Transketolase, pyrimidine binding dom
MLGVIRHKSIRPAFSAIRHFSSAAKELLSNIKLSAVVSMQITVRDALNSALDEEMSADPKVFLMGEEVGEYQGAYKISKGLLDKYGPERVLDTPITEAGFAGIGVGAAYYGLRPVVEFMTFNFSMQLSIKDRDVHGQHQKCYSVIATILKIMYAR

SEQ ID NO: 182475 - protein, 1526 aa, Glycine max
  Coding DNA Sequence Number=SeqID_90790
  Gene Ontology: Mol. function=nucleotide binding; Cellular component =cytoplasm; Biological process=defense response
  Homolog annotation: Hit_ID=A5C6N9; Match level="QueryCoverage=61%, HitCoverage=94%, E-value=4e-98, Identity=30%"; Hit description =Putative uncharacterized protein
  Pfam annotation: Domain name=AAA; Domain location=170-352; Score= -40.5; E_value=0.074; Accession=PF00004.20; Description=ATPase family associated with various cellular activities (AAA)
  Pfam annotation: Domain name=ABC_tran; Domain location=169-299; Score= -59.4; E_value=0.056; Accession=PF00005.18; Description=ABC transporter
  Pfam annotation: Domain name=LRR_1; Domain location=1074-1098; Score =0.2; E_value=2.8e+02; Accession=PF00560.24; Description=Leucine Rich Repeat
  Pfam annotation: Domain name=LRR_1; Domain location=1139-1163; Score =0.3; E_value=2.7e+02; Accession=PF00560.24; Description=Leucine Rich Repeat
  Pfam annotation: Domain name=LRR_1; Domain location=1333-1357; Score =0.2; E_value=2.8e+02; Accession=PF00560.24; Description=Leucine Rich Repeat
  Pfam annotation: Domain name=LRR_1; Domain location=1420-1440; Score =1.2; E_value=1.8e+02; Accession=PF00560.24; Description=Leucine Rich Repeat
  Pfam annotation: Domain name=LRR_1; Domain location=1460-1482; Score =1.8; E_value=1.4e+02; Accession=PF00560.24; Description=Leucine Rich Repeat
  Pfam annotation: Domain name=LRR_1; Domain location=584-604; Score =4.0; E_value=55; Accession=PF00560.24; Description=Leucine Rich Repeat
  Pfam annotation: Domain name=LRR_1; Domain location=606-627; Score =10.8; E_value=3.1; Accession=PF00560.24; Description=Leucine Rich Repeat
  Pfam annotation: Domain name=LRR_1; Domain location=629-647; Score =2.1; E_value=1.3e+02; Accession=PF00560.24; Description=Leucine Rich Repeat
  Pfam annotation: Domain name=LRR_1; Domain location=707-730; Score =2.1; E_value=1.3e+02; Accession=PF00560.24; Description=Leucine Rich Repeat
  Pfam annotation: Domain name=LRR_1; Domain location=766-787; Score =3.0; E_value=86; Accession=PF00560.24; Description=Leucine Rich Repeat
  Pfam annotation: Domain name=LRR_1; Domain location=791-815; Score =7.9; E_value=11; Accession=PF00560.24; Description=Leucine Rich Repeat
  Pfam annotation: Domain name=LRR_1; Domain location=856-875; Score =4.3; E_value=48; Accession=PF00560.24; Description=Leucine Rich Repeat
  Pfam annotation: Domain name=LRR_1; Domain location=914-936; Score =2.6; E_value=1e+02; Accession=PF00560.24; Description=Leucine Rich Repeat
  Pfam annotation: Domain name=MMR_HSR1; Domain location=169-283; Score= -13.9; E_value=0.02; Accession=PF01926.14; Description=GTPase of unknown function
  Pfam annotation: Domain name=NACHT; Domain location=169-319; Score= -32.7; E_value=0.021; Accession=PF05729.3; Description=NACHT domain
  Pfam annotation: Domain name=NB-ARC; Domain location=139-430; Score =191.2; E_value=2.6e-54; Accession=PF00931.13; Description=NB-ARC domain
  Pfam module annotation: Pfam domain module=AAA::ABC_tran::LRR_1::LRR _1::LRR_1::LRR_1::LRR_1::LRR_1::LRR_1::LRR_1::LRR_1::LRR_1::LRR _1::LRR_1::LRR_1::MMR_HSR1::NACHT::NB-ARC; Domain location=170 -352::169-299::1074-1098::...
  Pfam module annotation: Domain location=1139-1163::1333-1357::1420 -1440::1460-1482::584-604::606-627::629-647::707-730::766-787::791 -815::856-875::914-936::169-283::169-319::139-430
MGDIVVSIVAKLAEYTVGPILHHARYLCCFNNIAWNLLIAKEELELTRNSVNERVEEAIKRTEKIEPAVEKWLKDVEKVLEEVHMLQGRISEVNKSYFRRQCQYFLTKKIARKIEKMAQLNHNSKFEPFSKIAELPGTKYYSSKDFVLFKSAESTYKNLLDALKDKSVSMIGLVGLGGSGKTTLAKAVGKKAVELKLFEKVVMVTVSPTPNIRSIQVQIADMLGLKFEEESEEVRAQRLSERLRKDTTLLILDDIWENLDFEAIGIPYNENNKGCGVLLTTRSREVCISMQCQTIIEVNLLTGEEAWDLFKSTANITDESPYALKGVATKIVDECKGLPIAIVTVGRTLKGKTVKEWELALSRLKDSEPLDIPKGLRSPYACLGLSYDNLTNELAKSLFLLCSIFPEDHEIDLEDLFRFGKGMGLPGTFGTMEKARREMRIAVSILIDSYLLLQASKKERVKMHGMVRDVAFWIASKTGQAILASTGMDPRMLIEDETIKDKRVISLWDLKNGQLLDDDQLNCPSLEILLFHSPKVAFEVSNACFERLKMIKILAFLTSSYAWEIPLTSYLTLSLPQSMESLQNLHTLCLRGYNLGDISILESLQALEVLDLRGSSFIELPNGIASLKKLRLLDLFYCTIPDLFQNAYEEHRPCRALCVEGFNASVQSFISLPIKDFFQKAEHLHLMHLEGGYENVIPSMDPQGMNHLIFLILEYCPEIKCVFDSTNADLLQTEDAFSSLVILSLLGLDNLEEVFHDPSSRCSLKSLEKLTIQSCRQLYNISFPKNSKLCHLKFLTIENCPMLTCIFKPSIFQTLELLEHVVISECYELKQIIEEVEEGSVDYVSSQSRTSLMLPKLRKLTISGCQGLEYIFPMCYAHGLASLEKLSIKVCGKLKYVFGSEKEYDLTVYQHQSNCQTIHINFLNLETLHLIGLPNLVEIWPKYFHPHLPNLKMFQCTDCPRLSDSCVRRVMIIDSDLQQDSTATEKELLCLVTSACNQLSDQVLASKLRYVLKFRHLGLFDLGVKGLFQFQIREHESNRELAPLKLDLTHAYLGNLPELEFIWKGPTNFLSLGMLDMIHVNGCPKLKVIFSPTILRSLPMLTRLEIIDCEELEQIFDLGDAQSLYTCSQEEHDLTGLASVEELDIKECNELKYVFGSEKEHDLRGYQHQSRRQTNIHIYQILRLGTLRLIRLPNLLDIWPKYFHPHLPNLKVLICIDCPRLPDSCVRRVMIIDSDLQQDSTATEKELLCLVATTFNQLSHQVLSSKLRHVLKFRYLRLLGLRVKGLFQFQIKEHESNKELAPLKLDLTHAYLWDLLELEFIWKGPTNFLSLHMLDMIHVNGCPKLKVIFSPTILRSLPMLTTLEIIDCEELEQIFDSGDAQSLYTCSQFVCFPDLNTIYVRKCNKLKYFFHNFVAGHFCDLNYLKIEDCSQLQKVFAFECETDDDGQEGIVKDGEKVLLKLLRITLSRLPNFKEIHHGFKLTAYVREHDINDCPKYSPSLYLHTGERMSIEQSVQVYESAEEKDED

SEQ ID NO: 182476 - protein, 102 aa, Glycine max
  Coding DNA Sequence Number=SeqID_90791
  Gene Ontology: Mol. function=sequence-specific DNA binding; Cellular component=nucleus; Biological process=regulation of transcription, DNA-dependent
  Homolog annotation: Hit_ID=B0LUS3; Match level="QueryCoverage=73%, HitCoverage=23%, E-value=7e-17, Identity=53%"; Hit description =Transcription factor
  Pfam annotation: Domain name=WRKY; Domain location=3-44; Score=19.3; E_value=3.2e-06; Accession=PF03106.6; Description=WRKY DNA -binding domain
MNKSYFRCGYKYDQGCKANKQVQRDQENPNMYRITYIGIHTCNATPKATHSATDSNTWESFLLNSDGEIMSDYVLTLNVWIWILGCHLFILALIFPLTKVTF

SEQ ID NO: 182477 - protein, 629 aa, Glycine max
  Coding DNA Sequence Number=SeqID_90792
  Gene Ontology: Mol. function=asparagine synthase (glutamine -hydrolyzing) activity; Cellular component=phagocytic vesicle; Biological process=amino acid biosynthetic process
  Homolog annotation: Hit_ID=P49092; Match level="QueryCoverage=82%, HitCoverage=95%, E-value=0.0, Identity=83%"; Hit description =Asparagine synthetase [glutamine-hydrolyzing] 1
  Pfam annotation: Domain name=Asn_synthase; Domain location=293-534; Score=334.8; E_value=1.6e-97; Accession=PF00733.12; Description =Asparagine synthase
  Pfam annotation: Domain name=GATase_2; Domain location=97-245; Score =31.2; E_value=7.7e-12; Accession=PF00310.12; Description=Glutamine amidotransferases class-II
  Pfam module annotation: Pfam domain module=Asn_synthase::GATase_2; Domain location=293-534::97-245
NGDTTAYIIISDHNIQATTQGMSQALCAVLWVILLPHSIDAPRAQTLFLEVEDHRCEGRVANSRTRFQKFSSGREDGEDEVHAEELMVPAPANPLLEVIDLDNKAPVYLTGLKHRGPDWSGLHQHGDCFLAHQRLAIVDPASGDQPLFNEDKSVIVTVNGEIYNHEELRKQLPNHNFRTGSDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEAIPSAPYDPLVLRHAFEQAVIKRLMTDVPFGVLLSGGLDSSLVASITSRYLANTKAAEQWGSKLHSFCVGLEGSPDLKAAKEVADYLGTVHHEFTFTVQDGIDAIEDVIYHIETYDVTTIRASTPMFLMSRKIKSLGVKWVISGEGSDEIFGGYLYFHKAPNKEEFHRETCRKIKALHQYDCLRANKSTFAWGLEARVPFLDKAFINAAMSIDPEWKMIKRDEGRIEKWILRRAFDDEEHPYLPKHILYRQKEQFSDGVGYSWIDGLKAHAAKHNSARLTVPGGASVACSTAKAVEWDAAWSNNLDPSGRAALGVHISAYENQNNKGVEIEKIIPMDAAPLGVAIQG

SEQ ID NO: 182478 - protein, 928 aa, Glycine max
  Coding DNA Sequence Number=SeqID_90793
  Gene Ontology: Mol. function=N-acetyltransferase activity; Biological process=metabolic process
  Homolog annotation: Hit_ID=A7NYD4; Match level="QueryCoverage=93%, HitCoverage=97%, E-value=1e-108, Identity=34%"; Hit description =Chromosome chr6 scaffold_3, whole genome shotgun sequence
  Pfam annotation: Domain name=Agenet; Domain location=1-75; Score =17.6; E_value=0.0043; Accession=PF05641.3; Description=Agenet domain
  Pfam annotation: Domain name=PHD; Domain location=697-732; Score =24.5; E_value=1.8e-05; Accession=PF00628.20; Description=PHD-finger
  Pfam module annotation: Pfam domain module=Agenet::PHD; Domain location=1-75::697-732
LKSVEEGFQGSWHPGTVVRCERQKRHVKYDNILEDDGSKYLVDVVRVSAILDGLGSSSDCSNECGFIRPLPPPLAFGERDLPFGLCVDVNYEEAWWEGVIFDHCNGTKERSVLFPDLGDEMKVGIHHMRLTQDWDEVTENWESRGKWVFLEMVEECEKESVVAVSFKQIWYDVRATKEFDDNIKHWTCNVKELWRDLVKEVIGNYYVLTLEQVFPALNLPEDFFKETPESVEPTDSIPLQEEYDKDPLVDGASEKEIILQQEPASPVQEIMPEAGEVMPGASCCGKKRKRGRSASIYWEPLVLTNVEFCPDVINEYIHGCGSKTVRELLKTKVRKHLAYLGWKIEWAEDKYFPGRGRYRYKSPDDAQEQKVYTSIIQVLTHMQMESNMNTVQPQIDHNRMHSTNDTNLSHLLSDLPPNDQDVDVCPPPKRKPSNVKVVVEPEFCPQAVVKYYLNASNKHWVDRGKWRLKAKKHLLAEGWTFDYPTKKRKTTLYISPGNKWLGLLRGACRIHIKEKISEWTNSGMIPLNVPAINESGEGHIDSENLLKILSQTLEKESELLTASPASRSTENRNHRCTRNSKASMPKSHRKGLSTRVLWSRKRVQKVSAPSPSHQRPRNVSSWLIDNSVVMSRCKVYCWAEGGRNSNVVEGRITYDGIKCSCCLKIYGLGGFVNHAGGSSDCRPSASIFLKDGENDNICSVCQYGGELVLCDRCPSAFHSACLGLEIYEGLQSLLGKPLIVGANNLTWTLVKFINSESCDVGSTKNDLLAEKYSKLSVALSVMHECFEPLKNPFTSKDIIDDVIFNTRLTQLGVERLVLPAVSGVLETWTNSFGFAKMTNFERSQFLDYAFLDFQETIMCQKLLKRSSSPESVLTREMQPKPHDVFTVKCKIKFEKSSSALEVDQAEEAHKSRKDLQVVECVPTLPTSS

SEQ ID NO: 182479 - protein, 169 aa, Glycine max
  Coding DNA Sequence Number=SeqID_90794
MEEFMAQVAWLEVQSSPLGGGYSGGDTRGHPCCNTTYGGYWEEDGAADTDYAADMAAAQNTWDPWPTPAQNTSLPAKDAPSSPQDDPTPAQKDRRQDLIYFLLFRYKEKVLAAGVSLSETYALSEALNSFSVMGNPRRGSVRDVLAQCAASSPSESFVSSRAQRAQLAN

SEQ ID NO: 182480 - protein, 63 aa, Glycine max
  Coding DNA Sequence Number=SeqID_90795
MRKMLAIEIVKWKYLNYEIPLVEKGGISKYDTKKDDLHKKWKTKFNVALLTATMDNFGDKQKC

SEQ ID NO: 182481 - protein, 54 aa, Glycine max
  Coding DNA Sequence Number=SeqID_90796
MSLHYNKTNEACEFGDDFIGPPTFDQLKMTSTNLLEYGNMLVQEQKNVNTDLRE

SEQ ID NO: 182482 - protein, 129 aa, Glycine max
  Coding DNA Sequence Number=SeqID_90797
MSWSIFDPCRPGYSRIFSIKASLSITLRDLLGAPSRIAGAPRADNGRFLPPLSIAEEMRKNLLPWLHTLQSHTSSSLYFSNSDHAIGIGLIAFSIEMTNKVKGKGKEVAGKGYAGKRKGAFDDDKTGGG

SEQ ID NO: 182483 - protein, 321 aa, Glycine max
  Coding DNA Sequence Number=SeqID_90798
MWCYEWKKSEALRVGRLSLNSVDFAQVQKNACVWLVVESLVQNEFWMFASRSQREKSCDLVGVLAEFSAYALFCLAVIACARIDGDPVLRETRIWATWEYVSSDGGGQQGMLEMRKCRRVKLPAFIVDHRVVPGDMSRGSGDLGDVRRAPGSQQIKGTKTTKQEGLWWLASCEFCVICGLWPLVIDYQGLENEVRKLREPLVIDYQPIVMAAQLIRDRVEMECLEGAWETLEGNTRCRFRGTIRFTATSLVHPDEPARTLQRTVEIGMARRGRDQNRDVLDRITAVLETLVQERDVEPAEYRGLMAFRKNHPPNNLENYER

SEQ ID NO: 182484 - protein, 37 aa, Glycine max
  Coding DNA Sequence Number=SeqID_90799
MSLNHSPMDVDGENSHGRSKRRKGSSKRKLLVNQRVE

SEQ ID NO: 182485 - protein, 324 aa, Glycine max
  Coding DNA Sequence Number=SeqID_90800
  Gene Ontology: Mol. function=oxidoreductase activity; Cellular component=intrinsic to mitochondrial inner membrane; Biological process=electron transport
  Homolog annotation: Hit_ID=A7NYD9; Match level="QueryCoverage=98%, HitCoverage=70%, E-value=1e-147, Identity=74%"; Hit description =Chromosome chr6 scaffold_3, whole genome shotgun sequence
  Pfam annotation: Domain name=Pyr_redox; Domain location=57-157; Score= 35.1; E_value=2.4e-07; Accession=PF00070.18; Description=Pyridine nucleotide-disulphide oxidor
  Pfam annotation: Domain name=Pyr_redox_2; Domain location=57-202; Score=-31.4; E_value=0.005; Accession=PF07992.5; Description =Pyridine nucleotide-disulphide oxidore
  Pfam module annotation: Pfam domain module=Pyr_redox::Pyr_redox_2; Domain location=57-157::57-202
MVFKVHCESVTEGAQAPDPWRFTISYDKLEIRRKLLLNLMMSDVPGIEEEEKQRLLHCVVVGGGPTGVEFSGELSDFIVRDVRQRYAHVKDYIHVTLIEANEILSSFDVRLRQYATNQLTKSGVRLVRGIVKDVEEKKIILNDGTEVPYGLLVWSTGVGPSAIIQSLDLPKAPGGRIGIDEWLRVPTVEDIFSIGDCSGFVESTGKTPLPALAQVAERQGKYLAFLLNKIGKANGGRANSAKDVDFGDQFVYKHMGSMASIGSYKALVDLRQSKEGKGLSLAGFVSWFIWRSAYLTRVISWRNRFYVAINWATTLVFGRDISRI

SEQ ID NO: 182486 - protein, 111 aa, Glycine max
  Coding DNA Sequence Number=SeqID_90801
  Homolog annotation: Hit_ID=A5BDS3; Match level="QueryCoverage=85%, HitCoverage=48%, E-value=2e-08, Identity=36%"; Hit description =Putative uncharacterized protein
MYHERTKYIDVKLHFIRDVIESEKVKVENVSTEENPAGLRGVHPVDKRRTVSEYRNIFPAIDFSLWPNGYSQRSDIFSPNIAVGQVMDMLRAFGNDCHPDVKSEAHSKHFS

SEQ ID NO: 182487 - protein, 92 aa, Glycine max
  Coding DNA Sequence Number=SeqID_90802
MSSSDRNLDDARTKPAGEEVSGCYIVAVAHGATQISIYPTNVPSEQSFSGLSSIKDHLPPKNNDLQRCFRSPQHIKELHDNTNQKHCKLLYQ

SEQ ID NO: 182488 - protein, 100 aa, Glycine max
  Coding DNA Sequence Number=SeqID_90803
MAILVDDNDFRSRGRLPCGRDSHLRGRLLGYKCEYDVKFPYVVDRGPPCDVAPLELVGLGSSSSMDSFVSWKMNGSGMEKEERDEMPLQGEDESRRSSPP

SEQ ID NO: 182489 - protein, 154 aa, Glycine max
  Coding DNA Sequence Number=SeqID_90804
  Homolog annotation: Hit_ID=Q9AR60; Match level="QueryCoverage=68%, HitCoverage=22%, E-value=2e-08, Identity=33%"; Hit description =Photoperiod responsive protein
MVERITKASKVAAADAVAVLWSLCCLCKNVKVRDDVAKRNGVVVVLLVMQRGWEEHVRSMCMDLIKVLKGVRKNGLRPVKVSRQWERRDPMCGCLANGESGSLHVSLVPLAAPSSQCTVSLLAMAAHAFSPLPLAGSMQKVTPCVNIYKIDPFA

SEQ ID NO: 182490 - protein, 241 aa, Glycine max
  Coding DNA Sequence Number=SeqID_90805
  Gene Ontology: Mol. function=carbohydrate binding; Biological process= carbohydrate metabolic process
  Homolog annotation: Hit_ID=A7NUJ3; Match level="QueryCoverage=51%, HitCoverage=40%, E-value=3e-24, Identity=59%"; Hit description =Chromosome chr18 scaffold_1, whole genome shotgun sequence
MALFVFLVDNEAWQWRVVDLEHDLDDDDTGVNLDANVTSMLERHNTKRILVGDKGVEQAIIVVKVHHHQGLNGFHYVDEGNQSMDIGGEVVRRREGRWCDPLELWEDAKCQNIIAEGAYVGLAPPGEAGSWQRECKGYQFWTRANEKGYFSINNICGGDYNLYAWVPGFIGEYWNNIVLAITPVNDPKQDPPLFITGVIGKDSAIARHGIHGLYWLLNINVSGLLLEKGVNTIFLTHTIFV

SEQ ID NO: 182491 - protein, 55 aa, Glycine max
  Coding DNA Sequence Number=SeqID_90806
MQEWCDMMHGGSWVTWWWWVEAQWWVWCGVEVVLDGCGGGVWGEVGSHGHGEFTM

SEQ ID NO: 182492 - protein, 2300 aa, Glycine max
  Coding DNA Sequence Number=SeqID_90807
  Gene Ontology: Mol. function=ubiquitin-protein ligase activity; Cellular component=intracellular; Biological process=protein modification process
  Homolog annotation: Hit_ID=A3CGV1; Match level="QueryCoverage=98%, HitCoverage=57%, E-value=0.0, Identity=54%"; Hit description =Putative uncharacterized protein
  Pfam annotation: Domain name=DUF908; Domain location=82-395; Score =91.8; E_value=2.1e-24; Accession=PF06012.3; Description=Domain of Unknown Function (DUF908)
  Pfam annotation: Domain name=DUF913; Domain location=443-788; Score =178.9; E_value=1.3e-50; Accession=PF06025.3; Description=Domain of Unknown Function (DUF913)
  Pfam annotation: Domain name=UBA; Domain location=1282-1319; Score =43.4; E_value=7.9e-10; Accession=PF00627.22; Description=UBATS-N domain
  Pfam annotation: Domain name=UIM; Domain location=1326-1343; Score =20.3; E_value=0.0073; Accession=PF02809.11; Description=Ubiquitin interaction motif
  Pfam module annotation: Pfam domain module=DUF908::DUF913::UBA::UIM; Domain location=82-395::443-788::1282-1319::1326-1343
MYCHLNLVIDWFQPPMVKAFIEKIIQCPLQDIAIPLSGFRWEYNKGNFHHWRLLLLHFDTYFKTYLSCRNDLTLLDNLEDDSPLPKHAILQILRVLQIILENCPNKSSFDGLEHFKLLLASTDPEILIATLETLSALVKINPSKLHGSTKMICCGSVNSYLLSLAQGWGSKEEGLGLYSCVMANEKVQDEALCLFPSEEIGHDQSNCRMGTTLYFELHGPSAQSKEHSADAVSPGSTVIHMPDLHLRKEDDLSLMKQCIEQFSVPSELRFSLLTRIRYARAFRSPRICRLYSRICLLSFIVLVQSGDAQEELVSFFANEPEYTNELIRIVRSEEVISGSIRTLAMLALGAQLAAYTSSHHRARILSGSSLTFAGGNRMILLNVLQRAILSLKSSNDPSSLAFVEALLQFYLLHVVSTSTSGNNIRGSGMVPTFLPLLEDFDPTHIHLVCFAVKTLQKLMDYSSSAVSLFKELGGIELLAQRLQKEVHRVIGLVGETDNIMLTGESLRYSTDQLYSQKRLIKVSLKALGSATYAPANSTRSQHSQDSSLPVTLRLIFQNVDKFGGDIYYSAVTVMSEIIHKDPTCFSALHEMGLPDAFLLSVGSEILPSSKALTCIPNGLGAICLNAKGLEAVRESSSLRFLIDIFTSKKYILAMNEAIVPLANAVEELLRHVSTLRSSSVDIIIEIIHKIASFGDGNGTGFSGKAEGTAMETDSENKEKEGHCCIVGTSYSAIEGISDEQFIQLCVFHLMVLIHRTMENAETCRLFVEKSGIEALLNLLLRPTIAQSSDGMSIALHSTMVFKGFAQHHSIPLAHAFCSSLREHLKKALAGLGAASEPLLLDPRMTTDGAIFSSLFLVEFLLFLAAPKDNRWVTALLTEFGNGGKDVLEDIGRVHREVLWQIALLENRKPEIEEDGACTSDLQQAEGDASETEEQRLNSFRQFLDPLLRRRTSGWSIESQFFNLINLYRDLGRSTGSQHRSNLVGPRSSSSNQVQHSGSDDNSGTADKKESDKQRPYYTSCCDMVRSLSFHITHLFQELGKVMLLPSRRRDDVVNVSPASKSVASTFASIAFDHMNYGGRCVNLSGTEESISTKCRYFGKVIDFMDNVLMERPDSCNPIMLNCLYGRGVIETVLTTFEATSQLLFTVNRAPASPMDTDDANAKQDDKEDTDNSWIYGSLASYGKLMDHLVTSSFILSSFTKHLLAQPLTNGNTAFPRDAETFVKVLQSRVLKTVLPVWTHPQFVDCSYEFISTVISIIRHVYTGVEVKNVNGSGGARITGPPPNETTISTIVEMGFSRSRAEEALRQVGSNSVELAMEWLFSHPEEIQEDDELARALAMSLGNSESDAKDAVANDNALQLEEEMVLLPPVDELLSTCTKLLSKEPLAFPVRDLLVMICSHDDGHHRSNVVSFIVERIKECGLVPSNGNVATLAALFHVLALILNEDAVAREAASTSGLIKIASDLLYQWDSSLDSREKQQVPKWVTAAFLALDRLLQVDQKLNSEIAEQLKKEAVNSQQTSITIDEDRQNKLQSALGLSMKYADIHEQKRLVEVACSCMNNQLPSDTMHAILLLCSNLTRNHSVALTFLDAGGLNLLLSLPTSSLFPGFDNVAASIVRHVLEDPQTLQQAMESEIKHSLAVASNRHPNGRVNPHNFLLNLASVIYRDPVIFMLAAQSVCQVEMVGERPYIVLLKDRDKDKAREKEKDKDKTLEKDKVQNSDGKVVLGNTNTAPTGNGHGKIQDSNTKSAKGHRKPNQSFINVIELLLESICTFVPPLKDDIASNVLPGTPASTDMDIDVSVVKGKGKAVATVSDGNETGSQVASASLAKIVFILKLLTEILLLYSSSVHVLLRRDAEISCIRGSYQKSPAGLSMGWIFSHILHNFLPYSRNSKKDKKADGDWRQKLATRANQFIVGACVRSTEARKRVFGEISYIINEFVDSCHDIKRPGNEIQVFVDLLNDVLAARTPAGSYISAEASTTFIDAGLVKSFTCTLQVLDLDHAGSSEVATGIIKALELVTNEHVHSVHSSAGKGDNSTKPSVLSQPGRTNNIGELSQSMETSQANPDSLQVDHVGSYAVHSYGGSEAVTDDMEHDQDLDGSFVPANEDDYMHENSEDARNLENGMENVGLQFEIQPHGQENLDEDDDEDDDMSGDEGEDVDEDDDDEEEHNDLEEVHHLPHPDTDQDEHEIDDEDFDDEVMEEDDEDDEEDEDGVILRLEEGINGINVFDHIEVFGRDNSFANEALHVMPVEVFGSRRPGRTTSIYSLLGRTGDAAVPSRHPLLLEPSSFPPPTGQSGQFL

SEQ ID NO: 182493 - protein, 107 aa, Glycine max
  Coding DNA Sequence Number=SeqID_90808
  Homolog annotation: Hit_ID=A7NUK3; Match level="QueryCoverage=97%, HitCoverage=10%, E-value=1e-26, Identity=58%"; Hit description =Chromosome chr18 scaffold_1, whole genome shotgun sequence
MDLILSDNEGQAGKSVKLPPAWPKHPNDEAANGFVTSIKGIFRTQHHKEKAFVHKTKKGEVENETQGDFSEYDGEIAPFARHLTNTQAKKIIRKHTKKLQSKAQKVT

SEQ ID NO: 182494 - protein, 227 aa, Glycine max
  Coding DNA Sequence Number=SeqID_90809
  Subcellular localization annotation: CTP_CleavageSite=17; ConfidenceScore=5.30e-01
MAKPSKKRKGSSSTTTAAGQRRHDTSGDPPTPNPPSFSSPSQGVPFEGTLVDDWKHVYSSHDTRKMVYNDHVDMTGRLLAGSFTFECCIMHYVLCRVLLPRSTNLAQASEEDLILLWALQTEDEPFVKVKRSFAIGAGVVTSFGYRKDMDGQWVRKQDLPPPIPNERTPSPPPQHDTSSSLLNDVLTELWDLRAFVNDRFDAMDSHITHLEDDMSFIQRCFDPPADS

SEQ ID NO: 182495 - protein, 639 aa, Glycine max
  Coding DNA Sequence Number=SeqID_90810
  Gene Ontology: Mol. function=magnesium ion binding; Cellular component=membrane; Biological process=two-component signal transduction system (phosphorelay)
  Homolog annotation: Hit_ID=A7PBN9; Match level="QueryCoverage=40%, HitCoverage=79%, E-value=1e-113, Identity=75%"; Hit description =Chromosome chr16 scaffold_10, whole genome shotgun sequence
  Pfam annotation: Domain name=Extensin_2; Domain location=305-622; Score=-126.4; E_value=0.023; Accession=PF04554.4; Description =Extensin-like region
  Pfam annotation: Domain name=YqaJ; Domain location=24-167; Score =102.2; E_value=1.6e-27; Accession=PF09588.1; Description=YqaJ viral recombinase family
  Pfam module annotation: Pfam domain module=Extensin_2::YqaJ; Domain location=305-622::24-167
MLKYTSVETYSVLQASCLQHWFKNWQALRRNKLTASTFAAAIGFWRRQRVQLWLEKIGAIEPFSGNLATCWSNIKEEDALERYKLITGNTVLFPEFQVYDAHPEDSWLAASPDGVIDSMVHELPSCGVLEIKCPYFDGDISKAFPWFRIPIHYIPQAQGLMEILERDWMDFYVWTPNGSSLFRIYRDAEYWDLMKIALSDFWWKHVHPARELYSSNVITHPLFQLRSMRPAPRHELCRDIVYKSKHIAANSKLLMREIHGKLLGSGDWSETGLKGYLQVMEDSEQRKKRLKEMRVQADQAEVSGGVEGSVVPGFLSNPLMEAPSTMPSQDKSYAAPRFDYYTDPMSAFSSNRRNIASIQAALDNFPPSKFGGSPMAQYSSPHPESTNPQRTPHPIQASPAAYRKPIWSGPGGPAHYNFPIHPSSGGTYPSPRFEPSGGPLYNSGQGIAHPPSYSPNPPYPGYGDSPRPSYNPNPSPGYGNSPRPSYNPNPSPGYGNSPRPSYRPNPSPGYRNSPSPGQGRGRGFWRNTGSPVSGRGSGQGPNFHGHRSNENTARGPDRFYNRSMVEDPWEHLEPIIWKANDGYLNTSRIPLNSQPWISKATSTKGEGSSAASVKSSSEPSLAEYLASAFNEAANDAENV

SEQ ID NO: 182496 - protein, 135 aa, Glycine max
  Coding DNA Sequence Number=SeqID_90811
MDDALQKHGCVVVSKCSHCGSNYETTTHLLFQCPFPVNIWTWLSIVMGVNLLQFEPLELLDKFVVAGSSQMKDIFLAGLLRIRVLSLGSCIIDGRIVVSSKEAELWSMIYGLRMAEELKIERLIVEALREIVFLG

SEQ ID NO: 182497 - protein, 337 aa, Glycine max
  Coding DNA Sequence Number=SeqID_90812
  Gene Ontology: Mol. function=heat shock protein binding; Biological process=protein folding
  Homolog annotation: Hit_ID=A6XN08; Match level="QueryCoverage=97%, HitCoverage=97%, E-value=6e-80, Identity=51%"; Hit description =Putative uncharacterized protein
  Pfam annotation: Domain name=AT_hook; Domain location=324-336; Score =15.2; E_value=0.056; Accession=PF02178.10; Description=AT hook motif
  Pfam annotation: Domain name=DnaJ; Domain location=64-126; Score =80.7; E_value=4.6e-21; Accession=PF00226.22; Description=DnaJ domain
  Pfam module annotation: Pfam domain module=AT_hook::DnaJ; Domain location=324-336::64-126
MHSAEAERLLGIAEKLLQNRDLMGSREFAILAQETEPLLEASDQIMAIVDVLLAADKRVNSHPDWYAVLQLDRRSDDLDLIKKQYRRLALLLHPDKSRFHLAGHAFKLVADAWTLLSDPVKKSVYDKDLTFFSRVDLSVPEWVQQQEKLPVRRPGPGPSAGRNSAAAREDILADENSRRRRRRRKRSSTFWTACPYCYRLYEYPRVYEGYCLRCQNCDRSFHGVTVPSLPPLVPGQEAYYCCWGFFPVGFVVGGFGSPPEKEAAPVAAMPVQAPPPPPQQASSLPNWMPVPAENGAGSVTPVATARVTSSGAAMTNGVGSGTGPKKRGRPRKYPLPS

SEQ ID NO: 182498 - protein, 1077 aa, Glycine max
  Coding DNA Sequence Number=SeqID_90813
  Gene Ontology: Mol. function=ubiquitin thiolesterase activity; Cellular component=integral to membrane; Biological process =ubiquitin-dependent protein catabolic process
  Homolog annotation: Hit_ID=A7NUN3; Match level="QueryCoverage=93%, HitCoverage=94%, E-value=0.0, Identity=43%"; Hit description =Chromosome chr18 scaffold_1, whole genome shotgun sequence
  Pfam annotation: Domain name=UCH; Domain location=525-840; Score =155.8; E_value=1.2e-43; Accession=PF00443.20; Description=Ubiquitin carboxyl-terminal hydrolase
  Pfam annotation: Domain name=zf-MYND; Domain location=81-139; Score =8.5; E_value=0.0046; Accession=PF01753.9; Description=MYND finger
  Pfam module annotation: Pfam domain module=UCH::zf-MYND; Domain location=525-840::81-139
MRVTIDLGFWSLVVVAVVGLIVPAIAFVVRRQCQRAAARAEEIKRLLVLAEEESVRAESESEASVYQQNGIVSAPPKNKVCAVCYSPTTTRCARCKAVHYCLRYVTFSSKPQMKNTQKFGLSSGKCQIVHWRQGHKDKCHPPSPTCQTEDLVSDLGKKVAEPDYRGIHDEKSQTKSTEYATSSEKPPLSDMRCSPDISRAKDDSVRVESLQEGNVTGSNSELSSNSFSGFSASTGASESSDDSSVCESVTSNEYERCEGHNFVDPTNDISDTTSSRNSIGESIPLSPKFASLVDSVDGYPAMHKLNQVRPAFGKEESKLTSNGSSGLRIRKGAAIEPSTVSSGFWNTTRDSTRIKDGSNSEPLSSHSDDSAPKSVNNMPCARSASSENEGDSLGCADALSIHNLQTVGSRVSNHVINPGSTLKSSESRCLPHAVADTKLVSRTEEHSHYSTKGGNNGILSGTATSNSKNDLKTSVLKVSGQLRGSRLSKPFPSAVGSYITGKYSDKGLFPYDLFVKLYNWNRVELEPFGLINCGNSVAALSSSLLNSCYANAVLQCLAFTPPLTAYLLQGLHSKSCANKKWCFTCEFESLILKSKDTNSPISPVGILSQLQNIGSQLGNGREEDAHEFLRLAVETMQSVCLMESGDNMSDSLKEETNLMGLTFGGYLQSKIKCMKCGGKSECQERMMDLTVEIEGEITTLEEALQQFTSAETLDGENKYHCVRCKSYEKAKKKMTVSEAPNVLTIALKRFQSGKFGKLNKPIRFPEILDLAPFMSGTSDLPIYRLYGVVVHLDIMNAAFSGHYVCYVKNFQSRWFKVDDSVVTAVELESVLAKGAYMLFYARCSPRAPRLIRNSIVSSDSKWKLKGKTATMKLRRLPTGAGVNLTSPDGSPSLDTLYLKFLHPKMILEDDSSSDNSSLISSNSDEGSCSTDSTSDSTGTDDFADYIFSDAGRGAGGILRNSDSSISPALSSSPHSRYFPSSDIDHDSVVLPHSTGFQPSPSDGLLYRNRVVDVKRSGGGVFHFHPDTNIEHRKLDTTTSRSNCSSFRDTDSVQRAGSNHFNDRNSGVSYTNSRDRTD

SEQ ID NO: 182499 - protein, 204 aa, Glycine max
  Coding DNA Sequence Number=SeqID_90814
MSGERRVHVIRRCSHRQARHATVGGVYEGVLIGQSHIQAREPKLDQRRQILVGLHKARSLHLVSKLIPYCIVNRSHEPRYDRTGIYDGSGSLIRVECEIVAGWFGFFWAGPWARVLRTRKSRRTGNWGGSRRVRRIGKGVTRALGPSPIGLGLGREGPAGGGVDAPEGVAWEGVNAQSERVLHERGGECGACVMHKIRKEKEQN

SEQ ID NO: 182500 - protein, 275 aa, Glycine max
  Coding DNA Sequence Number=SeqID_90815
  Gene Ontology: Mol. function=protein transporter activity; Cellular component=clathrin adaptor complex; Biological process=intracellular protein transport
  Homolog annotation: Hit_ID=A7NT73; Match level="QueryCoverage=94%, HitCoverage=55%, E-value=1e-110, Identity=78%"; Hit description =Chromosome chr18 scaffold_1, whole genome shotgun sequence
  Pfam annotation: Domain name=Adap_comp_sub; Domain location=7-275; Score=298.2; E_value=1.6e-86; Accession=PF00928.12; Description =Adaptor complexes medium subunit family
MLWWMNGHTRKDNIRNKGYILTSEIDGTIQMKSYLSGNPEIRLALNDDLSIGRSQGPAYGYRSSSDSGTVILDDCNFHESVRLDSFDIDRTLSLVPPDGEFPVMNYRLTQEFRPPFRINALIEEAGSLKAEVILKVSAEFASSVTANTIKVQMPLPKYSRVVSVAYDHWVSFELEPGAVGQTTDFKEANKRLEWSLRKIVGGSEHTLRAKLTFSQESPVNVTKESGPVSMTFTIPMHNVSRLQVKYLQIAKKSATHEPYRWVRYVTQANSYVARI

SEQ ID NO: 182501 - protein, 124 aa, Glycine max
  Coding DNA Sequence Number=SeqID_90816
  Homolog annotation: Hit_ID=A7P6L6; Match level="QueryCoverage=62%, HitCoverage=2%, E-value=6e-19, Identity=61%"; Hit description =Chromosome chr9 scaffold_7, whole genome shotgun sequence
MVREKREFPKEEFSDFGCWSGLGPVYLRLAPSVHLAQVPVFELSTLSSLSAGFGISPENQKEDGTLNTSRDASGTGMGEGVGLKGVSDQIANEGQLLGTQEQQKEKQDYSNEVPSSNNTGIEME

SEQ ID NO: 182502 - protein, 115 aa, Glycine max
  Coding DNA Sequence Number=SeqID_90817
  Gene Ontology: Mol. function=heat shock protein binding; Biological process=response to stress
  Homolog annotation: Hit_ID=A7NUP5; Match level="QueryCoverage=78%, HitCoverage=64%, E-value=9e-25, Identity=60%"; Hit description =Chromosome chr18 scaffold_1, whole genome shotgun sequence
  Pfam annotation: Domain name=DnaJ; Domain location=40-98; Score=67.2; E_value=5.6e-17; Accession=PF00226.22; Description=DnaJ domain
MMWEWEDYEDTITEPEPEPDSDSDSHLNFDFFSALSRPKDYYKILEVDYDATDDAIRSNYIRLALKWHPDKHKDHNSATSRFQDINEAYQGLGLGLGLGFRVTRCSCSLFVVLDN

SEQ ID NO: 182503 - protein, 211 aa, Glycine max
  Coding DNA Sequence Number=SeqID_90818
  Homolog annotation: Hit_ID=A7PGU6; Match level="QueryCoverage=29%, HitCoverage=9%, E-value=6e-19, Identity=74%"; Hit description =Chromosome chr17 scaffold_16, whole genome shotgun sequence
MPVASKTRNMLEGLVKEGSLKWLLGKKSYFGEEFEEMENSPSAGKNFIRELSPVANLVVRRCSNSVILKGNSGSQDDETVTPDDVGDGENADEVTMDKELAYSDPTSDMDMDLDVNEDAYLMEDGELDEQGDLAENGNEGKQDEETCLPDEVMEVVHTEVDVNSEKDVQGQDHQENVDMNFTEPKRDTSRHELASQSKVDWQTHICECPDW

SEQ ID NO: 182504 - protein, 121 aa, Glycine max
  Coding DNA Sequence Number=SeqID_90819
MTTLALKQTIALGLSKELDHDASSIAIDVSGILGSLREGGDEKDQSGPLGPSRSFLQKVVASGGSNLARLGELGGKLLPYFAINRGRSEEEKGSAFLAFRILLNLLRKIVSVKKIQAEALP

SEQ ID NO: 182505 - protein, 64 aa, Glycine max
  Coding DNA Sequence Number=SeqID_90820
MGRPVRVTLFCENAPTMWDRYRLKGALKLDVFTPKAYTLKSPSGSLPPNSGPIPKIIFACRCCS

SEQ ID NO: 182506 - protein, 127 aa, Glycine max
  Coding DNA Sequence Number=SeqID_90821
MEGNLYSIVNGVDMVIDAEFWNVVVGIDMGGIRKFEESMDGYSKMQTYRGILRLVDYEFPYAILASRFIHYFTIDVSNEIVDFTKASNEITERHLKKLGMTYVDHEWVMAGEPPPATNDNQMGEEAH

SEQ ID NO: 182507 - protein, 47 aa, Glycine max
  Coding DNA Sequence Number=SeqID_90822
MAAEWRRRKGDWRHHFKGKMSQEQTYHHRKPWPTDPRSSSRFSTKCA

SEQ ID NO: 182508 - protein, 359 aa, Glycine max
  Coding DNA Sequence Number=SeqID_90823
MGNDDCSLDGGCSFMCPPMSTPQRAQTVFVEEEDHQREGRVASSKMGFRELSGGKEDEGKGNGGVSYPNLFRGLSFVDFFILASRLMVLNTNLSSPRLASGSLGPPNNFMVKKPTHSGKLIASALSFNSPGRAAFAPSAHFPLNRRAREAEEGFQGSEVEGIERTKKEEEERRGNEVEVLLNRDCDQSLHRSLFGDLRATIDTFFFSPRPPVEGVGAPERCLGIKGEKVGESHGIVGSRCECYSGGLILDLVTGFDKGNLGVTIDEGDLVVMDLAPHCCVVRTHCLLCRVEGAVATLPYVAVYLRRPPPPWKLPHSSLGLAHRSFCDGCNISPSSTSSVVKTPPPSTSSTCFVIFNLGI

SEQ ID NO: 182509 - protein, 111 aa, Glycine max
  Coding DNA Sequence Number=SeqID_90824
  Gene Ontology: Mol. function=catalytic activity; Cellular component =nucleus; Biological process=red or far red light signaling pathway
  Homolog annotation: Hit_ID=A7PXX5; Match level="QueryCoverage=66%, HitCoverage=27%, E-value=7e-27, Identity=78%"; Hit description =Chromosome chr15 scaffold_37, whole genome shotgun sequence
MDTTEIVSFYQNSPDELYLLFEQFCDHFHATSRNSMYMNFISSHSNNIHALEQLRSIKDKASSSAQFVKNIFESRFIKKITELMDDIRENVSVLTLLAGYDCKFICLYDIN

SEQ ID NO: 182510 - protein, 164 aa, Glycine max
  Coding DNA Sequence Number=SeqID_90825
MAPTRHPLDLEKSNRALGFPALITGLYQSYGVHVTPNKVIRLPITRAFIEKYSTPRQAQGDAHQDARTPPPPRQADLARPLGVEQYLQHLVRQQAANHRGQGQGSAVFVCPTPKQFGVEVAWPGDWPGAQAGEEPAESPSEAKEFHMDEDMTDLLDFLGGSGAT

SEQ ID NO: 182511 - protein, 77 aa, Glycine max
  Coding DNA Sequence Number=SeqID_90826
MMILRASHVDLIITFAMHSIILAIKASILANIGLNQAHVFKERFIKSRSSMEVTSLQKLGQKMDRVTSLLCLLPTHD

SEQ ID NO: 182512 - protein, 283 aa, Glycine max
  Coding DNA Sequence Number=SeqID_90827
  Homolog annotation: Hit_ID=Q6WAY6; Match level="QueryCoverage=90%, HitCoverage=44%, E-value=5e-32, Identity=33%"; Hit description =Putative uncharacterized protein
MVEVSTEAIASLAQYYDQPLRCFTFGDFQLTPTVEEFEEILGCPPGGRKLYLFSGFYPSLTRISKIVKISTQELDWGKQVENGVVGVPRKCLEEKERTLASQDEWAPFMDVLALLIFGVVLFPNVDGLVDLTAIDAFLTFHNRKESPVVAISVDLYDTFDRRCEKNRARIVCCTLALYVRHVCPLEGHRSCTAKKEANWDQLLASKEGVSVNWFSRWKEERTGILISCRGFPNVPLMGMRGCINYNLVLTIRQLGYPMRGAPSEEGLTPFIARGFNSTSAGVL

SEQ ID NO: 182513 - protein, 221 aa, Glycine max
  Coding DNA Sequence Number=SeqID_90828
  Gene Ontology: Mol. function=phosphoprotein phosphatase activity; Biological process=intracellular signaling cascade
  Homolog annotation: Hit_ID=A7R8Y3; Match level="QueryCoverage=85%, HitCoverage=62%, E-value=1e-24, Identity=32%"; Hit description =Chromosome undetermined scaffold_3090, whole genome shotgun sequence
EMCSTTDYKVKSIGGMCILIQMWAWERCTTLAPKRTPPVIENKPLGHRWLRRGNQHIGNDDLRVFRHKLDLMKQHEFVWEPYTPTVMAALPPICVWHHPDRVLRQYGLQQPISGCPSQSQNLHGITLKGKQDKNWFHLLAPIISQWNNAAQFRVDVYPRQEGLLGFNSDYMVWYRRKTKMFVDPNNANTAALGEVVETLQYMVSPQGRNTWTVDDLVPYVD

SEQ ID NO: 182514 - protein, 124 aa, Glycine max
  Coding DNA Sequence Number=SeqID_90829
MSISPCESIDWSVLSQHSPIGCPFPPARSRRREIGIVPARHPMDPKKSNRVLGFPALITGLCQFYGVPVTPNKVIRPPTNRAFIKRYCAPRQAQDETPQQPGDGQQQATNALPPPPEPLSSSTK

SEQ ID NO: 182515 - protein, 100 aa, Glycine max
  Coding DNA Sequence Number=SeqID_90830
  Gene Ontology: Mol. function=structural constituent of ribosome; Cellular component=ribonucleoprotein complex; Biological process =translation
  Homolog annotation: Hit_ID=Q2PMP9; Match level="QueryCoverage=100%, HitCoverage=100%, E-value=5e-42, Identity=77%"; Hit description =Chloroplast 50S ribosomal protein L14
  Pfam annotation: Domain name=Ribosomal_L14; Domain location=1-100; Score=149.9; E_value=7.1e-42; Accession=PF00238.10; Description =Ribosomal protein L14pL23e
MIQPQTHLNVADNSGARELMCIRILGASNRRYAYIGDIVVAVIKQAVPNTNLERSESDQSCNFVIDQEGNPKGTRIFCAIARELRQLNFTKIVSLAPEVL

SEQ ID NO: 182516 - protein, 168 aa, Glycine max
  Coding DNA Sequence Number=SeqID_90831
VWRLPGTLWTQDKSNRALGFPALITGLCQSFGVPVTPSKVIRPPITRAFIEKYCTQRQVQGNAPQAADVPPPHQAGPAGLFDTEQYLRHLVRQQVANHRAHSQGFTSFPCPTPNQFRAEVAWPGDWPEAQAGEAPAGAPTEAPDEADEAREDEEMTDLLDFLGGSGAT

SEQ ID NO: 182517 - protein, 164 aa, Glycine max
  Coding DNA Sequence Number=SeqID_90832
  Gene Ontology: Biological process=transposition, DNA-mediated
  Homolog annotation: Hit_ID=Q1J7G7; Match level="QueryCoverage=20%, HitCoverage=47%, E-value=8e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIKLIDTVDLEGGP

SEQ ID NO: 182518 - protein, 78 aa, Glycine max
  Coding DNA Sequence Number=SeqID_90833
MEFLELKQGNMTVAEYAGKFEELFPLLVNMCRIWDEDSRDRANYYRSIGPMKNKKNGPQHWGKSYLNPPKQYGNRPNN

SEQ ID NO: 182519 - protein, 56 aa, Glycine max
  Coding DNA Sequence Number=SeqID_90834
MSPASPSRRRVGCDGHAILPRKGPVTRVMSKRLQKDWARAAKEGPRVLMNLKGSIM

SEQ ID NO: 182520 - protein, 150 aa, Glycine max
  Coding DNA Sequence Number=SeqID_90835
HLGPPDFKGRRGRTGHHATCGALPAAGPYLRLSRFQGGQAVKQKKITLSGAPADVSGLPNVAVSRHVPICTDDRSARARALGFAATAAPSYSSGLGPCPDGRVSAQLGTVTQLPVHPASPVLLTKNGPLGALDSMARLNRAAAPSYLFKV

SEQ ID NO: 182521 - protein, 219 aa, Glycine max
  Coding DNA Sequence Number=SeqID_90836
DPTDLLPEASLPNRSTYKSNPQETQRKDAHAKVEYVKRLYDQVNVQIAEKNESYTKQANKKRKEVVLEPDDDLGHLRANVFQEGGNDENPETGQIQAKGPSSHHLLPEASLPNRPTYNSKPQQTQHKDAQAKVEYVKRLYDQVKVQIAKKNESYANQANKKMKEVVLEPVDDPGHLRANVFQEGRNDENPETGQIQAKGPSGEGRRSKWRRTKPPSGEG

SEQ ID NO: 182522 - protein, 82 aa, Glycine max
  Coding DNA Sequence Number=SeqID_90837
KGIEIDPEKVKAILEMPEQRTEKQRSYGTVTCQEAFEKIKQISRIPRHDRLYPHSLWGINDDSLRGDQKDNAIGISGSLPTL

SEQ ID NO: 182523 - protein, 55 aa, Glycine max
  Coding DNA Sequence Number=SeqID_90838
MKNVHGIDHGNITEALQNLPCPSIAKIGEKVAAQLAQASCCFLQKVPDGPRWAQG

SEQ ID NO: 182524 - protein, 123 aa, Glycine max
  Coding DNA Sequence Number=SeqID_90839
MERGIKLILAPKSKSFAYINLTNRTRYRDDGSLLVGLLWRLDLLASMRSFNGDFPPWRCSRRQRRRGERRRHPLGNKPWKKELHHQDEPWIRSLEGCFNGGKERGRERERGEHEIEGIKEGEK

SEQ ID NO: 182525 - protein, 77 aa, Glycine max
  Coding DNA Sequence Number=SeqID_90840
MASSNGNFPTSMSVLIGKNYDDWCAKVNVIFQFQDVTKVVQERVQEPEKNPADAQKVAHRDLMKRDAKAWGSTEAFI

SEQ ID NO: 182526 - protein, 191 aa, Glycine max
  Coding DNA Sequence Number=SeqID_90841
MSHHSSSVNGEDTSHKDPLSRILDELSSLKLWKEKQERKEKGKKRVEEISQDERKKIREEERIKIMKEMKREKDVSYSSHNSCKSLSEELHDYYEGRHRSHLRPHSHRREKERKPQEANINLPYFHEKDNVEANLVWEIRVEQQLKKKSTSKSYGSHSYPKKNQGQGILGVTPSKPKDDKGKTIEKQAPKA

SEQ ID NO: 182527 - protein, 112 aa, Glycine max
  Coding DNA Sequence Number=SeqID_90842
MCIHLKGERCENFPERPKWTRGENVNPYPRKQKRREGKFPIKEKEKENFQSKEKKGSKEIPNQRVGESKKKGKKIPSQRKKNGKAPGQRNQKKCAERSLDRTISEQYKIVTK

SEQ ID NO: 182528 - protein, 87 aa, Glycine max
  Coding DNA Sequence Number=SeqID_90843
  Subcellular localization annotation: CTP_CleavageSite=62; ConfidenceScore=5.22e-01
MVIDYQRVKTLCFASTTGGPHFVQVQNKHSSPPYGLAPNHTPPNVAHTPMRMSTTLHPYPLRANNPKLIMYMSFNSWGRHMKYPTAI

SEQ ID NO: 182529 - protein, 243 aa, Glycine max
  Coding DNA Sequence Number=SeqID_90844
  Gene Ontology: Mol. function=structural constituent of ribosome; Cellular component=ribonucleoprotein complex; Biological process =translation
  Homolog annotation: Hit_ID=A6GZ89; Match level="QueryCoverage=45%, HitCoverage=90%, E-value=5e-39, Identity=73%"; Hit description=50S ribosomal protein L14
  Pfam annotation: Domain name=Ribosomal_L14; Domain location=1-112; Score=206.8; E_value=5.3e-59; Accession=PF00238.10; Description =Ribosomal protein L14pL23e
  Pfam annotation: Domain name=Ribosomal_L5; Domain location=187-242; Score=57.9; E_value=3.5e-14; Accession=PF00281.10; Description =Ribosomal protein L5
  Pfam module annotation: Pfam domain module=Ribosomal_L14::Ribosomal _L5; Domain location=1-112::187-242
ADNTGAKEVLVIRVLGGTRRRYASVGDKIVVTIKDSTPSGNAKKGQVSKAVVVRTKKAVRRKDGSYIKFEDNACVLLNAAGEMRGTRVFGPVARELRDKEYMKIISLAPEKDIKGKTGEVIEVIKKEGRDPRVIVAGLNIIKKHVKPSASNPQGGIVEREASIHISNVALVGKDGKAVKVGYKTEGDKKVPKLEKIILSQGLGDATADKKIIDYAVEELTNITGQKAVGTISKKDEAAFKLRK

SEQ ID NO: 182530 - protein, 86 aa, Glycine max
  Coding DNA Sequence Number=SeqID_90845
MRHQIPMIGGMMNVLSGATLFCKITHAPNIFMICVHRDSLGRNNQHENKEKGVEERIPKFQEPMDLRSNPFQGGWNDAILPPKGIG

SEQ ID NO: 182531 - protein, 266 aa, Glycine max
  Coding DNA Sequence Number=SeqID_90846
  Gene Ontology: Biological process=response to stress
  Homolog annotation: Hit_ID=P32292; Match level="QueryCoverage=33%, HitCoverage=91%, E-value=6e-23, Identity=67%"; Hit description =Indole-3-acetic acid-induced protein ARG2
  Pfam annotation: Domain name=LEA_3; Domain location=1-91; Score =156.9; E_value=5.7e-44; Accession=PF03242.4; Description=Late embryogenesis abundant protein
  Subcellular localization annotation: CTP_CleavageSite=33; ConfidenceScore=5.20e-01
MARSFSNVKVLSALVADGFSNTLTRRGYAAATQSATRGGAASISSKIAPKSGEDKVGGGAEKVSWVPDPVTGYYKPENIKEIDVAELRATGGFSVSQFEFPNSKTIAIQAATALRGDEEVIEGKGSGGDADGEIEIIAETNDVENAEPEEEDLHANPPEFGEPAVGYVDGDDFLVTQLVRTFEGETARTVQIGVEFSAGRVQLVAGHSFRENACRKVKALQHLVRRRGAGGGDRRRRRKAGLGFGDSGGFNTSRFCMFWDDGMEGD

SEQ ID NO: 182532 - protein, 271 aa, Glycine max
  Coding DNA Sequence Number=SeqID_90847
  Gene Ontology: Mol. function=binding; Cellular component=nucleus; Biological process=activation of protein kinase C
  Homolog annotation: Hit_ID=A7Q0E2; Match level="QueryCoverage=99%, HitCoverage=70%, E-value=4e-97, Identity=48%"; Hit description =Chromosome chr7 scaffold_42, whole genome shotgun sequence
  Pfam annotation: Domain name=PPR; Domain location=105-139; Score =10.8; E_value=0.41; Accession=PF01535.11; Description=PPR repeat
  Pfam annotation: Domain name=PPR; Domain location=34-68; Score=22.9; E_value=0.0012; Accession=PF01535.11; Description=PPR repeat
  Pfam module annotation: Pfam domain module=PPR::PPR; Domain location =105-139::34-68
MSCARLGALEHGKWVHAYIDKTGMKIDVVLGTSLIDIAMITAFAMHGLSEECLELFARMVNDGVRPNAVTFVGVLCACVHGGLVSEGNEYFKKRMKEYGVSPTIQHYGCIVDLYSRAGRIEDAWSVVKSMPVEPDVMIWGALLSGLGCMGTLKLVREVRHLRDGGPGNQETSRRLEKHGYERNTGEVLLDLDEEGKEFALSLHSEKLAIAYCFLRTSPGTTIRIVKNLRICSDCHVAIKMISREFNWEIIVRDCNRFHHFKNGLCSYKDYW

SEQ ID NO: 182533 - protein, 478 aa, Glycine max
  Coding DNA Sequence Number=SeqID_90848
  Gene Ontology: Mol. function=DNA photolyase activity; Cellular component=mitochondrion; Biological process=protein-chromophore linkage
  Homolog annotation: Hit_ID=A9PD20; Match level="QueryCoverage=71%, HitCoverage=71%, E-value=1e-143, Identity=73%"; Hit description =Putative uncharacterized protein
  Pfam annotation: Domain name=DNA_photolyase; Domain location=89-266; Score=123.7; E_value=5.4e-34; Accession=PF00875.9; Description=DNA photolyase
  Subcellular localization annotation: CTP_CleavageSite=10; ConfidenceScore=5.37e-01
MEAEKHEAALAVASVSLSLPRVLPFFQPTTPQPTKLKVPTQASSLTHLSLSTPSKTSFKSTISSTPLHAPLSLGPHRPRDPSNAAALRRAAVVWFRNDLRLLDNECLTAANNESLSVLPVYCFDPADYGKSASGFDKTGPYRAAFLIDSVSDLRRNLQARGSDLVVRVGKPEAVLVELAKAVGADAVYAHREVSHDEAKAEERVEAAMKEENVEVKYFWGSTLYHVDDLPFQLEDMPSNYGGFRDRVQKLEVRKTIEALDQLKGMPSRGDVEPGEIPSLMDLGLNPSATMSQVIIVQNGKCVANASMVGGETEALQKLKKFAAECAAQPHKGFKDGTQSIYGANFSCKISPWLAMGCLSPRTMYEELKKTAGRVISASSNRNDGGNGSSRTGTNWLMFELLWRDFFSCHHDIGFGNPFLPVIFIIVWGFLVFEWCTCLSLKLEVSHSPNLEMFITKKYSTAKKQLEAAPATACAGAFA

SEQ ID NO: 182534 - protein, 93 aa, Glycine max
  Coding DNA Sequence Number=SeqID_90849
  Gene Ontology: Mol. function=structural constituent of ribosome; Cellular component=ribonucleoprotein complex; Biological process =translation
  Homolog annotation: Hit_ID=A7Q8D3; Match level="QueryCoverage=66%, HitCoverage=49%, E-value=3e-25, Identity=91%"; Hit description =Chromosome chr5 scaffold_64, whole genome shotgun sequence
  Pfam annotation: Domain name=Ribosomal_L22e; Domain location=6-91; Score=56.5; E_value=9e-14; Accession=PF01776.8; Description =Ribosomal L22e protein family
MSGAKGKKKGASFVIDCAKPVEDKIMDIASLEKFLQERIKVGGKAGALGDSITVTRDKSKITVTSDSNFSKRYSLHHAPLAEIFRRIDLGPCY

SEQ ID NO: 182535 - protein, 191 aa, Glycine max
  Coding DNA Sequence Number=SeqID_90850
  Gene Ontology: Mol. function=catalytic activity; Cellular component =Golgi apparatus; Biological process=cellular metabolic process
  Homolog annotation: Hit_ID=A7Q0D4; Match level="QueryCoverage=91%, HitCoverage=39%, E-value=2e-92, Identity=93%"; Hit description =Chromosome chr7 scaffold_42, whole genome shotgun sequence
  Pfam annotation: Domain name=Epimerase; Domain location=1-109; Score=- 46.5; E_value=0.0011; Accession=PF01370.12; Description=NAD dependent epimerasedehydratase family
MEGGGTWLQDSVRSCYDEGKRTAETLTMDYHRGAGVEVRIARIFNTYGPRMCLDDGRVVSNFVAQALRKEPLTVYGDGKQTRSFQYVSDLVEGLIRLMEGEHVGPFNLGNPGEFTMLELAKVVQETIDPDARIEYRPNTEDDPHKRKPDISRAKDQLGWEPKVDLRKGLPLMVSDFRQRIFGDQKEKATVA

SEQ ID NO: 182536 - protein, 82 aa, Glycine max
  Coding DNA Sequence Number=SeqID_90851
MMGGMARRCRNRSDSNRRIEVLQTHALATWLRFPINSMSFSLVLLCFTEYNKSICLTPPLPLQLKMPQGITSGVWILSIGIA

SEQ ID NO: 182537 - protein, 140 aa, Glycine max
  Coding DNA Sequence Number=SeqID_90852
  Homolog annotation: Hit_ID=A5AKF5; Match level="QueryCoverage=55%, HitCoverage=4%, E-value=6e-08, Identity=38%"; Hit description =Putative uncharacterized protein
MRLSHEVLKVTVELSSSVGLSAASVHLARQKNLAKHQYLGLALSARSATPFECKDVPYPLVPSRKDKERHLARLLDIFKKLEITMPFGEALQQMPLYAKFLKDMLTKKNRYIHNDRIVVEGKALIDLGASINLMWKQCLP

SEQ ID NO: 182538 - protein, 396 aa, Glycine max
  Coding DNA Sequence Number=SeqID_90853
  Homolog annotation: Hit_ID=Q6WAY6; Match level="QueryCoverage=87%, HitCoverage=64%, E-value=2e-24, Identity=27%"; Hit description =Putative uncharacterized protein
MVEVPIEAIASLAQYYDQPLRCFTFGDFQLSPMVEEFEEILGCKGEWAPFIDILALLIFEGVHFPHVDGLVDLAAIDAFLAYHDHKESPVVAMLADLYDTFDRRCEKSSMRIVCCTPALYVWLVSHLFRQEVRHACPLESHRSCTEKGGANWDQLLANKEGASINWFPRWKEGRIGVLISCGGFPNIPLMGMRGCISYNPVLAIRQLGYLIRGAPLEEELAPVISRGFNKTNMETLQKVRKAWEVLQKKDKELRGSNNGPIGGYHKWLKVHMQGLEWLPSLRTTNGSQTVKERFKSAALKILKENAELRDINIATTEALEQETKRARREEHSQNKFQGALWRNNSELKLWREEMDQSRVDSLILKDELKVCSRSKRNLSQRLCETKTNMLAIIRKY

SEQ ID NO: 182539 - protein, 314 aa, Glycine max
  Coding DNA Sequence Number=SeqID_90854
MAPKKLSTKRSRKDAAGEGSSATLEFDSHRFWSVEHQQRFEAIKGWSFHREMRVQLREDEYPDFQGEIAHRHWARLVTLMSKFDQEIVIEFYTNAWPIEEGVRDMRSWVRGHWIPFDADALSQFLGDSLILEENQRNQVDSFDEEAITQLQCIPGQDFARTAAWRRVRIMRTSMTTLTQMWMTLLLSNDLPSDHNSDLPLPKCQLAYAILTRMSVHVAQVIADAIYLFAGMAPTRHPLDPEKSNRALGFPVLITGLFQFYGVHVTPSKVIRPPITRAFIEKYCTPRQVQGDAHQTAGASPPPRQADSAGPLSVE

SEQ ID NO: 182540 - protein, 274 aa, Glycine max
  Coding DNA Sequence Number=SeqID_90855
MGLIWLNEGSCRLLPCLGIGPVSKPCNLTPKLLRSRARKRGGTLPPLTEAELVETLVYLHLPTVVGHLLANQMLWWRYVCGLMFITLRLPRRAVLLDEGLGDRWSDYFTGGDGNSEELAEARDQCRKPQGPVGLIWVQRVPVVIARQDIAEQQCHPCLGQSGHSGAHDPHPPPCSGPSEILPRCAQQLSNGFLIEPVGPVPLLAELTLLAFLQTSESPRNWIRASASKGITDPSPTNASAFNVCELSPPESPDTHPPELTLPFLAMTSSDGLNA

SEQ ID NO: 182541 - protein, 158 aa, Glycine max
  Coding DNA Sequence Number=SeqID_90856
  Homolog annotation: Hit_ID=Q6WAY6; Match level="QueryCoverage=25%, HitCoverage=7%, E-value=1e-10, Identity=68%"; Hit description =Putative uncharacterized protein
GRTGILISCGEFPNVPLMGMRGCINYNPVLAIRQLGYPMRGAPLEEGLTPFIARGEVAMGPPIGGYRRWLKAHAQGLDWLPNLRTTKEVEGEAPEEDEENAELRDINIATIKALEQETKRARKEEHGHNKFRGALWGQLQEAWARATKEGPRVLMNLR

SEQ ID NO: 182542 - protein, 53 aa, Glycine max
  Coding DNA Sequence Number=SeqID_90857
  Homolog annotation: Hit_ID=A5AYU6; Match level="QueryCoverage=100%, HitCoverage=13%, E-value=3e-08, Identity=46%"; Hit description =Putative uncharacterized protein
MTGDASKFTYISPKKSGHVTYGDNNKGRILGVGLKHNLLSVSQLWVTKLIVIF

SEQ ID NO: 182543 - protein, 152 aa, Glycine max
  Coding DNA Sequence Number=SeqID_90858
GSNSELKLQREERDQSGVDSLILKDELKVFSKSKRNLSQRLCETETNMLAIVSKYQEELNLATAHEHKMADEYARVYAEKEARGRVIDSLHQEATMWMDRFALTLNGSQELPRLLAKAKAMVDTYSAPEEIHRLLSYCQHMIDLMTHIIRNR

SEQ ID NO: 182544 - protein, 383 aa, Glycine max
  Coding DNA Sequence Number=SeqID_90859
  Gene Ontology: Mol. function=hydrolase activity, acting on ester bonds; Cellular component=nucleus; Biological process=biosynthetic process
  Homolog annotation: Hit_ID=A8GHD5; Match level="QueryCoverage=93%, HitCoverage=27%, E-value=1e-129, Identity=67%"; Hit description =Amino acid adenylation domain
  Subcellular localization annotation: CTP_CleavageSite=38; ConfidenceScore=5.15e-01
ERRRYGGGAGGAVGIALSGQPSFSAGFIFMRRTGSAALCAAGPVINVLPMEMHLEPQATLYEAAARISRELKTVRRHQRYDAEQVQRDLGRIGDGEPLYGTVFNFKMFDYQLDFAGIEGITHDLASGPVRDLEIALFIDEHHQLKVELLANAERYGRQELQAHLQRLPLLLAQFAAQATLPIGEADMLTADDHALLARVNDTAHPVPATTLSQLLAQQAQTTPDAPALADAHFNFTYRETREQVMALARELVAQGVRPGDIVAVALPRSVFLSLALMAIVEAGAAYLPLDTGYPDERLAMMLEDAAPRLVITNPAQQARFADKGEILLYDAPLPADHAAGVAIAGPTPNHAAYIIFTSRLHRASESVLVGHQRSSTVLLWMHT

SEQ ID NO: 182545 - protein, 77 aa, Glycine max
  Coding DNA Sequence Number=SeqID_90860
MTHYNPYPRKQKRKEGKFTIKEKAKRKERKFPIKEWEKAKRKERKFPIKEWEKAKRRERKFPTKEWEKVKKGWKESS

SEQ ID NO: 182546 - protein, 198 aa, Glycine max
  Coding DNA Sequence Number=SeqID_90861
MTPKKLSAKRSRRDAAVEGTSAAPEFDSHRFRSAEYQQRFEAIKGWSFHRERRVQLRDNEYTDFQEEIARRHWTSLVTPMAKVDLDIVLEFYANAWPTEEGVRDMRSWECEFSQRRNRVDGFDEEAIGQLLCIPGQDFARTAVERRVRIMRTSMTTLTQMWMTLLLRNVLPSDHNSDLPLLKCQLVYAILTRMSVHVA

SEQ ID NO: 182547 - protein, 53 aa, Glycine max
  Coding DNA Sequence Number=SeqID_90862
MNGWTEVVRLVGLPFAQCQCIAHPSSRFFLTLNKGVLRSADGSLSQKIGLARG

SEQ ID NO: 182548 - protein, 176 aa, Glycine max
  Coding DNA Sequence Number=SeqID_90863
  Homolog annotation: Hit_ID=Q6WAY6; Match level="QueryCoverage=88%, HitCoverage=24%, E-value=8e-17, Identity=39%"; Hit description =Putative uncharacterized protein
MDGLVDLAAIDAFLAYHDHKEIPIVAMLADLYDTFDRRCEKSGTWIVCCTRALYVWLVSHLFRQEVRHACPLESYRSCTEKGGTNWDQLLANKEGASINWFPQWKEGRIGVLISCGGFPNVPLMGTRGCISYNLVLAIRQLGYPMRGAPLEEEIAPVISRGFNKTNVETLQKVRMA

SEQ ID NO: 182549 - protein, 89 aa, Glycine max
  Coding DNA Sequence Number=SeqID_90864
  Subcellular localization annotation: CTP_CleavageSite=22; ConfidenceScore=5.44e-01
NPCGVYPDLSSFTGSGVYPDLSSFTGSGVYPNLSSLTGSGVYPDLSSFTGSGVYPDLSFFTGSGVYHDLSSFTGSGVIQTFVACIKRSA

SEQ ID NO: 182550 - protein, 132 aa, Glycine max
  Coding DNA Sequence Number=SeqID_90865
  Gene Ontology: Mol. function=phosphoprotein phosphatase activity
  Homolog annotation: Hit_ID=A5AWR0; Match level="QueryCoverage=72%, HitCoverage=9%, E-value=2e-16, Identity=50%"; Hit description =Putative uncharacterized protein
MEARNTYVSHEMWRVYNYSSRCLSIIRYACCVLRVDGVPLIGQTNLDWAELCEELLGVRLQEGELQGNVVKLSWLAHHFSHINNHDGNVEQLQWFTRAWILRFIGGVLFVDKSSSKVSLRYLQFLRDFEQCS

SEQ ID NO: 182551 - protein, 146 aa, Glycine max
  Coding DNA Sequence Number=SeqID_90866
MVKEECKEVSVSSKRLAKKESHFEIKTNIKETSPLGQPPHILLCKKTLVSTVTPLGLEVIPQVKELLDEGLVRIIRHQIPKISDMMNVLSVEILFRKISHAPNIFMSHVHRDSVGRNNQHENIEKVIKGFPRTLREYRSFLNGLLH

SEQ ID NO: 182552 - protein, 51 aa, Glycine max
  Coding DNA Sequence Number=SeqID_90867
RRGGSLQAQGEAPQQPGDGQQRTTDAPPPPLESTSTHLQRLESFLRHMVDQ

SEQ ID NO: 182553 - protein, 187 aa, Glycine max
  Coding DNA Sequence Number=SeqID_90868
  Gene Ontology: Mol. function=glutathione gamma-glutamylcysteinyltransf erase activity
  Homolog annotation: Hit_ID=Q2TE74; Match level="QueryCoverage=31%, HitCoverage=12%, E-value=6e-16, Identity=69%"; Hit description =Glutathione gamma-glutamylcysteinyltransferase 2
MVDVSPIKANIVEQIRTTGLFKHVTRWLDSESSCCNTLANLGDKDMLPALVVSVCCQAADLLTICGKLKTLTESTIRERALTAQHSSMITISKFEYEYLTNHAASVEEIADKKVAAAEAWIEALKASEKEIMMETKIAQRQLKESKLEQELEVYTKEKMLSRRVSSSEELDNWPRKCEKSSSKNFIV

SEQ ID NO: 182554 - protein, 295 aa, Glycine max
  Coding DNA Sequence Number=SeqID_90869
MAKFDPDIVLEFYANAWPTEEGVRDMRSWVRVLEEGQECEYGQRRNRSDGFDEEAIAQLLCMPGHDFARITAGRWVRIMRTNMTTLTQIWMTLLLSNIQPSDHNSGLPLPKCHLVYAILTRMSIHVAQLIADAIYLFAGTAPTRHPLDPDKSNRALGFPALITGLCQSFGVPVAPSKATDASPPHRAGLAGSFDTEQYLRHLVRQQAANHRAHVQTHDCLYQMSLSLQSQGFTSFPCPTPDQFRVEVAWPRDWPEARAGEAPAEAPAETPDEADEAREDEEMTDLLYFLGGSGAT

SEQ ID NO: 182555 - protein, 125 aa, Glycine max
  Coding DNA Sequence Number=SeqID_90870
MLIDVGNALACACCVCSWRALCTDLPGSLALAFGHVHTLDVVYDRGGHCALTFQGGLSPGREHLWAPKLITYGRGDATCTTGWSRQTHHSSLSESVVWTRLGYFLRFGCCCLDWVHGWMMSNCWM

SEQ ID NO: 182556 - protein, 91 aa, Glycine max
  Coding DNA Sequence Number=SeqID_90871
MGLNQAHAFKKRKERALRHPYRTHARSRVISEIEEVQEQMKADMEPMKEQMTTMMEAMMSMRKMMEVNMSTVVTASTATEVDPTHPSSLNQ

SEQ ID NO: 182557 - protein, 307 aa, Glycine max
  Coding DNA Sequence Number=SeqID_90872
  Subcellular localization annotation: CTP_CleavageSite=18; ConfidenceScore=5.48e-01
MATPPSFPPPPPESATPSQSTSKKTRKETRLRSLATRPVGAERPVVHVDPWKKEKLMEEVAQSESTNTSIDPPSPIRPHVKWKMARMKISGQITSHATKERIGSLEEQASQGSFVAHGREDVLTIAIVPPEHPSRVRAAGVGVTIKKIPWTGFKELPTSSSMAPEDLEQLTQKIGDQLEESITEKSDAIIGLAPPPKVEVSPSTACVNTMEIYVDLSRQDPEMGDSGKFYEGSTTVYNVPLGNDQVKVDVEEVRDVDAHITGAEGPAKPVDRSNPDVNLLYLMTLTILQLFTKLLQVSWDATVFGGV

SEQ ID NO: 182558 - protein, 58 aa, Glycine max
  Coding DNA Sequence Number=SeqID_90873
MWQWGVDCITNNVEGTELLGEGRSGRPQGLVDLLLQWGLGLLENDEDGFYEMATLRGE

SEQ ID NO: 182559 - protein, 354 aa, Glycine max
  Coding DNA Sequence Number=SeqID_90874
  Homolog annotation: Hit_ID=Q5JJM4; Match level="QueryCoverage=40%, HitCoverage=20%, E-value=7e-08, Identity=37%"; Hit description =Peptidylprolyl cis-trans isomerase-like protein
VESTTIEKEELAKIVADLQAQLKESESKLEESELRASKGREVSKELEEELLVLKKETMEQHENGFYKAVRDLDLGIFYPTKDMKDGELLREEEIVAAKEVDLGFDEPLEMRDSPRADLGFDEPLECETHQGVDFEFDKPLEIHRGSPRADLGFDKPLVMQDSPRADLGFHKPLEKRDSPREDLGLDEPLEKRDSPRANLEFDEPLEMRDSPRADLGFDEALEMRDSPRVDLGFDEPLEKQDLPRQTLSLMSLWISVEASQGQNLGLTSLCLWRNKIHQGRTFDLMSLWKSETYQGRTLDLTSLWRCKTHQGKTLGSTNLWRSIKAHQADLGFDEPLKKRDSPRVNLGFNEPLYG

SEQ ID NO: 182560 - protein, 36 aa, Glycine max
  Coding DNA Sequence Number=SeqID_90875
MAKGLYRLKMIPIKSKYKFDFAGSSIPNFSAFSFKG

SEQ ID NO: 182561 - protein, 63 aa, Glycine max
  Coding DNA Sequence Number=SeqID_90876
MAVMRTESDTKEGGKRVFFLIFLDPSSPRLASGFPRPWNYLLDKQPARLGELITSGLRFSSAG

SEQ ID NO: 182562 - protein, 166 aa, Glycine max
  Coding DNA Sequence Number=SeqID_90877
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=95%, HitCoverage=45%, E-value=6e-36, Identity=47%"; Hit description=CTV.20
MVATAYQTSHECLEETIVDILVAGFSVWKDRSAELLYNLKCRTLADFRWYRDTFLTRVYTREDSQQPFWKEKFQAGLPRSLGDKVRGKIRSQSINGDIPYDNLSYGQLISYVQKVALKICQDDKIQRQLAKEKAQTKKDLGSLCEQFRVSSLSKTKEKTKPQKRIS

SEQ ID NO: 182563 - protein, 101 aa, Glycine max
  Coding DNA Sequence Number=SeqID_90878
  Subcellular localization annotation: CTP_CleavageSite=47; ConfidenceScore=5.68e-01
MALPGAVHASSTFEPAAPRSYCVVLFGNSPFSAFFRSPMNVISKRCSCMLHQRVWSPAKLLRSAVRQFSILHFFMEPHECHCLALFMHPPPTSLEPSDVIA

SEQ ID NO: 182564 - protein, 123 aa, Glycine max
  Coding DNA Sequence Number=SeqID_90879
MIRGDTLRLSAPFCHPEAAGPMTSRDQVWSFCTLVSSRGGGPDDTRRYLTVIRTLLSSRGGGPDDKQRPSLVILHPCGGPDDTQRYLTVIRTLLSSRGGGPDDKQRPSLVILHPCIIQRRRGR

SEQ ID NO: 182565 - protein, 42 aa, Glycine max
  Coding DNA Sequence Number=SeqID_90880
MTKARQKGVRKIPGGLNILFYPPPPINRKKREKLATQLAQAS

SEQ ID NO: 182566 - protein, 242 aa, Glycine max
  Coding DNA Sequence Number=SeqID_90881
  Gene Ontology: Mol. function=phosphopentomutase activity; Cellular component=cytoplasm; Biological process=deoxyribonucleotide catabolic process
  Homolog annotation: Hit_ID=A7ZVS6; Match level="QueryCoverage=64%, HitCoverage=38%, E-value=1e-83, Identity=95%"; Hit description =Phosphopentomutase
  Pfam annotation: Domain name=Metalloenzyme; Domain location=69-178; Score=143.0; E_value=8.3e-40; Accession=PF01676.9; Description =Metalloenzyme superfamily
MAALSRVRLSATKAGNFQRTGNRHDLAVEPPAPTVLQKLVDEKGGHVVSVGKIADIYANCGITKKVKATGLDALFDATIKEMKDAGDNTIVFTNFVDFDSSWGHRRDVAGYAAGLELFDRRLPELMELVGEDDILILTADHGCDPTWTGTDHTREHIPVLVYGPKVKPGHVLNDVGCGLMPSPRPSPTGRGRRSGKAKPPPDTHFQALCFSQLNTTSWWLLVLKSSNTCSILPSASIRKLMR

SEQ ID NO: 182567 - protein, 227 aa, Glycine max
  Coding DNA Sequence Number=SeqID_90882
  Homolog annotation: Hit_ID=A2Q4S5; Match level="QueryCoverage=68%, HitCoverage=26%, E-value=8e-20, Identity=36%"; Hit description=IMP dehydrogenase/GMP reductase, putative
  Pfam annotation: Domain name=DUF1723; Domain location=95-144; Score =56.8; E_value=7.3e-14; Accession=PF08330.1; Description=Protein of unknown function (DUF1723)
MTEDVPDMAEDAPEMTADVQANDGAEGSHADDAEGFPGGPRDPSVLTSFADHERPELKLVSHGRKVTLIGRPVPEIEGLVGATGLSPLIGCSVVTGDPGLISAFVERWHRETSTFHLLVGELTITLDDVSSLLHLPISGAFHSFHALSVDEAIFLLTELLEVSAEEARPETTRSHGAYVRLGWVRDIYEMRCKARRWIVAARAYLLHPGRFALFLPTRVQHMFMWCI

SEQ ID NO: 182568 - protein, 76 aa, Glycine max
  Coding DNA Sequence Number=SeqID_90883
MTVEWRRNRERRHHFKEKMSLEEARHQRRPWIRAWRKKEMNKGRGREEHKILCSKRALKSEPTNPRSIPRFSTKCA

SEQ ID NO: 182569 - protein, 271 aa, Glycine max
  Coding DNA Sequence Number=SeqID_90884
  Homolog annotation: Hit_ID=Q84VH5; Match level="QueryCoverage=91%, HitCoverage=37%, E-value=2e-74, Identity=62%"; Hit description =Envelope-like protein
  Subcellular localization annotation: CTP_CleavageSite=21; ConfidenceScore=5.07e-01
MATAPKETSAPGSPSVPSSPSSTKAPSNQEQPEFHIQPIQMIPGQAPVPEKLVPKQQQGVKTSENPSLATSPREVDTEMDKKIRSILMKMSQHLPPQMFSVPDADKDVPTSSTPNTEVLPSPSEEESTEEEDQATEETPAPRAPEPAPGDLIDLEEVESDEEPIANKLAPGIAERLQSRKGKTPITRSGRIKTMAQKKSTPITPTTSRWSKVAIPSKKRKDISSSDSDYDVELDVPDIKRAKKSGKKTCLGKRTGKRCLGLQGDHGPHQGC

SEQ ID NO: 182570 - protein, 111 aa, Glycine max
  Coding DNA Sequence Number=SeqID_90885
MGEVEEVQEQMKADMEAMKEKMATMVEAMISMKKIMEANAVAVAATRAVAKVNPMPPSDLNQMSHPTLDMVGKDLGSTSGPHYVQIQNKHAFTPYGLPSNYTPPNVAYTPK

SEQ ID NO: 182571 - protein, 73 aa, Glycine max
  Coding DNA Sequence Number=SeqID_90886
MNDSRWKQELSPYNQYEEERTPNLKTRREEDLVEVKAQEENPIKEHELREKDEEKDEEQAQQQWKKYSTVENQ

SEQ ID NO: 182572 - protein, 23 aa, Glycine max
  Coding DNA Sequence Number=SeqID_90887
MSGTHSERGHSTAQPLNPGVRLP

SEQ ID NO: 182573 - protein, 39 aa, Glycine max
  Coding DNA Sequence Number=SeqID_90888
MYIFVKYFAIYMRVPGVDRLIQATEVWMTPLPVKEDKSG

SEQ ID NO: 182574 - protein, 94 aa, Glycine max
  Coding DNA Sequence Number=SeqID_90889
MIMKVDGEITSESEISEEEVEEEECEEEAMQGDMLMVRRLLGNQMQPLDDNQRENIFSHQYPMEATAHGGCVLIVGAMNNDHHQEYEAPNPQVR

SEQ ID NO: 182575 - protein, 49 aa, Glycine max
  Coding DNA Sequence Number=SeqID_90890
MKNEERTGNQGPLTSAFPHLFIAKQGIWDKGSSPRRAGYFIMKQPCSPR

SEQ ID NO: 182576 - protein, 20 aa, Glycine max
  Coding DNA Sequence Number=SeqID_90891
LCGQEHPPGAAATGGATVPE

SEQ ID NO: 182577 - protein, 40 aa, Glycine max
  Coding DNA Sequence Number=SeqID_90892
MSLSLEDKLIRQALESAVFYLLAKPTCWLSERPLSATLMG

SEQ ID NO: 182578 - protein, 122 aa, Glycine max
  Coding DNA Sequence Number=SeqID_90893
AAPVRKAARLWTERPAPWRAACGAAPDSGRPGFRSRAAVRENLPPLAERTPPIACRAPDSTPPTAGALRAAGRPLSDRPGGWPGAGPAPAGKINAQSRPFSVLIADIFYHLFAVVKFSVGYT

SEQ ID NO: 182579 - protein, 62 aa, Glycine max
  Coding DNA Sequence Number=SeqID_90894
MHDLHRSQSMFYNESNDVEYGNFYISGDVGTAVVSCAFYIVFHKAMMLNMGTSTSVVRYALM

SEQ ID NO: 182580 - protein, 149 aa, Glycine max
  Coding DNA Sequence Number=SeqID_90895
MIPHGGHREDSCLMHSGILHDMETCSAVRNLLQQMIDQGRLEVGNEGEEEQHVYMQSVDKEGPKKPKPLVIHFTRDTAPPRPQHPSAVSGGRPIPFPYENNHAVPWRYAPLGGRKEEAIDIGSLSAKVTNITGLSGITRSGRVFAPLPC

SEQ ID NO: 182581 - protein, 127 aa, Glycine max
  Coding DNA Sequence Number=SeqID_90896
MAGTFFLLKQQNSLEIMSGKKEMTPNRVGRHTQRKDAHAKVEYVKRLYDQVKMQIAKKNESYVKQAHKKRKEVVLEPGDDPEHLRTNVFQEGGNDENHETGQIQAKGPSGEGRRLKWRSTKPPSGEG

SEQ ID NO: 182582 - protein, 87 aa, Glycine max
  Coding DNA Sequence Number=SeqID_90897
MRGAPSEKSIMPFIARGFSDPNARVLQGVRKAWDAVRRKEKELKGSSNGIIGNYRRWLRVQTQGLDWLPKLKAARDEEAKALEESEE

SEQ ID NO: 182583 - protein, 193 aa, Glycine max
  Coding DNA Sequence Number=SeqID_90898
  Pfam annotation: Domain name=FAR1; Domain location=100-184; Score= -25.1; E_value=0.029; Accession=PF03101.6; Description=FAR1 family
MCRGFIGSLCLVGYEIRCGEGEGTGVEHCGGRRRHSRYAEGGAAIGKMDEDEWMYESIMPEEAHMDYQNEEACGVNEPYVDYSDAFKTSQDVLRWARSIAHESRFVTMILRSDTNTSSRGRTLFVLIGCERRCEYRCRKKEFIRRDTRTRKCGCPFKLHCKPVVGGEGWMVKLICGVHNHELAKSLVGHPYAE

SEQ ID NO: 182584 - protein, 105 aa, Glycine max
  Coding DNA Sequence Number=SeqID_90899
MHCKDKISIFQPVAMCPFAGERRRGSRVRFPKEERCAESPPTFIYGKRQKNRRKPIEMKILSSGVVFTFKEGRQKRALAPTYPPSKRKSDLRSSFLCVNQVILFT

SEQ ID NO: 182585 - protein, 79 aa, Glycine max
  Coding DNA Sequence Number=SeqID_90900
MQIAIGNDEFVADWTCGTQTANASGSETASLTGEFLKPQGYGAGAGAPVVGVQCRAASLTSWALVIAIIAGDLSSSGGL

SEQ ID NO: 182586 - protein, 367 aa, Glycine max
  Coding DNA Sequence Number=SeqID_90901
MGSNQAFSFTKRFAHVKVSTSDLSMMEDFEKILGCPLGGTKPFFPSGHSPSIPRLSEVLGIPVTELREKEVNRNEVVFFPSMIDWIDLAAVDMFLAYYYRRESPMVSILADVYCTLDSSWEKKSTRVICCFPALYVWMVSHFVMHNGMPTCPLEDFCMVPDKRKINWEELLASTTGLNKEHLSMHQQIRKVWDSPNRRDKELRKKDEEVKLPKKTNGERVEIDVPIEQRRKECNRLRDVNMSKTEALEREMRRAKGEETNRRRYQGALSGNSNELKLRSAERDQTIAENVTLRDELKDCWESKESLKERLGMMEKSMLVIVDQYEVKMVRERQVLATIHGQAEVLALQGEREAGEEVIELLHQESRK

SEQ ID NO: 182587 - protein, 82 aa, Glycine max
  Coding DNA Sequence Number=SeqID_90902
  Gene Ontology: Mol. function=nucleic acid binding; Cellular component= nucleus; Biological process=mRNA processing
  Homolog annotation: Hit_ID=Q9FT01; Match level="QueryCoverage=100%, HitCoverage=34%, E-value=5e-22, Identity=47%"; Hit description =Putative splicing factor
RFRDKNEVAEPKADPERDQRTVFAYQMPLKATETDVYEFFSKAGKNLVQSNASGGAAGVTGPYGVVDRKLYVGNLHFNMTES

SEQ ID NO: 182588 - protein, 87 aa, Glycine max
  Coding DNA Sequence Number=SeqID_90903
  Gene Ontology: Mol. function=nucleic acid binding; Cellular component= nucleus; Biological process=mRNA processing
  Homolog annotation: Hit_ID=Q9FT01; Match level="QueryCoverage=95%, HitCoverage=34%, E-value=4e-23, Identity=48%"; Hit description =Putative splicing factor
MDPARRFRDKNEVAEPKADPERDQRTVFAYQMPLKATETDVYEFFSKAGKNLVQSNASSGAAGVTGPYGAVDRKLYVGNLHFNMTES

SEQ ID NO: 182589 - protein, 83 aa, Glycine max
  Coding DNA Sequence Number=SeqID_90904
  Gene Ontology: Mol. function=signal transducer activity; Cellular component=nucleus; Biological process=G-protein coupled receptor protein signaling pathway
  Homolog annotation: Hit_ID=A7PBZ1; Match level="QueryCoverage=63%, HitCoverage=6%, E-value=8e-18, Identity=77%"; Hit description =Chromosome chr2 scaffold_11, whole genome shotgun sequence
MAIGDLEAFFPAATREYAPMVDEIWKDPAVQETYKTKKELHNLPNVAKYFLDRKDTPMVPIGGDTSSDTLPWGLRHSFGYFDS

SEQ ID NO: 182590 - protein, 163 aa, Glycine max
  Coding DNA Sequence Number=SeqID_90905
  Gene Ontology: Mol. function=microtubule motor activity; Cellular component=microtubule associated complex; Biological process =microtubule-based movement
  Homolog annotation: Hit_ID=A2Q2F8; Match level="QueryCoverage=34%, HitCoverage=9%, E-value=1e-11, Identity=59%"; Hit description =Kinesin, motor region
WESQGVTHLQYARVNLVDLAGSKRQKNSGAEGERLKSATTSVVTFDTCRKLVVDIPSKATIAASTNPLHTLRANHKPSFHFPFAKVCDFLQAKITIAFVGIGEKNAGLVLRAEQRGGGEADIVVARRLEFLASAQSSEDSSTFPFDIESAVRSSNNTVSDTFS

SEQ ID NO: 182591 - protein, 322 aa, Glycine max
  Coding DNA Sequence Number=SeqID_90906
  Homolog annotation: Hit_ID=A7P4G2; Match level="QueryCoverage=78%, HitCoverage=17%, E-value=3e-61, Identity=50%"; Hit description =Chromosome chr4 scaffold_6, whole genome shotgun sequence
MDSSSLYILSRSWALVLLNFHTFMINSTPKLYCDKEEFPYELLHPLEDCNVNSSLSFTLQICRVEDILVEGLIKGSIVHFHRARTISVESSRTISASRIGCTGGLGHGNTLSNGIGSGGGHGGTGGEAFYNDNHVEGGYSYGNATLPCELGSGSGNGNSTRTTAGGGIIVVGSLEHPLSSLSIQGYVKADGGNFEPQIRNEKFAIFDNFTGGPGGGFGGTILMFLHMLTIGKSVVLSSIGGYSSSNGSGGGGGGRIHFHWSDIPTGDVYLPIASVKGDIQIWKPWKQQGCPIPLSIRDGCSLKQPWEEHMREYEHNPIIDQI

SEQ ID NO: 182592 - protein, 187 aa, Glycine max
  Coding DNA Sequence Number=SeqID_90907
MVDFTLLLPRDETRLPARKPPLMHREKRGKLGPTLSKQRRSACQLVPPMEGRKSWDSYFMWGISKCSLDGDEGLHQLQSRPRLRQLGYPLRGAPSEEGLTPFIARGFNSTNAGVLQRVRKAWEMVQRKDKELRGSSNEPIGGYHRWLKAYTQGMYWLPNLRTTKKVEGEASEKDEEIQALKTELEKD

SEQ ID NO: 182593 - protein, 110 aa, Glycine max
  Coding DNA Sequence Number=SeqID_90908
MALKHKVQSLIEAGWLTFQEDGPNVKMNLLANHGGLDVNAIEACKLQKPKHLKDVMTSRRFIFEALQEAGVVSLGGHKGDPCLMHPGELHDMETCSADDRPRPTRDRRRG

SEQ ID NO: 182594 - protein, 76 aa, Glycine max
  Coding DNA Sequence Number=SeqID_90909
  Subcellular localization annotation: CTP_CleavageSite=39; ConfidenceScore=5.22e-01
MMKNGGKPSRNRPRKHLGSVTEAPRLGFSSRKRFFSLISREKREVVAAQLRPGELGCLPPKGTAFCWEHPWKVQMG

SEQ ID NO: 182595 - protein, 201 aa, Glycine max
  Coding DNA Sequence Number=SeqID_90910
MVTKRSNSFRLGFPTLITVLCRARGVTSDSLTYESLSSTINLAYIKKNCWNVDNMTANFRGARKVVAPPGIILTVEPFMEKVAWPGTQPSLVREGEGPNAQAGGTQVRQKAATPKRSPQISPDPPSPVVDQSSPQQLADPPTPVHEMPADPSTPLLEILEDPATPVLGLTTTPSTTHVLHFTDKEGTQDQDTQQDDQSHEF

SEQ ID NO: 182596 - protein, 68 aa, Glycine max
  Coding DNA Sequence Number=SeqID_90911
MRLPGKEILLMKSPITLTEILDVSISFLNDHLEETLGSTKIEENHSKCINLAQCGAKKSLAHKILVGN

SEQ ID NO: 182597 - protein, 105 aa, Glycine max
  Coding DNA Sequence Number=SeqID_90912
HDTGPAIRSSGRWSCYVAQSCHSGSRHRYPSDHGANSTVDICKVRCGRAETCNEACHAIAERLESHLNLGVVTPDTSTHELIAKSVTQDQLVYVRSRCKRHTDQS

SEQ ID NO: 182598 - protein, 286 aa, Glycine max
  Coding DNA Sequence Number=SeqID_90913
  Gene Ontology: Mol. function=4-hydroxy-3-methylbut-2-en-1-yl diphosphate synthase activity; Cellular component=integral to membrane; Biological process=isoprenoid biosynthetic process
  Homolog annotation: Hit_ID=P58665; Match level="QueryCoverage=52%, HitCoverage=35%, E-value=9e-63, Identity=83%"; Hit description=4 -hydroxy-3-methylbut-2-en-1-yl diphosphate synthase (EC 1.17.4.3) (1- ...
  Homolog annotation: Hit description=hydroxy-2-methyl-2-(E)-butenyl 4 -diphosphate synthase)
  Pfam annotation: Domain name=GcpE; Domain location=149-286; Score= -137.7; E_value=3.9e-10; Accession=PF04551.5; Description=GcpE protein
MRSAGDLVRARFGAVKTLRFCSAMSIIGILIAGIAGNSTIAIVGLGIAGIGISNMVPIAFSAAGNMPGPAPGIGLSVVTTMGYSGILEAPSAIGFNAEHTGLASVFLFLPSSALGVDKKSPLFHLNCKTLPQAPETAMTSHADYDPKPRRASVAVDVGGVIVGGGAPVVVQSMTNTDTADIDATVSQVAALFRAGSEIVRITVDRDESAAAVPKIRERLLRLGMDVPLVGDFHYIGHKLLADHPACAEALAKYRINPGNVGFKDKKDKQFGEIVETAIRYDKPVRI

SEQ ID NO: 182599 - protein, 840 aa, Glycine max
  Coding DNA Sequence Number=SeqID_90914
  Gene Ontology: Mol. function=methyltransferase activity; Biological process=methylation
  Homolog annotation: Hit_ID=A7CLX2; Match level="QueryCoverage=60%, HitCoverage=55%, E-value=2e-67, Identity=51%"; Hit description =Putative type II DNA modification enzyme
GEPLSFLDHHLQCGDALLGLMDLKALEMGIPKDAFKPLSGDDNQVCKELAKQNATELKDLERKRLFNAKEMFNTDNGLETLKAIEAMPERTTKQIAAKEQAYKDFLTSAKESPLRHAADMLLGAFLIDKNIQNKDSVPTTASMVLELLGENSSAQQQKRALATQACQKGFVLHWPLAFPQVFAQGGFDCVLGNPPWERIKLQEEEFFASRNPNIAQAKNKAERSQRIQWLSEGKLAEHLYPSLQHTEVERQAEQALFEEFITAKRTAEAASVFFHVKGDEGGRYPLTGVGDVNTYALFSEEVEQRLRSKGWSRKWIMGWRNVTSAHVLRTVIATVFPLSAVGHSMPIFLPKVNDIRRCAAFFANWSTIVLDFIARQKVGGINLTFGYLKQLPFIPHERYGDKELDFIVPRVLELTYTAYDLHDWAKDLGYNGLPFEFSSKRRAILQAELDACYAKLYGLTRDELLYILDPADVMGEDYPSETFRVLKNSEIKEFGEYRTKRLILQEFDRMSLAEASGEPYLSLLIPPPGEKSKVEYSEIGTLRNEDDARLTSLILAMIRHAGSLQRQSLSIAIEIVNHGNKVFDLMNTENAQSVLDYRDSRFSKANIDSSRLQDLLHFLETKEIIRFLQKGALIEAVNDSELPAGINLDQETEAIASLLLQTASSVIDALIDHLEKHQGTPFLWVEQFAIYHEASSDQIIRLITFRRGVNLVWAREPDENSQYAGIHAAGHGVGKTSLCLLMRYCLGDSTKSIDELRDELLAEFPGGGVGVVVHIGDETYSLFRYFNAHRDGRIDLRLKQRDFDSLRSDYDLADAARKNDEITAYRQLQNAAKLAILAGR

SEQ ID NO: 182600 - protein, 108 aa, Glycine max
  Coding DNA Sequence Number=SeqID_90915
MVGYTPSSFDDMVFTDERIKVGLKRGKSDHHALINAKKTRANEEGENEGEAHVVTAIPIQPSFPPTQQCHYSANNKPSPYPPPNYPQRQSLKLTTKPTYRTSNDKHHL

SEQ ID NO: 182601 - protein, 100 aa, Glycine max
  Coding DNA Sequence Number=SeqID_90916
MHRSPTGNLVPLDLEIKATLRRNRVERRRKLLQDRRVASILEEETHFSNSSSSNSPSSRESAAYLLEAISMADDHQQRVTLEDYSSSSMPQFFTSIARPE

SEQ ID NO: 182602 - protein, 60 aa, Glycine max
  Coding DNA Sequence Number=SeqID_90917
SDLQLAIALQQQEFEQQPPRQDNLQQKSSISGSSRLVTGPQGLGFEVWGLGFGVGGWGWG

SEQ ID NO: 182603 - protein, 41 aa, Glycine max
  Coding DNA Sequence Number=SeqID_90918
NVRPRPHDLFREKKRKKKEERGNEQMINNLKKKRGKGKESK

SEQ ID NO: 182604 - protein, 148 aa, Glycine max
  Coding DNA Sequence Number=SeqID_90919
MGEVEEVQEKMKASMEAMKEQMATMMEAMMIMKKIMEANAVTIAATNIVAKVNPMPPSGLNQMNHPTLDMTHEIPHHNLADFEPCLGYATEGQAVDGIPLQNPLEGPQYHPQLHLLHSTTSKNPHAMAEMGKLDHLEERLRAIEGGED

SEQ ID NO: 182605 - protein, 78 aa, Glycine max
  Coding DNA Sequence Number=SeqID_90920
MTKSKGKDPLEGLGGPIDEDMTKSKGKDPLEGLGGPMTRARARKAKEALQQVLSKGPIGNLGISLLGDQMVADLLAVG

SEQ ID NO: 182606 - protein, 64 aa, Glycine max
  Coding DNA Sequence Number=SeqID_90921
MSIFILLFRYTTYQGNPCGVYPDLSSFIGSGVIQISVACIKRSTPSQDHIKCTLPPMTYTPYDV

SEQ ID NO: 182607 - protein, 118 aa, Glycine max
  Coding DNA Sequence Number=SeqID_90922
MMITKDDDNGDDKKLKDQSKNNSSESKINQRTTQVNQRSIKEQLKCIKNNSRVQDKNQEEFKTQEESLESRIKIQGYILCGTSRGYIYLGLTKNNRGNISYGSVLVEGTSTRFKENKG

SEQ ID NO: 182608 - protein, 105 aa, Glycine max
  Coding DNA Sequence Number=SeqID_90923
MVMMVIQPAKKKKIPNLNEQRRARKAEAIMKVKKRFTATVMPCPADRISNGNISLGTVYPSRPHDHPNATTNRQITTTTKIEKSFDNSWSVPNLTPRIMATIICS

SEQ ID NO: 182609 - protein, 68 aa, Glycine max
  Coding DNA Sequence Number=SeqID_90924
  Gene Ontology: Mol. function=sugar:hydrogen symporter activity; Cellular component=integral to membrane; Biological process =carbohydrate transport
  Homolog annotation: Hit_ID=O04249; Match level="QueryCoverage=54%, HitCoverage=7%, E-value=1e-09, Identity=75%"; Hit description=Sugar transport protein 7
MAGGGSFTTGTGSKERAKQYKGRVTAFVIISCIVAAIGGVLFGYDIGISGCHNPYYPDPTVNESTVAI

SEQ ID NO: 182610 - protein, 206 aa, Glycine max
  Coding DNA Sequence Number=SeqID_90925
MKDGELLDEEEVVATEEDVDLGGIGSETLMGLYGIENESMTDLYEIENLMTINHLGFDFTLVEGLANQSGGVLWVPAKIKLGNRETQQGQTLGFYKDKTQQQKGSPNLGFDEPLEIRPGMDMSILDFGEAHQGHTLGLTSFWRIDQGYVGLGFWMDLGFDKPLEIPPGTCLSWVLERLTKGGPWLVEIRLGTHSSWAYLGLATLGR

SEQ ID NO: 182611 - protein, 116 aa, Glycine max
  Coding DNA Sequence Number=SeqID_90926
MAREEEEPYWMTPYKNFLIRGMLPPNENEARCLKRKDGYPRTIAKSFETDRKRQPMRSSLKPCAQDSISPRVCGRKNSPTYFRLMIVHPKRQPMKALFALHTTRMPWSLSKSRNHR

SEQ ID NO: 182612 - protein, 103 aa, Glycine max
  Coding DNA Sequence Number=SeqID_90927
MEERKRERKREGEHEIEGRKRERTHGLEIYPKAHENPRAFPWISSPIYLESFSQCPCGVGLHHSQPSAPPSEPEQPIVQDPPATLVLDLNEHAEDQQQDDQEF

SEQ ID NO: 182613 - protein, 80 aa, Glycine max
  Coding DNA Sequence Number=SeqID_90928
MWSAENQKVIVLMDVLCLGLQEKNERQNFYKESCLPFPEPIFFTVQSQMQYFASDTLECIILPASTEGCSFPTIIQTQSP

SEQ ID NO: 182614 - protein, 137 aa, Glycine max
  Coding DNA Sequence Number=SeqID_90929
  Homolog annotation: Hit_ID=A5C922; Match level="QueryCoverage=56%, HitCoverage=29%, E-value=1e-07, Identity=37%"; Hit description =Putative uncharacterized protein
  Pfam annotation: Domain name=Retrotrans_gag; Domain location=33-114; Score=4.8; E_value=0.018; Accession=PF03732.8; Description =Retrotransposon gag protein
MAALDFTYESLCIQYPNEDVPYVLKTGLIHLLLKFHGLAEGVAKDWLYYLAPRSITSWDDLKRVFLEKNFLTSRTTTIRKDISGLSNMDRSMIDAASGGALGDMTPAEARNLIEKMASNSQHFNARNDAIVIRGVLR

SEQ ID NO: 182615 - protein, 308 aa, Glycine max
  Coding DNA Sequence Number=SeqID_90930
MAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPMPKYGAYQHPLDPDKSNRALGFPSLITGLCQSFGVPVAPTKVIRPPITRAFIEKYCTQRQAQGDAPQAAGAPPPPHQAGQAGAFDMEQYLRHLVRQQAANHRAHVQTHDCLYQMSLSMQSQGFASFSCLTLDQFRAEVAWPGDWPEAQAGEAPPEAPNGGEEAHEDEEMADLLDFLGGSED

SEQ ID NO: 182616 - protein, 143 aa, Glycine max
  Coding DNA Sequence Number=SeqID_90931
MRGIVHEPQDGPSGTSTLASRGLHVLTFGGLHVFALRGLHVLAIRGLYALTFRGLHTLAFRGLHPQTSEDYTSSPSEGYTSVATYPSAGGRRETRGMRVPRKEYARSRHQRLFEENVGKTGKDAIYELLSERFGSCIYARGRY

SEQ ID NO: 182617 - protein, 117 aa, Glycine max
  Coding DNA Sequence Number=SeqID_90932
MEKEKHVSYCSHDFCKSLSEELSDYYRGRHRSHPRPHSHMREKERKPQEANINLPYYHGKDVEAMSSKIFKIQNEECRNMPFCGRAKARLTGALSKGGKMRGVATNVYLWKTSEKPK

SEQ ID NO: 182618 - protein, 175 aa, Glycine max
  Coding DNA Sequence Number=SeqID_90933
  Gene Ontology: Mol. function=transcription factor activity; Cellular component=intracellular; Biological process=regulation of fatty acid metabolic process
  Homolog annotation: Hit_ID=A8GFF9; Match level="QueryCoverage=100%, HitCoverage=73%, E-value=9e-92, Identity=94%"; Hit description=Fatty acid metabolism regulator protein
  Pfam annotation: Domain name=FCD; Domain location=36-131; Score= -30.7; E_value=0.045; Accession=PF07729.3; Description=FCD domain
  Pfam annotation: Domain name=FadR_C; Domain location=8-175; Score =394.7; E_value=1.4e-115; Accession=PF07840.3; Description=FadR C -terminal domain
  Pfam module annotation: Pfam domain module=FCD::FadR_C; Domain location=36-131::8-175
HGKPTKVNNFWETSGLNILETVARLDHKSVPQLIDNLLSVRTNIASIFIRAAVRNHPEQAQEVLAKAAEVEDQADAFNLLDYEIFRGLAFASGNPIYGLIFNGLKGLYTRVGRYYFSNPEARKLALAFYSKLSTLCHEKLYDQVMDTVRNYGKDSGAIWQSMQGTMPSDLTEARR

SEQ ID NO: 182619 - protein, 266 aa, Glycine max
  Coding DNA Sequence Number=SeqID_90934
LHVLTFRGLHALAFRGLHVLAFRGLHAFTFRGLHVLALRTTHPHLQRATRPHLQRTTHPRLEDYTAARPRLQRTTRLPLQRITHPSLQRATFPRFQRTTRPRLHRAADLRLQRTQGPPPLMVNRGLRSRREAIVKLLCIPGQDFTQPLQGDEYGSCTPPQLRSPPAGVSVGIVPTRHPVDVEKSNMALGFLALVVGLCQSYRVLVPPARSCHRDIGIAPIRHSVGPEKSSRVLGFPALTTSLSQFYGVPVAPNKVIRPPTNRAFIR

SEQ ID NO: 182620 - protein, 297 aa, Glycine max
  Coding DNA Sequence Number=SeqID_90935
  Homolog annotation: Hit_ID=Q6WAY6; Match level="QueryCoverage=83%, HitCoverage=45%, E-value=2e-18, Identity=26%"; Hit description =Putative uncharacterized protein
MARIAKVIKISVQELDRVKQNRNGVIGIPRKHLEEKAKALVDQGEWASFIDVLVLLVFGVVLFPNVDGLVDLAAIDAFLAYHHNKESPVVVVLADAYDTFDRRCERSGVRIICCTPALYVWLVLHLFRHESRPVCPLQGHRIYAEKGKANWEQLLASMGFSNVPLMGMRGCINYNLVLVIRQFGYPMRGAPSEESIMPFIARGFSDPNARIFQKVWKAWSVVQRKDKEFRGSSNGIIGGYHKWLKAWTQELDWLLKLKASSEEEAETPGESEEVQALKVELERAQAVKEKFKTMAIK

SEQ ID NO: 182621 - protein, 325 aa, Glycine max
  Coding DNA Sequence Number=SeqID_90936
MASNSQQFSARNDAIVIRGVHEVATNSSSAVETKKLEGKLDALVNLVTQLALNQKSISVTRVCGLCSSVDHHTDLCPSVQQSEAIKQPEAYAANIYNRPPPPQPQQQNQPQQNNYDLSSNRWSNPSQEQPQQQPYFQNVAGPSKPYVPPPIQQQQPQKQPTIETPPQPSLEELVRQMTMQNMQFQQETRVSIQSMTNQMRQLATQLNQQQSQNSGRLPSQSVQNPKNVSAIILRSGKQCQPVASSSSANEPAQLHSTPEKGESSTGNSDLQKQHIPLPFPPRAISDKKMEEAEKEILETFRKVEEGFSQGSVPIILGRPFMSGIL

SEQ ID NO: 182622 - protein, 58 aa, Glycine max
  Coding DNA Sequence Number=SeqID_90937
  Subcellular localization annotation: CTP_CleavageSite=21; ConfidenceScore=5.43e-01
MVSAASMASVKFPKTLENPSRGASITLPRHFRKRFMWKFFIVLHRSSFVLHRSSVFNR

SEQ ID NO: 182623 - protein, 224 aa, Glycine max
  Coding DNA Sequence Number=SeqID_90938
MNAEINRIFLQDIEATTIQEEPLSSEASSSFPKKGESHTVLIEANIMADEPRRVTLEDYSSTSVPQFFTSIARPEEQAQNITYPHSLIQLIQNNLFHGLPNEDSYADLATYIEICNIEKNPKEECKAIMTRSKMMSMNEGEKRIAIDPVVEPLSEIEEEVEVEDDQQKGIPIIVSEKEIKKERKEGKRKSKSECAREKKKEASSAKGREVPYPWYLLGRTKKDI

SEQ ID NO: 182624 - protein, 68 aa, Glycine max
  Coding DNA Sequence Number=SeqID_90939
  Homolog annotation: Hit_ID=A2Y694; Match level="QueryCoverage=70%, HitCoverage=16%, E-value=1e-07, Identity=50%"; Hit description =Putative uncharacterized protein
MRKQNIHRDEFLRCKRCGKERRFHLKSTPDIKNYHDALNNKCWTCSLWPYQNWYLVLQNPLYVGSGIL

SEQ ID NO: 182625 - protein, 87 aa, Glycine max
  Coding DNA Sequence Number=SeqID_90940
GLWRWRRCICCLLPAIPRLLWCLALCLSGGAILLDENSVSRRPDDLARDDGHSIELTEARNQSWKSQDPVGLLWVHWVSCGRDPCKQ

SEQ ID NO: 182626 - protein, 101 aa, Glycine max
  Coding DNA Sequence Number=SeqID_90941
MDDQTKSIQTLSIEGSIKHRKHNQLDIKYLHHRFIRNPQLGCLASHYRRNPNNNKLTKPSALISRLAHDLDIDVEASFMMMNQVDSSSFDNDKDDDKKPKE

SEQ ID NO: 182627 - protein, 98 aa, Glycine max
  Coding DNA Sequence Number=SeqID_90942
  Homolog annotation: Hit_ID=Q2H7J5; Match level="QueryCoverage=98%, HitCoverage=42%, E-value=4e-10, Identity=32%"; Hit description =Putative uncharacterized protein
MNVVKIVFPESNNLLCWFRIDKNVKAKCKTLVGQKNAWDYVMEAHGSLVDCPFEQEFDDCLMKFEIGCSPWPMFVDYVKQTWLIPHKEKFVKAWMNKG

SEQ ID NO: 182628 - protein, 46 aa, Glycine max
  Coding DNA Sequence Number=SeqID_90943
MLRASMFNFERPDMMQSYPARALDRKLQVDWARDAREGPRVLMSLR

SEQ ID NO: 182629 - protein, 194 aa, Glycine max
  Coding DNA Sequence Number=SeqID_90944
  Homolog annotation: Hit_ID=Q2AA09; Match level="QueryCoverage=30%, HitCoverage=21%, E-value=8e-08, Identity=45%"; Hit description =Retrotransposon gag protein
  Pfam annotation: Domain name=Retrotrans_gag; Domain location=1-78; Score=20.0; E_value=0.00062; Accession=PF03732.8; Description =Retrotransposon gag protein
EAKKWLHSFKGNSLKTWEEVVEKFLNKYFPKSKTAERKDAISSFHQFPDESLSEALERFRARGKIKLKTPEEAIELIENMSASDHAILHDRVHQPTKKSLLELQVVPFVVVLMNPAIVFLLKNKCRKTTKLEETLAQFMQVTMSNHKSTESALKNLEIQVGQLAKKLMAAKDEDVVALKEQVAFKDTTVKKKNE

SEQ ID NO: 182630 - protein, 84 aa, Glycine max
  Coding DNA Sequence Number=SeqID_90945
MDTLSAAYETSKNYKCLRSHCICPHLASSPCIPAPLLFFAFIYTIQMNVLSAVVALSVFIFSFELSVELAKRDCALSEYYVSNT

SEQ ID NO: 182631 - protein, 73 aa, Glycine max
  Coding DNA Sequence Number=SeqID_90946
MSLSLQSQGFISFSCPTPDQFRAEVAWPGDWPEAQAGEAPAGAPAEAPDEADEAREDEEMTNLLDFLGGSGAT

SEQ ID NO: 182632 - protein, 137 aa, Glycine max
  Coding DNA Sequence Number=SeqID_90947
MARVAKVVKISAQELDRVKQIRNRVAGIPKKHLEEKAKSLMGRGEWTSFIEVLALLVFGVVLFPNMDVLVDLAAIDAFLAYHHNKESSVIAILADDYDMFDRRCEKSNTRIVCCTPTLYVWLVSHIFCHESRPVYPL

SEQ ID NO: 182633 - protein, 215 aa, Glycine max
  Coding DNA Sequence Number=SeqID_90948
  Homolog annotation: Hit_ID=A7Q7C6; Match level="QueryCoverage=57%, HitCoverage=20%, E-value=2e-30, Identity=61%"; Hit description =Chromosome chr18 scaffold_59, whole genome shotgun sequence
MVKRIRKVAKETLGESRGYGLKVYHRIQEPKAKQALKRMKNGKALDLHNIPIGVWKSLDSPMLSVLKGFQRMRALVRSMGEILFSCGSNRRAVIATLSISENDIQRFEGISEVEVVTKSLQGLSIESALDLQKVLRVETCTSQTTALQRLEANLPLFQSRMGALLFLISALLSRGLGSLMPFPTPAPEPHFMLLNCSGPTQGSCAPGATCTQSGG

SEQ ID NO: 182634 - protein, 27 aa, Glycine max
  Coding DNA Sequence Number=SeqID_90949
MEAPAGARSDDIAGSRSRGSELRHVKS

SEQ ID NO: 182635 - protein, 336 aa, Glycine max
  Coding DNA Sequence Number=SeqID_90950
  Pfam annotation: Domain name=Transposase_23; Domain location=238-308; Score=-6.0; E_value=0.0054; Accession=PF03017.5; Description =TNP1ENSPM transposase
LTRKWALAADQDGVEDTVCEKYGISKEKWVQFCQTRRDPSWEDVRKKAHAIQKQNIAPHVLSRGGYDYLEQKLLIEKTKKKLEEAAQSGSVDGVIDPPSPVRRHVKWKMARTKKTEEMTTEAAKEIAEKIDSFEEQATQGSFVLHGRQDVLAAAIGRPEHPGRVRAAGAAADPADQGLARGVHHRESDEASQASFNQLQSQMQSQGLAVPPEPLVGPSGPQVSTKGSCVYPSGNDPETGDSDRCGLYIEADPAHLVAMGRVYEGSTVVYNTPLLLGQVKVSVEEVTDADAPVLVPTDEVSLVGQALHTFLAWPTHLVKSLSQQVAVSRQTTSELDP

SEQ ID NO: 182636 - protein, 51 aa, Glycine max
  Coding DNA Sequence Number=SeqID_90951
MKNDEEWRKEGGGCRPAPPGELDCFHQKAPPSVGTPGRPKWAWLLFAPPFY

SEQ ID NO: 182637 - protein, 110 aa, Glycine max
  Coding DNA Sequence Number=SeqID_90952
MEVMMSMKKIMEANAVVVAATRAVAKVNSMPPTGLKQMNHPTSDMVGKDLGSMGSPHDVQIQNEYAFPPYGLPLNYTPPNMAYTPNENVNNSTPILVESQQPQSDHAHVS

SEQ ID NO: 182638 - protein, 104 aa, Glycine max
  Coding DNA Sequence Number=SeqID_90953
MEIYVSDRLGKSVYVCFLISDVVIIKKGEIVEAKLHDESRVIQRCFVDNKDDDKGDDKKLKDRIKNTSRFKRKVDFKNQESRFKTSRFQEIKIQDSRLKNQEKA

SEQ ID NO: 182639 - protein, 48 aa, Glycine max
  Coding DNA Sequence Number=SeqID_90954
MKRTRMWDFPRSCKGWSPMRPRNEASSRRDRTSRLRSWQWKKGSKDRN

SEQ ID NO: 182640 - protein, 59 aa, Glycine max
  Coding DNA Sequence Number=SeqID_90955
MARSVSASCPYSKDLYGRELTRLLVIIPKVVISLLMVSRGINETLGLIRILVMDLKRAN

SEQ ID NO: 182641 - protein, 157 aa, Glycine max
  Coding DNA Sequence Number=SeqID_90956
  Homolog annotation: Hit_ID=UPI00006A2D9E; Match level="QueryCoverage =99%, HitCoverage=85%, E-value=2e-13, Identity=15%"; Hit description =UPI00006A2D9E related cluster
TLTFRGLHVLAIRRLHALAFRGLHVLAFRGLPILAIRGLHVLSFRGLHALAFRRLHTIAFRGLHALAIRGLHALTFRGLHVLTFRELHVLNIRGLHALTFRGLHVLAFRGLQVLAIRGLHALTFKGLHILAIEGLHALAIEGLHVLAIRGLHVLAFR

SEQ ID NO: 182642 - protein, 211 aa, Glycine max
  Coding DNA Sequence Number=SeqID_90957
  Gene Ontology: Mol. function=hydrogen ion transporting ATP synthase activity, rotational mechanism; Cellular component=proton -transporting two-sector ATPase complex; Biological process =mitochondrial electron transport, NADH to ubiquinone
  Homolog annotation: Hit_ID=Q0JIM3; Match level="QueryCoverage=85%, HitCoverage=9%, E-value=7e-59, Identity=71%"; Hit description =Photosystem I P700 chlorophyll A apoprotein
  Pfam annotation: Domain name=ATP-synt_DE; Domain location=163-210; Score=63.3; E_value=8e-16; Accession=PF00401.11; Description=ATP synthase, DeltaEpsilon chain, long alpha-helix domain
  Pfam annotation: Domain name=ATP-synt_DE_N; Domain location=97-161; Score=38.3; E_value=2.8e-08; Accession=PF02823.7; Description=ATP synthase, DeltaEpsilon chain, beta-sandwich domain
  Pfam annotation: Domain name=ATP-synt_ab_C; Domain location=12-113; Score=158.6; E_value=1.6e-44; Accession=PF00306.18; Description=ATP synthase alphabeta chain, C terminal domain
  Pfam module annotation: Pfam domain module=ATP-synt_DE::ATP-synt_DE _N::ATP-synt_ab_C; Domain location=163-210::97-161::12-113
MLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVADKLEYYPNHAPIATAVDIGILRIRLLKDQWLTMALMGGFARINNNEITVLVNDAEKGSDIDPQEAQQTLEIAEANLNKAEGKRQTIEANLALRRARTRVEAINVIS

SEQ ID NO: 182643 - protein, 170 aa, Glycine max
  Coding DNA Sequence Number=SeqID_90958
MYDTPVELKWDGSKFGLSNVDASFFLTFSDVNEIVAGYKCLNISILQLWMLFLDEWSSTLGHASVYGFLEPQSIHNAKDLAECEHYLQAWLKESQREVGHWQLVVLCPTTNECGYYVMHWMWNIIGGGLKNDWSMWFLDGTALDNETITTIRQKWAAYFLKVQSNQCTKS

SEQ ID NO: 182644 - protein, 101 aa, Glycine max
  Coding DNA Sequence Number=SeqID_90959
  Subcellular localization annotation: CTP_CleavageSite=72; ConfidenceScore=5.03e-01
MPGDYHHLVHLLSSCPVKSDMRGYVMVTRTFRRQGENEPVDAQRLTSSSAPFVVLTREVSDMRGYPMFTLTLCQPGANETVEARRLTSSSAPIVVLTREVR

SEQ ID NO: 182645 - protein, 65 aa, Glycine max
  Coding DNA Sequence Number=SeqID_90960
MKEIQQRMESPTVATYSSAGGRRVTRGMRVPRKEYARSRHQRLFEENVGKTGKDAIYELLSGGIL

SEQ ID NO: 182646 - protein, 57 aa, Glycine max
  Coding DNA Sequence Number=SeqID_90961
APVSLALARPRRACCDNRAQEEDASTNQIPKPSLAPILDYATPSAPAAQVLDLNEHA

SEQ ID NO: 182647 - protein, 72 aa, Glycine max
  Coding DNA Sequence Number=SeqID_90962
MQKCPRYGVSRYKVKDDDKCSSDENSKKGPLVTVCGIFRSFYGLSVYLLIETIQKTLHGMQMGEIAMECSII

SEQ ID NO: 182648 - protein, 96 aa, Glycine max
  Coding DNA Sequence Number=SeqID_90963
MKLCFYTQLIHDRVVMECLEVEPVQVIEVSSSEGDLEEDPMELPPEPAMDALDLPEDDEDPLPDVDSPEDIMSASEADSIEESGPGGIANSDDSSS

SEQ ID NO: 182649 - protein, 118 aa, Glycine max
  Coding DNA Sequence Number=SeqID_90964
MIRGDTLRLSAPSLCHSDTVVFDGKQRPKTKFGHSAHMIRGDTLRLSAPSLCHSDTVVFDGKQRPKTKFGHSAHMIRGDTLRLSAPSLCHSDTVVFDGKQRPKTKFGHSAHMIRGDTL

SEQ ID NO: 182650 - protein, 138 aa, Glycine max
  Coding DNA Sequence Number=SeqID_90965
MAAGQPRLAECMTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLA

SEQ ID NO: 182651 - protein, 39 aa, Glycine max
  Coding DNA Sequence Number=SeqID_90966
MEMAPRKLASKRSRKDAAAAGTSAAPEFDSHRFRSAEHQ

SEQ ID NO: 182652 - protein, 129 aa, Glycine max
  Coding DNA Sequence Number=SeqID_90967
MATQLIHDRVLMECLEGVWETLEGIERCRFRGTIRLTATSLVHPEEPARTLQQPVEWILPTPTPYRLVEPRTQRSYLLNLLWTSLTYLRMMKTRSPDVDSPEDIMSASEADSTEESGPRGTAISDDSSS

SEQ ID NO: 182653 - protein, 95 aa, Glycine max
  Coding DNA Sequence Number=SeqID_90968
FDLRTKKKILQTIGERWRQFKSNLTSKWALAADKDGVDDIVCESTTLAKRTGPNFVRVAETLRGRFLRGAGLTGFLCHPWMSGCTDCCHWATRTP

SEQ ID NO: 182654 - protein, 26 aa, Glycine max
  Coding DNA Sequence Number=SeqID_90969
MKRNKEYPLPDCREKMLEEIVQSIGM

SEQ ID NO: 182655 - protein, 154 aa, Glycine max
  Coding DNA Sequence Number=SeqID_90970
  Gene Ontology: Mol. function=protein serine/threonine kinase activity; Cellular component=integral to membrane; Biological process=recognition or rejection of self pollen
  Homolog annotation: Hit_ID=Q70I29; Match level="QueryCoverage=97%, HitCoverage=19%, E-value=3e-40, Identity=50%"; Hit description=S -receptor kinase-like protein 2
MNPKISDFGLAPRLWGDQVDANTNKIAGTYGYVPPDYAVHGHFSMKSDVFSFGVMVLEIAWRLWTEGRPTNLMDVFLGERCTSAEVIRCIHIGLLCVQQIPVDRPDMSAVVLRLNGEKSLPQPKALGFYNGRDKADLYGPFSNNYVSLTVFEPR

SEQ ID NO: 182656 - protein, 108 aa, Glycine max
  Coding DNA Sequence Number=SeqID_90971
MWIKGRGGVSKDTFCGDAKGEDKKVFRVRWEVVCSPKEKVLEVGKVEWGSLEAGSRVEEGMVSIYHEAGAWQSISYKCLKVDLEVHQYHQLGRGVFGLRRGWDNYCNI

SEQ ID NO: 182657 - protein, 57 aa, Glycine max
  Coding DNA Sequence Number=SeqID_90972
VATVVKEKCKEVSVSSKRHLLALPDLGLEFIPQVKKLLDEGSVRKSLNPCALLVPKI

SEQ ID NO: 182658 - protein, 42 aa, Glycine max
  Coding DNA Sequence Number=SeqID_90973
MAQECFPNEYRMWNCPSSVDKWHESSFSNARNGPEEARLKEI

SEQ ID NO: 182659 - protein, 66 aa, Glycine max
  Coding DNA Sequence Number=SeqID_90974
  Gene Ontology: Mol. function=aspartic-type endopeptidase activity; Biological process=RNA-dependent DNA replication
  Homolog annotation: Hit_ID=Q69F85; Match level="QueryCoverage=84%, HitCoverage=3%, E-value=9e-09, Identity=51%"; Hit description=Gag -pol polyprotein
MTQPPRLVGIILESRENITTKKALKLNFRVSNNQAEYEAIIAGLKLAREVKAKKLRCYTDSQLVHR

SEQ ID NO: 182660 - protein, 81 aa, Glycine max
  Coding DNA Sequence Number=SeqID_90975
MTTGDSPQQKTSQGNEKKKEDENITQVDFIDYRSNFTPPQQERSLRIDIEEELKNITKGDPPQRERSQKIGKKKKFKNIAQ

SEQ ID NO: 182661 - protein, 84 aa, Glycine max
  Coding DNA Sequence Number=SeqID_90976
MTEPSKKRKGTSSRSQRHSGSQETPIPSSIPSGSLFSSEEQQVHEGTLMSEVYGIKMVIDQSLFYDLTQLPSEGVPFEGALIDN

SEQ ID NO: 182662 - protein, 55 aa, Glycine max
  Coding DNA Sequence Number=SeqID_90977
MGFRGFRDTRNASEKVGGGCHPARLGELTSLGRAGRQPPPTFSYKKAEGGCSKDP

SEQ ID NO: 182663 - protein, 239 aa, Glycine max
  Coding DNA Sequence Number=SeqID_90978
MNLIIVIKRKEHVVWHPYQTHARARVMGEVEEVQKQMKADMEAMKEQMATMMEAMMSMKKIMEANAVTVSATRVVAKVNPMPPSGLNQMNHPTSDMVGKDLGSTDGPYYVQIQNKNAFPPYGLPPNYTPPNVAYTPSENANNSTPILIESRQPQTDHAHVSQTMGETHEIPHHNLADFEPCLRYATEEQAVGGIPLQNTLEGHQYHPQPHPLHSTVGKNPHAMAKNGKVGSSRGKAQSH

SEQ ID NO: 182664 - protein, 232 aa, Glycine max
  Coding DNA Sequence Number=SeqID_90979
  Homolog annotation: Hit_ID=Q6L477; Match level="QueryCoverage=96%, HitCoverage=41%, E-value=7e-11, Identity=25%"; Hit description =Putative uncharacterized protein OSJNBa0009L15.8
AEFEIPEASDSRTKKKILQIIGERWRQFKSDLTRKWALGADKDGADDIVCEKYGISKEKWTQDDVRKKAQASQKQNTAPHVLSSGGYEYLAEKLMAEKTKKILEEAAQFGSTEGIIDPPSPIRHHVKWKMARTKKTGQMMSEAAKEIADRIDILTAAIGRPEHPGRVRAVGAGVTIKQYFGSASRTSHSSSSMPPEDLEQLTQKIRDQLEESITEKVTRKMMESFSQMQSQF

SEQ ID NO: 182665 - protein, 91 aa, Glycine max
  Coding DNA Sequence Number=SeqID_90980
HLVRQQAANHRGQVQIHECLYWFSLSQQGQGFAPFACPTPEQFRAEVAWPGDWPEAQAGEEPTGSPGDAEEARMDEEITDLLGFLGGSGAM

SEQ ID NO: 182666 - protein, 67 aa, Glycine max
  Coding DNA Sequence Number=SeqID_90981
  Subcellular localization annotation: CTP_CleavageSite=58; ConfidenceScore=5.19e-01
MGVQIATRPTWAFQDVPPEGGCFWRKQPSSPGKFKPRRFRNVFVGDFAKILDRSSTFFVVHRSSTDF

SEQ ID NO: 182667 - protein, 262 aa, Glycine max
  Coding DNA Sequence Number=SeqID_90982
  Homolog annotation: Hit_ID=Q6WAY6; Match level="QueryCoverage=75%, HitCoverage=33%, E-value=6e-14, Identity=27%"; Hit description =Putative uncharacterized protein
CFYKVELFVPYKVIACVPKSEKKLGGTLGKYGFPNDPLMGTRGCINYNPILAIRQLGYPMRGAPLEEIIAPFVAWGFNEGNAKILQRIRKAWNAVERRDKELRGSSNSVVGGYHKWLKARTQGITWLPKQKDPKLERTRVIKEKLKTTVTRVKKECDELKDVNMTIDEDNNEFKLQRAERDKSRVECMALKDKMKACQRSKRSLTEQLSRTKENMFTIIDQYKEKAMKWMDRFALTLNGSQELPRLLARAKAMADVYPAPDE

SEQ ID NO: 182668 - protein, 255 aa, Glycine max
  Coding DNA Sequence Number=SeqID_90983
  Homolog annotation: Hit_ID=Q6WAY4; Match level="QueryCoverage=60%, HitCoverage=28%, E-value=1e-13, Identity=33%"; Hit description =Putative uncharacterized protein
MKRESLHRFLSCIHWVPCEVASLRKLGQRMDQVQCQAFNKGYGKIWDLAMIEVSIEAIASLTQYYDQSLRRFTFGDFQLAPTIEEFEGILGCPIEGRKPYLFFGFYLSMVRIVVVVKIPEQELDRMKQNRNVVAGIPRKCLEEKAETLSSQGEWTSFINVLTLLVFGIVLFSNVDGSRNKFRGALWGSSNELKLRKVKRDKSRIGSLMLGDKLKSCQRSKRSLREQLSKTEGNMLIIIDQYKEKVNLIASHGCKS

SEQ ID NO: 182669 - protein, 109 aa, Glycine max
  Coding DNA Sequence Number=SeqID_90984
  Subcellular localization annotation: CTP_CleavageSite=92; ConfidenceScore=5.22e-01
TYQGNPCGVYPDLSSFTGSGVYTDLSSFTGSGVYPDLSSFTGSGVYPDLSSFTGSGVYPDLSSFTGSGVIQNLRSLYQTIRSYSGRLGFSVRAQPRVRSDRHWHVVLLI

SEQ ID NO: 182670 - protein, 47 aa, Glycine max
  Coding DNA Sequence Number=SeqID_90985
MTKNERRTMKNGEKREVVAAQVAQASWVTSTRRHRLLLEHPRRSKWA

SEQ ID NO: 182671 - protein, 68 aa, Glycine max
  Coding DNA Sequence Number=SeqID_90986
INNNVYRLDLPEEYGVKTTFNISDLISFAGATDVEEEKQTDLRAMSRRLQEDWARAAEEGPKVLMNLK

SEQ ID NO: 182672 - protein, 122 aa, Glycine max
  Coding DNA Sequence Number=SeqID_90987
  Pfam annotation: Domain name=zf-CCHC; Domain location=51-68; Score =29.8; E_value=9.8e-06; Accession=PF00098.14; Description=Zinc knuckle
MQEENEEEDSDDEEEFSFFRKKFQKFIKKRRIDRHQNFNNGRKSQEDSQVLRCYKCNQIGHIKVNCPSNEEWPEKSDKKRYDERRNKKAYIAWDDNDSSDGSKKEINLLTKDYESDENISQE

SEQ ID NO: 182673 - protein, 125 aa, Glycine max
  Coding DNA Sequence Number=SeqID_90988
MRGIVHEPQVNLGADQNTLTFRGLQALAFRGLHVLAIRGLHALTIRGLHPLAFNGRHVLNFRGLHALALRGLDILAVRGLDVLAFRGLHVLHFRGLHVLAFRGLRALAFSGLHSHTLREFKVLYP

SEQ ID NO: 182674 - protein, 123 aa, Glycine max
  Coding DNA Sequence Number=SeqID_90989
MSLPSAVHASSTFEPGAPRMSLPTVVRQFSILHFYSETHECHCLALFMGPPPSSLEPHEFHCLALFANSPFSTFIRETHECHFLALFMCPPPSSLEPRECHCLALFANSPFSTFIRRPMNVIV

SEQ ID NO: 182675 - protein, 217 aa, Glycine max
  Coding DNA Sequence Number=SeqID_90990
  Homolog annotation: Hit_ID=A5AP21; Match level="QueryCoverage=75%, HitCoverage=11%, E-value=4e-08, Identity=30%"; Hit description =Putative uncharacterized protein
MIIIKTPKAVASTRFVYGNSEGQREHDPPVKYDVDKETWEQFAASRKTPNWQGIRKKMQEIQKYNDCPHVLSRGGYDLLEKKMMEEKMNKRQHDTMTTENTPNSRDPPSPIQRHVKWVLARTKQYGQMTSKSAQEISDKIIASLEEQTRQGTFVPHGREDILNTAIGRPDHGGCVRAAGFGVTISQYFGRAAHGSICSSGSISQVQMAEIIGGLQEQ

SEQ ID NO: 182676 - protein, 28 aa, Glycine max
  Coding DNA Sequence Number=SeqID_90991
MAILEGLLELLENKECAHWKAKYVSGWI

SEQ ID NO: 182677 - protein, 333 aa, Glycine max
  Coding DNA Sequence Number=SeqID_90992
  Homolog annotation: Hit_ID=A5BQJ4; Match level="QueryCoverage=57%, HitCoverage=16%, E-value=5e-09, Identity=26%"; Hit description =Putative uncharacterized protein
  Subcellular localization annotation: CTP_CleavageSite=71; ConfidenceScore=5.34e-01
MAEPSKKRKGTSSRSQRHSGSQEAPIPPSIPSGSLFSSEEQRTRYTNLFSSRSIVDPKFIDMEFFSNENFECFQAFENSNLIPFMSLKLPIYSELVKVFYSNFEIHEGTLNSEVYGIKMVIDQSLFYDLTKLPSEGVPYEGALIDEWKFDFAVHDARRLVCTNQADMTGRLLAGSLAFESRILHYLIVRILLPRSSNLAQAPLPYPHLVTLFLQHFNISLDFEPYVPIKRSFLIGASVIASFGYIKEHDCSCVKKGARNIGEEGHEGEDSSLLSKILERFDGLQTFVGERFDTLELQVDMRFNEMESRMTKVEEDVSYIRSSFDLPSPPPPSS

SEQ ID NO: 182678 - protein, 96 aa, Glycine max
  Coding DNA Sequence Number=SeqID_90993
MNVVGGWEKEEEVEKYGLERDLRGEEVKVDSVTNSGIQCTDFFVLPDDDTARSFGTLRWRAMCLAFMEADSSSASGPRGTASNGGGSGGRTLGTGT

SEQ ID NO: 182679 - protein, 145 aa, Glycine max
  Coding DNA Sequence Number=SeqID_90994
  Subcellular localization annotation: CTP_CleavageSite=28; ConfidenceScore=5.03e-01
MATPPASPPPLSPSPPPPPPAVASEPPRAERPVVHVDPATGKVDGPHKKKLKTYVGIVARDKVDVTYETWKEVPTAQKDLIWEDIQAEFDVPEASDTYKDNVDDTICEKYGPPSPIRQHVKWKMARTKKTRQMMSEAANKNAEKI

SEQ ID NO: 182680 - protein, 122 aa, Glycine max
  Coding DNA Sequence Number=SeqID_90995
YIYLGLTENKRGYISCGSVLMEGTSTRFKENKGGYIPCGSLLVNGFLQGMSPPRTEAGLDRIAWKGTVDGLKRIRMFLWKISHESILTNAKRLRIGISVNDESCACQAKAEALLHLFWDCND

SEQ ID NO: 182681 - protein, 35 aa, Glycine max
  Coding DNA Sequence Number=SeqID_90996
MDVDPICPRCGQGEEDTLGVHLDHRAEHPKLNPRG

SEQ ID NO: 182682 - protein, 161 aa, Glycine max
  Coding DNA Sequence Number=SeqID_90997
MGDQEEVQEQMKANMSALKEQMASMMDAMLGMSQLLENNAATAAAVSSAAEADPTLPATAHHPIPNVVGQERSTLGHISNPHLGYNRVAYPYGLPPNYTSPVMRDDAGHVPSPILKGEPPRQSDEIHEDRREHTQGDIDSYSPVPVEGPTPNTLPQPNLMG

SEQ ID NO: 182683 - protein, 117 aa, Glycine max
  Coding DNA Sequence Number=SeqID_90998
MTRGNPSDLQPFDPEIDRTFHRLVRDHFIPFEHPEHSVIGESEHFVVSNFEHPDFEHYSFEHSDFENSENMAQSPPREDPHKHLKEFHIVCSTMKPPDVQEDHIFLKAFPHSLEGIL

SEQ ID NO: 182684 - protein, 174 aa, Glycine max
  Coding DNA Sequence Number=SeqID_90999
MQNQEIQVGNSYSMENYQWEQELQPYNQYEEERTSNLDNLLMQFKEVTEYTQQAFKSFEIQVGKLAEEVTKFMARREENFIKVEAQEESPVRKHDSKEKDEDKSEEKAQQWEKYSQEERHGEHEKALSAILSLITSTSLAMIWKVLPEYMTFMESLARRQKYKEYVFFVTFMPP

SEQ ID NO: 182685 - protein, 262 aa, Glycine max
  Coding DNA Sequence Number=SeqID_91000
  Gene Ontology: Mol. function=protein kinase C binding; Cellular component=cell projection
  Homolog annotation: Hit_ID=UPI0000F2ADE5; Match level="QueryCoverage =39%, HitCoverage=16%, E-value=1e-11, Identity=36%"; Hit description =PREDICTED: similar to PDZ-LIM protein cypher3s isoform 1
LHALALEDYTPSSSEDYTSSPSEGYTLSPSENYTSSPLHDRATSPRLQRATRPRREDYTSLPLEDYTSSPSEGYMPSPLEGCTPSPTEDYMSSPSEGFTPSPSEDYTSSPSEDYTFSPSEGYTPSPRGLHVHTFRGLHVLTIRGLDALTFRELDTLAFKGLHILAIRGLHALTFRGLHVLAIRGLYVLTFRGLHALAFRGLHILVFRGLHVLAFRGLYTLAFKGQHVLNFRGLHALAFRGLCVLTFSGLHIHTVREFKVLFP

SEQ ID NO: 182686 - protein, 78 aa, Glycine max
  Coding DNA Sequence Number=SeqID_91001
MEVLLSPIALKVVGPLLMDSNSLRDGTNPPSNSYMATHKQGNKETSNKQRPKRNKMKAKPMEFYNKDLDFCKEHVIQD

SEQ ID NO: 182687 - protein, 300 aa, Glycine max
  Coding DNA Sequence Number=SeqID_91002
  Homolog annotation: Hit_ID=Q6UUU1; Match level="QueryCoverage=20%, HitCoverage=40%, E-value=4e-18, Identity=78%"; Hit description =Putative uncharacterized protein
YIEQLTEMPQNVLYDAIGIYQRCWNSYVPINVSFSPKVGPGLPGINRDTRIYLFCEVIFRHRYLFGAKCVGWLLFLSAVPPVQLLTGWCVTAKAPPDISAGKCSGHAARRVPFAIQAAQLLGRAIGAGLFAITPAGERGMCCKAIKLGNARVFPVTTLNSIKELCPDCGTAGLGICSGLSLLVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 182688 - protein, 373 aa, Glycine max
  Coding DNA Sequence Number=SeqID_91003
  Homolog annotation: Hit_ID=Q6WAY6; Match level="QueryCoverage=91%, HitCoverage=57%, E-value=1e-40, Identity=32%"; Hit description =Putative uncharacterized protein
MGPLQRQAFRKVYRKILDLAAAEVFTEAVVSLAQYYDHPLRCFTFGDFQMVPTIEEFEEILGCPLGGRKPYLFSGFLPSLSKVAAVIGDSAKELDRMKQIRNGVVGLPQKYLEDKARDMASQEKWGPFADVLALLIFGVVLFPNVDGLVDLAAIDAFLAYHHSKESPVVAILADLFDTFDRRCEKNSVRIFCCLPALCVWLTSHLFRQDTRHPCPLQSYRSCAEKGRVDWDQHLAGIGGSTINWFPHWMEGKEGVLFSCGDYPNVPLIGTRGCINYNPALAIRQLGYPMRGAPTEESLSPFLVRDLGAQGLKVIQRVHKAWRSPLRKDKELRGIRNGVIGGYHGWLRIHTRGLDWLSKLKVINEENRRSSGGR

SEQ ID NO: 182689 - protein, 260 aa, Glycine max
  Coding DNA Sequence Number=SeqID_91004
MALKKRKEPAIPSQVQYDRSRLTSPEAWERYTDIVVTRKKEFYANLYDLEDKSPKHVRVRGHLVKFDADTLNIFLKTPMIIEEGEELPAYSRFALLRPDPQKLAAKLCIPGRGFELNVDSLPLKILRKNITTLAQTWSVLSYSNLVPTSHASDITLDRAKLIDGIIMKMDMNLGYLISHQIYIISQHDSSRLGFPALITTLCKARGVTSDSRSLESLSPAINLAYIKKSCWNLDDPIVTFRGPRKAKGKRSEAPPTSVAP

SEQ ID NO: 182690 - protein, 164 aa, Glycine max
  Coding DNA Sequence Number=SeqID_91005
  Homolog annotation: Hit_ID=A6H594; Match level="QueryCoverage=54%, HitCoverage=88%, E-value=2e-27, Identity=73%"; Hit description =Putative 23S ribosomal RNA
STLEDPTSTFRTAAESTGRQETPCLNRENGVVGELYKCRAARRSSRECCTLDGESPVAESITSLRSDPSSMGHVESRVNQQGPPCKAKYSWVTDSEAVAWLRETTGAVAKASLHRAIDEAWVKTKWRSEPTDVEESADELWLGVKCHSNPELAGSPRNALRRSS

SEQ ID NO: 182691 - protein, 150 aa, Glycine max
  Coding DNA Sequence Number=SeqID_91006
  Subcellular localization annotation: CTP_CleavageSite=36; ConfidenceScore=5.07e-01
MKVHCYQASRRPNMITNSPPLLMFPWTRFPVESPTVATYPSTGGQHGAHGCVFQWRKACGVTTNIYSRKLSEKPERCGLRTLCVKGSGVVFTHGEGCFPCSYVSLIAMRKLDLCSSAKAVSYMLIYAFERSMLTDKNKGDRLRRWTLKRF

SEQ ID NO: 182692 - protein, 555 aa, Glycine max
  Coding DNA Sequence Number=SeqID_91007
  Gene Ontology: Mol. function=motor activity; Cellular component=cell projection
  Homolog annotation: Hit_ID=UPI00016621D1; Match level="QueryCoverage =99%, HitCoverage=42%, E-value=2e-17, Identity=32%"; Hit description =UPI00016621D1 related cluster
FNGLHVVPFIKLHTFTFRGLHILAFRGLHALTIRGLHVLPFRGLDILTIRGLHVLAFIGLHNLTIIGLHNLPFIGLHALAFRGLPILAFRGLHAIAFRGLHVLTFIKLHALTFRGLHALDFRGLHALAIRGLHILPFRGLDVLATRPGLQRAARRLHDLTFRGLHALTFRGLHVVAIRGLHVLAFRGLHVLTFRGLHVLAFRGLQAFAFRGLCVLTFRGLHALAFRGKHVLAFRGLDTLAFRGLHVLPFIGLHALTFRGLHVLTFIGLHALTFIGLHALTFIGLHALTFRGLHALAFRGLHALAFRGLHALALRGLHGYTPCLSKDYTSSPLEGFKPTRSEGYTPSPSKGCTPSPSEGNTPSPSKGCTSSPLEDYTGLHVLAIRRLHVLAFRGLHVLTFRGLHSLAFRGLDVLTFIGLHALTFIGLHNLTFIGLHAVTFRGLHVLAFRGLHALAFNGLHVLPFIKLHALTFKGLHILTFRGLHALAIRGLHVLPFRGLDVLTIRGLHVLAFIGLHNLTIIGLHNLTFIGLHALTFRGLHVIAFRGLHAIAFRGLH

SEQ ID NO: 182693 - protein, 61 aa, Glycine max
  Coding DNA Sequence Number=SeqID_91008
  Subcellular localization annotation: CTP_CleavageSite=47; ConfidenceScore=5.05e-01
STLEDPTLFSRLNPPISNVFYPVKSGPSLLGNVIFVIFPIGFFHSPTCSSPSRTDPLDWEI

SEQ ID NO: 182694 - protein, 57 aa, Glycine max
  Coding DNA Sequence Number=SeqID_91009
MKEREWKIFKPDKFSTRLPFKVVLDWRYPTTHEQRGKDRNTQRPLQKHYPQENPIDP

SEQ ID NO: 182695 - protein, 137 aa, Glycine max
  Coding DNA Sequence Number=SeqID_91010
  Homolog annotation: Hit_ID=A5AQM5; Match level="QueryCoverage=75%, HitCoverage=11%, E-value=8e-10, Identity=32%"; Hit description =Putative uncharacterized protein
  Pfam annotation: Domain name=zf-CCHC; Domain location=71-88; Score =27.5; E_value=4.8e-05; Accession=PF00098.14; Description=Zinc knuckle
MKKMIRRRRELLLKPHLKSKKKVTEDSIDLDENEDLSLFVKRFNKFFRMRGNQRRQNFEPKRRTEESFQTPKCFECNQPGHLRDDCPIFKERIKKSEKKAMKAYITWDDSDLESSDDSEKEMINLCPMGKNYESDKE

SEQ ID NO: 182696 - protein, 201 aa, Glycine max
  Coding DNA Sequence Number=SeqID_91011
MHAGARFHPDAARRRVWIMCINIWMMLLLSNLLPSDHHSDLPLPKCQLGSRPQDTQWTRRSPIGPWGSSSDYRPLSVLRSDHHSDLPLPKWITPTRHSVCLEKSNRVLGFPGLITSLRQFYGVPVAPNRVMRPLLTRLSSRSTTPSGRNRVRHHSSGQQTHRHHLQSSPQLIHKKAGALPTTHGRPTGDHHHFHSSFKPTN

SEQ ID NO: 182697 - protein, 691 aa, Glycine max
  Coding DNA Sequence Number=SeqID_91012
LVFQLAAADGLADLGALVVVGYVGLAGSHALHDVPTGIGAERLADAAVLDAGYLLAERRTERVDREPAQIAALALAVVVLGGFLGHGLEIRAAGDAGAQGIDLGLGGSVGLVIVHAHQDVAAVVFGDRVRATAGGAGITHFHQLQQLEAAGAADRADHFAGFHLFHQLGKGLRDFIQAAPAQIAAFQRVRAVRITHGGRVEVQLTLVQQGLHALGLLLAGGDLVGVGAVGQGDQDVRQVVLVAHRGLLLQRGVHFTLADADAALREALAQALHGDFIAHRSTEIVEIDAVVGQALAQCIQVRAVLLGDGIHRLVQLLVADADAAALGAGHLQLDQHQALEHLAAEHVFRRQLVFTAGVLRLDVGDRTLELALQDHVLVDDGGDAVQRLRLLREHLQGGGHAGHRQQGGEKNGEALWSWDQIRIVVIPGRPGVAGRHEIEVVAVIAEDSTAQRAVRVLADGAQALEDELQLDGVVHLAFAVAHVAPGDSAHGQAAAVPLHAGDDFQRFLVLQRVVIAADQAPARIQRVQERQVGLLQQGAVMLVGTRQGTGIDAVAVAQVDHAVVGHQVTGADAGQILALVLRVPLVGGAQGPAVVDHVVAVGDPGRLALLHRRAAGGDGHPRLIEVLDLADRGREAFLAGGLVDEAGTQRQGQLVGVVLAVGTGIARVAEQLAPAEGEVAGIEDRQLVLVA

SEQ ID NO: 182698 - protein, 189 aa, Glycine max
  Coding DNA Sequence Number=SeqID_91013
TTRPRLERTTRPHHQRAAHPHLQRTTCPRLERATRPHLGGLHVLALRGLHVLTIRGLHALTSRGLHVLALRGLHALTLGTSYPHRERTTRPGLERATRPRHQRAARPHLQRTTLGLHVLTIRGLHALPRDYMPALRGLHALTLVLVTLTVERTTRPRLERTTRPHHQRAARPSLSEDYTSRLERLHALI

SEQ ID NO: 182699 - protein, 81 aa, Glycine max
  Coding DNA Sequence Number=SeqID_91014
  Homolog annotation: Hit_ID=A5AWH3; Match level="QueryCoverage=71%, HitCoverage=19%, E-value=2e-09, Identity=55%"; Hit description =Putative uncharacterized protein
  Pfam annotation: Domain name=RVT_2; Domain location=2-79; Score= -182.3; E_value=0.012; Accession=PF07727.5; Description=Reverse transcriptase (RNA-dependent DNA pol
MVYKIHRRSKGNNEIPDKPNHVYKLQKALYGLKQAPRACRKIKQTQEEFINQAKYCKELIKRSGFYGNANNMATPLLEIAG

SEQ ID NO: 182700 - protein, 646 aa, Glycine max
  Coding DNA Sequence Number=SeqID_91015
  Homolog annotation: Hit_ID=A4GSN8; Match level="QueryCoverage=100%, HitCoverage=21%, E-value=1e-75, Identity=38%"; Hit description =Nuclear-pore anchor
  Pfam annotation: Domain name=Strep_SA_rep; Domain location=208-232; Score=9.0; E_value=3.7; Accession=PF06696.2; Description =Streptococcal surface antigen repeat
  Pfam annotation: Domain name=Strep_SA_rep; Domain location=296-320; Score=7.0; E_value=7.6; Accession=PF06696.2; Description =Streptococcal surface antigen repeat
  Pfam annotation: Domain name=Strep_SA_rep; Domain location=539-563; Score=1.5; E_value=61; Accession=PF06696.2; Description =Streptococcal surface antigen repeat
  Pfam module annotation: Pfam domain module=Strep_SA_rep::Strep_SA _rep::Strep_SA_rep; Domain location=208-232::296-320::539-563
MPLFLSDEEFAWCSGDGSAVAAKADAFIRGLFNELDTVRSKAHAADINAEQNCLLIEQKYLSLTAEFSKLESNIAELQSSLDQRLREIDEVQSQNHRIKLEAVEKDREIERLRTEVAELHKSKRQLLELNEQKDLELSEKNATMKSYLDKIVLKINPRFVVAMSRFLECLPPQLWPYIGCICLQFPTIEEQDKTAIATAMVRLSENAAHKEARLSEVEAELALCRAACTRFEQEKEIVERQNSWLNEELNAKVNIVFELRRKHTEFEADMTSKLADMQRQFGESSKSLLWNEDRVRELEIKLKSVQEELISAKDVAAANEEQLSAELSTVSEQGSEELTPAACLLTFEIEWEREPWSKGRPKKMQDPHVDLLSSGLEAQSALENAVSCTGIADDAIALQLNELINEGLDEPWSIELFNRELNEHLPYPCICKEAVSGFEPMTNKSPRHNFTAAPGLALTHLVNKLNELYKESSEEWSKKAADLEGVIKAIESRLKQVEDDYKEKLEKELSARKQVEKVTTMVMLGVDEYLGDIGLLEATDLKEKLEKCEAEIETRKKTDGVNNLPLSSFATEPWMEPIEADTMVEENSLLLVPRIPVGVSGTALAASLLRDGWSLAKMYAKYQEAIDALRHEQLGRKESEAVLQRV

SEQ ID NO: 182701 - protein, 1101 aa, Glycine max
  Coding DNA Sequence Number=SeqID_91016
  Gene Ontology: Mol. function=microtubule motor activity; Cellular component=nuclear pore; Biological process=protein import into nucleus
  Homolog annotation: Hit_ID=A5AYB9; Match level="QueryCoverage=97%, HitCoverage=79%, E-value=0.0, Identity=43%"; Hit description =Putative uncharacterized protein
  Pfam annotation: Domain name=M; Domain location=127-147; Score=1.8; E_ value=77; Accession=PF02370.7; Description=M protein repeat
  Pfam annotation: Domain name=M; Domain location=197-217; Score=3.8; E_ value=41; Accession=PF02370.7; Description=M protein repeat
  Pfam annotation: Domain name=M; Domain location=282-302; Score=7.5; E_ value=13; Accession=PF02370.7; Description=M protein repeat
  Pfam annotation: Domain name=M; Domain location=356-376; Score=0.4; E_ value=1.2e+02; Accession=PF02370.7; Description=M protein repeat
  Pfam annotation: Domain name=M; Domain location=478-498; Score=0.7; E_ value=1.1e+02; Accession=PF02370.7; Description=M protein repeat
  Pfam annotation: Domain name=M; Domain location=56-76; Score=5.5; E _value=25; Accession=PF02370.7; Description=M protein repeat
  Pfam annotation: Domain name=TPR_MLP1_2; Domain location=89-344; Score=133.0; E_value=8.3e-37; Accession=PF07926.3; Description =TPRMLP1MLP2-like protein
  Pfam module annotation: Pfam domain module=M::M::M::M::M::M::TPR_MLP1_ 2; Domain location=127-147::197-217::282-302::356-376::478-498::56 -76::89-344
VVAELQKAKDEIEKWKEEAHANKAHMLQYKSIAEVNEDALKEIEKAHEKFKIEADNGKKDLESELKSLRDKMLELENKSSLKYEEVASETVGKEEALTSAMAEITNLKEEILTKSSQISAMEIQISGLKEKLDREHQKWRAAQTNYERQVVLQSETIQELTKTSEALALLQEEASELRKLANTQKIENNELKAKWEDEKVQLEKSRNDAEKKYNEINEQNKILHSQLEAFHIQWAEKERNAAGISSGSSSADAFGDAGLQNAETEVSLLKQEKLRLQSQHESALKAAESAHASLETERAKSRSFLFTEEEFKALQLQKLRELAQKVRAETENLENLLREREIELQRHKKEIGTLKMEKDNLNKKVSELLERSKNVDVEDYDRVKKLAREIQDKLRERDARIEELGKSLSEKQDSVSCLEKDLSNCRLELAEREKRINDILHNEANLKLDSEKHRKLLAQFKVHGNSYLGKWIEFFGWLEKEDLGKENQQLSRQLDEIKQGKRSTCDTTGEQAMKEEKDTRIQILEKHLERQRDELKKEKEESRLERSRRLKTEKAIKDSYNNVEQEKIKLIIEIERYKESLKRLSDEVEKLKIVIGNLPEGSNVVQLLSGSNVDDFAAPYISAVESFEKEAQSVFRELGGRGNLGDAATITDGSAAATAAPGVSGLPPKATGESEKRLALPKASVETRRTGRRLVRPKLLEKSEKRPEELQGGDTEMSDAEGPGGKPGQSSDTDTSNVVQSSQQLARKRVAPTSTSELREESVAPGEKSSDVLKKSKGSESLEENTEEQPAAILEFTGSHPVTEELFDSSDMPQCQNEEVGEAQNEDGEIAVGNDEESKDPRHLDGTGQEELQADKTGTLEENQDQSAETKVLSDEMQRNQTDPDNQQSTLAPSGEREEGELMPDTGDLEGASDLSNIAENQESREGQSESAATPERSPARVDDDALEAGEINSPELSSDDKNDEGDLVEEAADGSDKLIDVNEPISAESDQVAEPVASETATSTSTVAESSSSKVNLPVPRQGTPSAPAETEETKQASPVGSTSTTINLSERARERAQMRQAGLVSSTLRGRGRGGAPRGRVGRGRGVVRRPPPPPGSDQ

SEQ ID NO: 182702 - protein, 223 aa, Glycine max
  Coding DNA Sequence Number=SeqID_91017
  Homolog annotation: Hit_ID=Q9AVH2; Match level="QueryCoverage=21%, HitCoverage=16%, E-value=1e-19, Identity=97%"; Hit description =Putative senescence-associated protein
MTEGCGEGFCLANLPGDAFSLWGNFFEAKKQMMADAKLRGCLPLVEICPPVNFVVLPVVGLARVGGAGLWPRAKFRIGWPPPPPRDQFCCQDFANFGLRPGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 182703 - protein, 184 aa, Glycine max
  Coding DNA Sequence Number=SeqID_91018
  Subcellular localization annotation: CTP_CleavageSite=39; ConfidenceScore=5.48e-01
AFHASSTHEPGAPRNYFLALFANSPFSTFIRKPMNLLPSAVHASSTNEFGAPLMNLLPSAVHASSTNESGDPGIYCLALFANSPFSTFIRSPMNSLPSAVHASSTHEPGAPRNYFLALFANSPFSTFIWSLMNLFPSAVHASSTNESGDTGIYYLALFANSPFSTFIRSPMNTLPSAVHALSTH

SEQ ID NO: 182704 - protein, 79 aa, Glycine max
  Coding DNA Sequence Number=SeqID_91019
MVADVKAMVVRLRLAAAAGLASTARPEINAENPSALLDFSGSTGCLGGHLDLSQSGHASVHDLHPLPRYASCKIMSRRA

SEQ ID NO: 182705 - protein, 91 aa, Glycine max
  Coding DNA Sequence Number=SeqID_91020
MTMITPSSKLTLTKGNKSWYRAPPRGDALVWGEANGDADVNLSLLIVTAAQGLAWFVLSFSALYCKIEFLQPGGSTSSRAAATAVELQFAL

SEQ ID NO: 182706 - protein, 337 aa, Glycine max
  Coding DNA Sequence Number=SeqID_91021
  Homolog annotation: Hit_ID=UPI00006A2D9E; Match level="QueryCoverage =40%, HitCoverage=87%, E-value=6e-09, Identity=16%"; Hit description =UPI00006A2D9E related cluster
GLHVLAVRGLHALALEDYTSSPSVGYTPSPSEDSTSSPSEDCMSYPSKGYTPSPSEDYTSSSSEGYTPLPSEDYMSSPLQDYPSSPSDDCTGLPVLTFRGLNVLLLGGLHALAFRGLYVLLFRGLHVLPFRGLHILTIKGPHVLAFRGIHVLTFIGLHVLPFRGLHALAFRGLHVLTIRGIHSLTFRRIHILLFRGLHVHAFRGLHALAFIGLHVIAFRGLHALAFVGLHPLAFIGLHICAFRELEGSRPQDTQWTWRSPTEPWGFQLWLWASVSPTRCPSPPARSHHRDIGKDCTRKIPSGPGEVQQGPGVCSSDYRPLSILRSVHRPQQGHQAPY

SEQ ID NO: 182707 - protein, 134 aa, Glycine max
  Coding DNA Sequence Number=SeqID_91022
MSKKDRKATQLRSLATRPVKAKGPVVHVVLATGKALAHGKEGEDDKVCEKYDISKEKWNQFCQNRRDPSWEKAQAIQKQNTAPHVLSHGGYDFLEQKLMEEKKKKRLEEATQSRSTDIIVDPPSPIRRHMKWKM

SEQ ID NO: 182708 - protein, 129 aa, Glycine max
  Coding DNA Sequence Number=SeqID_91023
  Homolog annotation: Hit_ID=A7QNA6; Match level="QueryCoverage=41%, HitCoverage=6%, E-value=2e-07, Identity=59%"; Hit description =Chromosome chr2 scaffold_132, whole genome shotgun sequence
ALGVAKPLVASYLSQEILAEQEVDRVHGLPAQPPVKFKNMVVISLSMKLKEEHCSIGFSRPLTNQNKNPFSYGSMECQNLLLELADYFVYQCGGCGAVLRAKHKGYVSGSLSDEGKVVLGGHSGKLESS

SEQ ID NO: 182709 - protein, 54 aa, Glycine max
  Coding DNA Sequence Number=SeqID_91024
LLGKWIWALAYHLQQPWARIINSKYGAKSDFQSARVQGGAFILVEGPKKALSPV

SEQ ID NO: 182710 - protein, 82 aa, Glycine max
  Coding DNA Sequence Number=SeqID_91025
MHENKWHGACLLFAPIWKPIDRPNSQKSPVESPTIATCPSRASEGEAHRCAFQRRKDARSRHQRLFVENIGKTEGNWSKGKF

SEQ ID NO: 182711 - protein, 353 aa, Glycine max
  Coding DNA Sequence Number=SeqID_91026
  Gene Ontology: Mol. function=phosphoprotein phosphatase activity; Biological process=intracellular signaling cascade
  Homolog annotation: Hit_ID=A7R8Y3; Match level="QueryCoverage=52%, HitCoverage=62%, E-value=4e-28, Identity=35%"; Hit description =Chromosome undetermined scaffold_3090, whole genome shotgun sequence
MCSATDYKVKSIGGMCILIQMWAWERCMTLAPKRTPPVIENKPLGHRWLRRGNQHIGNDDLRLFRRKLDLMKRHEFVWEPYTPTVMAALPPICVVGSVAWFAVVPLICFHVVEWHQPDRVLRQFGLQQPILGRPSQSQNLHGITLKEFRVDVYPRQEGLLGYNSDYMVWYRRKTKMFVDPNNANTAALGDVVETLQYMVSPQGRNTWTVDDLAPYVDKLAIISEEQERITEPVSHGPASEREFPAQEFHILQSSVETRGIGRRRELVEAEQYSQQMMERGHGMYYMPATFSEYPSQMYQYPFEGHHTDTSASEHSFGGVAETQAHFSWPTMTPSQQHDAPMATPNTPFAPQWN

SEQ ID NO: 182712 - protein, 360 aa, Glycine max
  Coding DNA Sequence Number=SeqID_91027
  Homolog annotation: Hit_ID=Q6WAY6; Match level="QueryCoverage=98%, HitCoverage=58%, E-value=9e-43, Identity=32%"; Hit description =Putative uncharacterized protein
MGQLQQQAFHKTYGKIMDLAMIEVSTEAISSLAQYYDQPLRCFTFGDFQLSPMVEEFEEILRCPLGGRRPYLFSGFYPSLARISKIFQISAQELDHGKQVRNGVVGIPRKCLEAKARTLAGRGEWAPFIDVLALLIFGGVLFPNMDGLVDLVAIDAFLAHHDHKESPVVAMLADLYDTFDRRCEKSSTRIVCCIPALYVWLVSHFFRQEVRQACPLESHRSCTEKGGTNWDRLLANKERASVNWFPRWKEGRTGVLISCKGFPNVPLMGTRGCISYNPVLAIRQLGYPMRGAPLEEELAPIISRGFNKTNGETLQKVRKAWEVVQKKDKELRGSNNGPIGGYRRWLKAHVQGLDWLRSRV

SEQ ID NO: 182713 - protein, 266 aa, Glycine max
  Coding DNA Sequence Number=SeqID_91028
  Homolog annotation: Hit_ID=Q2HW90; Match level="QueryCoverage=74%, HitCoverage=39%, E-value=7e-24, Identity=32%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPSTTRVAKVVKISAQELDRVNQNRNGVVGVPRKYLEVKARILADKGEWTPFIDILTLLIFEGVLFPNVDGLVDLAAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESRFYLHAKDVQMFP

SEQ ID NO: 182714 - protein, 53 aa, Glycine max
  Coding DNA Sequence Number=SeqID_91029
MEYREYPRKCLEEKAETLASQGELAGGSSSDQCFSCLSPKQGKPDQCCFSRCV

SEQ ID NO: 182715 - protein, 73 aa, Glycine max
  Coding DNA Sequence Number=SeqID_91030
MLLTTITCKLVIDYQRSLQPAAFNSKRGNRLPPLVIDYQKPLWLPDLVFKPGNRLHPLGNRLPETILASCFHF

SEQ ID NO: 182716 - protein, 105 aa, Glycine max
  Coding DNA Sequence Number=SeqID_91031
MGDLWDGQKSVDRSCDNYIDIVSPFILNNICPMMVSFARVSEIRVSEATSQEEDLLHRSTKKIKEGAKVYMKGSSMSFADKILQPVGRAGMSMETAMNLHKDVMN

SEQ ID NO: 182717 - protein, 121 aa, Glycine max
  Coding DNA Sequence Number=SeqID_91032
  Gene Ontology: Mol. function=protein serine/threonine kinase activity; Cellular component=plasma membrane; Biological process =protein amino acid phosphorylation
  Homolog annotation: Hit_ID=A7QG60; Match level="QueryCoverage=100%, HitCoverage=14%, E-value=1e-27, Identity=53%"; Hit description =Chromosome undetermined scaffold_91, whole genome shotgun sequence
MEWQKKGLIEKIVDPFIVDEIKPSSLKKFGETAEKCLAEYGVDRPTMGDVLWNLEYAYQLQTNERKREHGIDADDGSEAAVTPPPMGVPARRGGVDADSDDGTSDISSSRVFSQLITNEGR

SEQ ID NO: 182718 - protein, 86 aa, Glycine max
  Coding DNA Sequence Number=SeqID_91033
  Gene Ontology: Mol. function=oxidoreductase activity, acting on NADH or NADPH, quinone or similar compound as acceptor; Cellular component=integral to membrane; Biological process=electron transport
  Homolog annotation: Hit_ID=Q2QD36; Match level="QueryCoverage=73%, HitCoverage=17%, E-value=1e-22, Identity=84%"; Hit description =NAD(P)H-quinone oxidoreductase subunit 1, chloroplast (EC 1.6.5.-) (NAD(P)H dehydrogenase subunit 1)
TLQIEYGLEGLVGPEYAGPLGILQALADGTKLLFKENLLPSRGDTRLFSIGPSIAVISISLSYSVKNDNYVSMKEKKIKKKGKSCK

SEQ ID NO: 182719 - protein, 172 aa, Glycine max
  Coding DNA Sequence Number=SeqID_91034
MTTLTQIWMTLLLSNVLPNDHNFDLPLPKCQLVYAILTWMSIHVAEVIADAIYLFAGMAPTRHPLDLEKSNRALGFPALITGLYQSYGVHVTPNKVIRLPITRAFIEKYSTPRQAQGDAHQDARTPPPPRQADLARPLGVEQYLQHLVRQQAANHRGQVQIHECLYRFRLSQ

SEQ ID NO: 182720 - protein, 270 aa, Glycine max
  Coding DNA Sequence Number=SeqID_91035
  Gene Ontology: Mol. function=transcription factor activity; Cellular component=intracellular; Biological process=regulation of transcription, DNA-dependent
  Homolog annotation: Hit_ID=A8AMU1; Match level="QueryCoverage=77%, HitCoverage=60%, E-value=6e-56, Identity=54%"; Hit description =Putative uncharacterized protein
MPTRSQPLSRICSPTACAAEQGMTIISYDNRLAESVPPRARYFDSVSMDNVEAGRLAAQHLLDNGCRNIVFATESGLTLGRSHKILGFQSALSQSGTAARGVVIEGKGNREFGDAEMFELGVSLAQKISALTPRVDGVVAINDALAIGLMVGLRAQGLKIAEDISVIGIDNISLSALSSPGLTSVMAPLSAMASMMVERLVQRITEPGLQTDEFIFAPEVIQRQSGDLYPITFKTHINVGISIPFFCTLTSITGNNDEPTICAIYRKERH

SEQ ID NO: 182721 - protein, 447 aa, Glycine max
  Coding DNA Sequence Number=SeqID_91036
  Homolog annotation: Hit_ID=Q6WAY6; Match level="QueryCoverage=70%, HitCoverage=60%, E-value=5e-39, Identity=32%"; Hit description =Putative uncharacterized protein
MMWTNQNAKRFYQVKVKGLDVTCLKELGRLMGPLQREAFRKVYGKILDLTVAEVFTEAVVSLAQYYDQPLRCFTFGDFQMVPTIEEFEEILGCPLGGRKPYLFSDFLPSLSKVAAVIGDSAKELDRIKQIRNGVVGLPRKYLEDKARDMASQEKWGAFADVLALLIFGVVLFPNVDGLVDLAAIDAFLAYHHSKESPVMAILADLFDTFDRRCEKNSARIVCCLPALCGAARSIGSSLEGRQGRSLFSCGDYPNVPLIGTRGCINYNPALAIRQLGYPMRGAPTEESLSPFLMRDLSAQGLKVIQRIHKAWRSPLWKDKELRGIRNGVIGGYHGWLRIHTRGLDWLSKLKVIDEENFEALEEDEEVRALKLELGKARLAKEKFKSAATHIRKECTELQEENAATAKALEQETKRARKEEYGREKFRGALWGSKNELKLRREERDRSR

SEQ ID NO: 182722 - protein, 194 aa, Glycine max
  Coding DNA Sequence Number=SeqID_91037
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q9SC30; Match level="QueryCoverage=100%, HitCoverage=41%, E-value=2e-91, Identity=85%"; Hit description=ATP synthase subunit beta
  Pfam annotation: Domain name=ATP-synt_ab_C; Domain location=81-188; Score=179.0; E_value=1.3e-50; Accession=PF00306.18; Description=ATP synthase alphabeta chain, C terminal domain
MPSAVGYQPTLSTEMGLYKKESLLPKRDDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVGNIDEATAKATNLEMESNLKK

SEQ ID NO: 182723 - protein, 119 aa, Glycine max
  Coding DNA Sequence Number=SeqID_91038
MLQPYGINIGLKEHSNPVTPKAYTPKSPSGPLPPDSVIPPAVPIEFPNVRETEKRLKPPLVPSSYDSFFSLHEYYLKNPNGGSVQNLVLNKISKFNQNPTVNETGIVVLPRQFWVSVGN

SEQ ID NO: 182724 - protein, 148 aa, Glycine max
  Coding DNA Sequence Number=SeqID_91039
MKLAKYRLGPLEWEGRPGPSGEGQSPRVEKDEGPEAETLSRLLITYQGNPCGVYPDLSSFIGSGVYPDLSSFTGSGVYPDLSSFTGSGVYPDLSSFTGSGVIQIFVTCIKRSAPTQVHITFPNRHHANFIQRLNRRDNSWQRSRNNRD

SEQ ID NO: 182725 - protein, 100 aa, Glycine max
  Coding DNA Sequence Number=SeqID_91040
MVYTHREWEVAGLACAPTDHPCLFDNQKRIKNNTFDVDHRRKTKWMIGEMKEKEELVLVGHRMFHGNGGLQRWWWRRIPFVSLTIMPFEVVSTNSDRWAL

SEQ ID NO: 182726 - protein, 38 aa, Glycine max
  Coding DNA Sequence Number=SeqID_91041
MPAGVDGRSPEFHEPRDLRSNPFQGGGNDAILPPKGIG

SEQ ID NO: 182727 - protein, 38 aa, Glycine max
  Coding DNA Sequence Number=SeqID_91042
MAAIFSSSLFVSSPIPESIKLHNFSGLAPRSFRIKRKK

SEQ ID NO: 182728 - protein, 214 aa, Glycine max
  Coding DNA Sequence Number=SeqID_91043
  Gene Ontology: Mol. function=3-dehydroquinate dehydratase activity; Cellular component=cytoplasm; Biological process=aromatic amino acid family biosynthetic process
  Homolog annotation: Hit_ID=A7XEE1; Match level="QueryCoverage=90%, HitCoverage=38%, E-value=5e-76, Identity=73%"; Hit description=3 -dehydroquinate dehydratase/shikimate 5-dehydrogenase
  Pfam annotation: Domain name=Shikimate_DH; Domain location=81-192; Score=39.5; E_value=1.2e-08; Accession=PF01488.11; Description =Shikimate  quinate 5-dehydrogenase
  Pfam annotation: Domain name=Shikimate_dh_N; Domain location=4-47; Score=-4.2; E_value=0.00022; Accession=PF08501.2; Description =Shikimate dehydrogenase substrate bind
  Pfam module annotation: Pfam domain module=Shikimate_DH::Shikimate_dh_ N; Domain location=81-192::4-47
MITNLVRGSRMTVAGCRDVTIPHKEAAIKCCDEVDPVAKSIGAVNCIVRRPTDGKLIGYNTDYVGAVTAIEDGLRGKHNGSSTTISPLASKLFVVIGADVAGKALAYGAKAKGARVVIANRTFENLLMQIGGDALALSDLDNYHPEDGMILTNTTSIGMQPKVDEKPVSKHALKYYSLVFDAVNTPKITRLLKEAEESGATIVTGLEMFMGRTI

SEQ ID NO: 182729 - protein, 98 aa, Glycine max
  Coding DNA Sequence Number=SeqID_91044
  Gene Ontology: Mol. function=3-dehydroquinate dehydratase activity; Cellular component=cytoplasm; Biological process=aromatic amino acid family biosynthetic process
  Homolog annotation: Hit_ID=A5ATW0; Match level="QueryCoverage=76%, HitCoverage=14%, E-value=7e-25, Identity=77%"; Hit description =Putative uncharacterized protein
MKLNETFPICTISPKVAYEFYDSIRGKTFNKTKVIVSSHNYQLTPSMEDLGNLVARIQATGADIVKIATTALDITDVARMFQIMVHSQVRRLCLEIEF

SEQ ID NO: 182730 - protein, 138 aa, Glycine max
  Coding DNA Sequence Number=SeqID_91045
  Homolog annotation: Hit_ID=A2Q1D6; Match level="QueryCoverage=78%, HitCoverage=17%, E-value=1e-12, Identity=37%"; Hit description =Ovarian tumour, otubain, related
MDEEQWMYDNMMSEEVDMNIENEKDAGVKVEHVDCSDIFNTSQLFATRDEVLQWARSLAHDIGFFVVIMRSDTDTGVRGRASFLLIACERRGEYRPKKHNLVRTCTGSRKCGCPLKFHAKPVSGGGGWMVKLIYGVHN

SEQ ID NO: 182731 - protein, 169 aa, Glycine max
  Coding DNA Sequence Number=SeqID_91046
  Homolog annotation: Hit_ID=Q2HVW1; Match level="QueryCoverage=72%, HitCoverage=51%, E-value=3e-08, Identity=29%"; Hit description =Putative uncharacterized protein
MPMREKTWLSNTWVGRLKNLVLFDRMEDDLMWNGGEGITPKYIGDDMVLLMGLTETRTGQMAKEANEQGLSLFNSLEKWTPQLRIGYLLVWLLYWGISLHAWDLEHIKQIVMVVGEVMEVDDKMDKLHKLDRARILVKTPQQPLIQHKVSTWINGIEYTMHMVEETCYN

SEQ ID NO: 182732 - protein, 83 aa, Glycine max
  Coding DNA Sequence Number=SeqID_91047
MMVLNKPRRGLSQHALLRASEARVTGALSKGGKMRRVATNEGISTSHVDKSGALAPTYPPSKRKSDLRSSSLRVNQAILFLLE

SEQ ID NO: 182733 - protein, 179 aa, Glycine max
  Coding DNA Sequence Number=SeqID_91048
MGLEIYPKVHENPWTFFSSFSPILLESLAHGSSDWSLSREDCIRSHLRHKISCSFSPSPSTHLLLPSGSYRWLPMVWHLQSSFFLLHSASIDLQEAKDFIDEEDPRPTSSTWSYIKTSFSKKTHFVSSKGVNLTKVCLKARNSLWYLDSGCSRKLTGDKSKLSDFVSRVVDTSCSEKEI

SEQ ID NO: 182734 - protein, 123 aa, Glycine max
  Coding DNA Sequence Number=SeqID_91049
  Subcellular localization annotation: CTP_CleavageSite=41; ConfidenceScore=5.29e-01
MGKSSKKRKGTSSTTAAAGHRRHKQSEAPTAPIHPSLSSPRSSTLFSSDDQHLQYNSQFSSRIILDTKYLDIDFFNDETFDCYQVFQNSGLIDFMSLKLPYYPELVRVFYSNLKIQDGVIRSK

SEQ ID NO: 182735 - protein, 125 aa, Glycine max
  Coding DNA Sequence Number=SeqID_91050
MLEDDCRYLMVSKIPTVGISLKAQTEINGLLEGYLRHFSANQPEGLELLDPLTPHTIAAGGGLPISLLFCQDVAGAQRPSPNLLKLKAWPGLKEEESRPCREADRRDRPREERAQPTRAPPDVVD

SEQ ID NO: 182736 - protein, 91 aa, Glycine max
  Coding DNA Sequence Number=SeqID_91051
MAPTRHPLDPEKSNRALGFSAMITGLCHSYGVPVTPSKDAGAPPPPRQADSAGSLGVERLSQQGQGSAPFVCPTPEQFGAKVTWPGDWPDA

SEQ ID NO: 182737 - protein, 74 aa, Glycine max
  Coding DNA Sequence Number=SeqID_91052
MSDSSASHIETLEIEQWKLSTYSTGHNYSHGGLIQAHHITRRSSLQQQKLSRNSNCHDLSQGGPIKAHNISRRS

SEQ ID NO: 182738 - protein, 58 aa, Glycine max
  Coding DNA Sequence Number=SeqID_91053
VDYASKWVEAVAAPKNDAKTVVKFLKKKTFARFGNYLQDPYRPVSVPNGLWQMPTTYR

SEQ ID NO: 182739 - protein, 42 aa, Glycine max
  Coding DNA Sequence Number=SeqID_91054
MDSFRLKQEQALGFLDPRQTPDTSYQLSSTVENQWDVAASHL

SEQ ID NO: 182740 - protein, 276 aa, Glycine max
  Coding DNA Sequence Number=SeqID_91055
FKQRDPCWSFIQLLDYLKLALLDEAEELMGLFQSHGFSLKSLFLFGSSCHGRIYFLRGGGYVCGLLDHGRLPFRGKFHRVRGSEHPTTAGYATEAGDVGAVRGYMGVEPVPFLVKHITRALGVRGTFFSSDCIQICGSSLPPMDTSSCPAEAILLPRDRFPCRVTPRGETNIRPLRLRHGRPYMPLAVIGVNVVSGSSTMVRTLGTRVIPLEVGWLKDPPGREVIFREWALCIIIARAGGRIVDWPGRGWSCALGRRSLCRGRSFYLSQGGTLGSD

SEQ ID NO: 182741 - protein, 103 aa, Glycine max
  Coding DNA Sequence Number=SeqID_91056
MTQFMSRREKYFIEVEAQEESPVKEHESREKDEEQAQKQWEKPLAKLITVHALSCESQVLSAQPLHLKLIHSAKLAKAELSQIQFDLDLAKRKPTAKRQLILG

SEQ ID NO: 182742 - protein, 67 aa, Glycine max
  Coding DNA Sequence Number=SeqID_91057
MRLHCHQASQRPNMTTDSPPLLMAHIDPGIGPNISMRETLRHWTSNDLLFFLKGVVDKSGAFAPMYP

SEQ ID NO: 182743 - protein, 76 aa, Glycine max
  Coding DNA Sequence Number=SeqID_91058
  Gene Ontology: Cellular component=chloroplast
  Homolog annotation: Hit_ID=Q3BAJ0; Match level="QueryCoverage=75%, HitCoverage=70%, E-value=4e-14, Identity=71%"; Hit description =Putative uncharacterized protein
MLSVPLGFPEEDAIRLMRNKKGISKIRVAEAEAATFEVTERKATTGVGESESKRGFLTSFSHSKPCMRLSSRTAPK

SEQ ID NO: 182744 - protein, 161 aa, Glycine max
  Coding DNA Sequence Number=SeqID_91059
MEREERERVLESLHGEAMKWMDKFALTLNGSQELLRMLARAKAMVDVYSALEEVHGLFDYLVIVKVNTITKKNECALRYPYQTRAKTKIMSEIEEVQEQMKADMEAMKDQMTSMMEAMLSMRWMMEGNAAAVAATSAVAEADLTHPFDINKTSHPVPDMVG

SEQ ID NO: 182745 - protein, 154 aa, Glycine max
  Coding DNA Sequence Number=SeqID_91060
  Homolog annotation: Hit_ID=P0A1U1; Match level="QueryCoverage=98%, HitCoverage=97%, E-value=3e-74, Identity=92%"; Hit description =Uncharacterized protein yigI
  Pfam annotation: Domain name=4HBT; Domain location=55-145; Score =62.3; E_value=1.6e-15; Accession=PF03061.13; Description =Thioesterase superfamily
MSELTAAAALKLVGEIFVYHMPFNRALGLELERYEKEFAQLSFNNQPMMVGNWAQSILHGGVIASALDVAAGLVCVGSTLTRHDTINEEELRQRLSRMGTIDLRVDYLRPGRGERFTATSSLLRAGNKVAVARVELHNEEQVYIASATATYMVG

SEQ ID NO: 182746 - protein, 592 aa, Glycine max
  Coding DNA Sequence Number=SeqID_91061
  Gene Ontology: Mol. function=hydrolase activity; Cellular component =integral to membrane; Biological process=metabolic process
  Homolog annotation: Hit_ID=A6TGK6; Match level="QueryCoverage=44%, HitCoverage=98%, E-value=1e-142, Identity=93%"; Hit description =Conserved protein, phosphatase-like domain
  Pfam annotation: Domain name=Hydrolase; Domain location=142-375; Score=35.8; E_value=1.5e-07; Accession=PF00702.17; Description =haloacid dehalogenase-like hydrolase
  Pfam annotation: Domain name=Hydrolase_3; Domain location=145-400; Score=289.3; E_value=7.8e-84; Accession=PF08282.3; Description =haloacid dehalogenase-like hydrolase
  Pfam annotation: Domain name=S6PP; Domain location=141-400; Score= -64.6; E_value=5.2e-06; Accession=PF05116.4; Description=Sucrose-6F -phosphate phosphohydrolase
  Pfam module annotation: Pfam domain module=Hydrolase::Hydrolase _3::S6PP; Domain location=142-375::145-400::141-400
MGGAIATLFLQRHRQHCDAIALCAPMFGIIMRLPDWMVRHILDWAEGHQRIREEYAIVANAIVATCVFMPTIRGCASAGRPITGCAKAEDEKVVDNLMHDRYCELRSAAGHPCEGDKPLVIEGAYHEILFEKDAMRSVALNAIVVASDLDGTLLSPDHFLTPYAKETLKLLTARGINFVFATGRHYIDVGQIRDNLGIKSYMITSNGARVHDSEGKQIFAHNLDRDIASDLFEMVRNDVKIVTNVYREDEWFMNRHRPEEMRFFKEAVFNYKLYEPGELDADGISKVFFTCEDHEHLLPLEQAINARWGDRVNVSFSTLTCLEVMAGGVSKGHALEAVAKMLGYSLKECIAFGDGMNDAEMLSMAGKGCIMANAHQRLKDLHPELEVIGSNADDAVPHYLRKLLIGEYLAGSVDSYFSVLMRVGLAALVFLPFLHTRGQSPRTIVLYMLVGAMQLGIIGRKLRWGYLLSAALAVLGAAIIRYDKVSDHFWTGLLLVQLSNICFAIGMVGYKRLMEVRPMPQHNAFAWFYAGAFIVAVAAWFMLSNPQRLPTTDLQWGILDWLGVVASGLGYFMWNYGATHVDAVTLGIMITF

SEQ ID NO: 182747 - protein, 106 aa, Glycine max
  Coding DNA Sequence Number=SeqID_91062
MGDQEEVQEQMKANMSALKERMASMMDAMLGMRQLMANNAATAAAVSSAAEADPTPRGPPPAAEEKRKLDLIEERLRAVEGFSDYPFADMTDLCLVSDVVIPPKFK

SEQ ID NO: 182748 - protein, 74 aa, Glycine max
  Coding DNA Sequence Number=SeqID_91063
MKNKEKKNVLIFEDLDTSILKKNHRRSGKALQVEVSGISGHRKPQFLPSFPLDHCSHQRNSVYGTQTSFPLVPL

SEQ ID NO: 182749 - protein, 167 aa, Glycine max
  Coding DNA Sequence Number=SeqID_91064
ALGFPTLITGLCQSFGVPVAPSKVIRPPITRAFIEKYCTQRQVQGDAPQAADAPPPHQAGPARLFDTEQYLRHLVRQQAANHRAHVQTHDCLYQMSLSLQSQGFTSFLCPTLDQFRAEVAWPGDWPEARAGEAPAEAPVEAPAEADEAHEDEEMTDLLDFLGGSGAT

SEQ ID NO: 182750 - protein, 28 aa, Glycine max
  Coding DNA Sequence Number=SeqID_91065
DESSELKAIDFGLSDFVRPGLPSQVLTW

SEQ ID NO: 182751 - protein, 155 aa, Glycine max
  Coding DNA Sequence Number=SeqID_91066
  Gene Ontology: Mol. function=phosphoprotein phosphatase activity
  Homolog annotation: Hit_ID=A5C0F5; Match level="QueryCoverage=47%, HitCoverage=11%, E-value=7e-12, Identity=51%"; Hit description =Putative uncharacterized protein
  Pfam annotation: Domain name=DUF1723; Domain location=35-80; Score =36.1; E_value=1.3e-07; Accession=PF08330.1; Description=Protein of unknown function (DUF1723)
MDDKPLLRHQHVHRSRTTINELITSYYHILPEPEPQIIPLLLSTGPETHTFHLPWGECTITLEDVAHHLDIRVDGRVVAEPSFLHWDELCHELLGEVRPENARKGAALKLTWLLNMLRAPLPEEPTTHQLQCSHGLGIACYCTKSPTIRNKFSTG

SEQ ID NO: 182752 - protein, 46 aa, Glycine max
  Coding DNA Sequence Number=SeqID_91067
MDTSNPYTGAMKGIVHEPQVLSYKVMSKDDNWYLKASHWGNEGHRA

SEQ ID NO: 182753 - protein, 279 aa, Glycine max
  Coding DNA Sequence Number=SeqID_91068
MTKFDPDIVLEFYANAWPTEEGVRDMRSWVRGQWIPFDADALSQFLGYPLVLEEGQECEYGQRRNQVDGFDEEAIAQLLCIPGQDFARTAAGRRVQIMRTNMTTLTQIWMTLLLSNIQPSDHNSDLPLPKCQLVYAVLTRMSIHVAQLIADAIYLFAGMAPTRHPLDPDKSNRALGFPALITGLCQSFGVPVAPSKVIRPPITRAFIEKYCTQRPAQGDSPQAADTPPPHQAGPAGAEVAWPGDWPEARAGEAPAEAPAGAPDEADEAREDEEMTDLLD

SEQ ID NO: 182754 - protein, 76 aa, Glycine max
  Coding DNA Sequence Number=SeqID_91069
  Subcellular localization annotation: CTP_CleavageSite=51; ConfidenceScore=5.33e-01
MRGYLMVNRTFGQPGANEPVGARRLTSSSTPFSVLTLEGYLMVTRTFRQPGANELVDARGLTSSSAPFVVLPREVK

SEQ ID NO: 182755 - protein, 312 aa, Glycine max
  Coding DNA Sequence Number=SeqID_91070
  Homolog annotation: Hit_ID=UPI00016621D1; Match level="QueryCoverage =80%, HitCoverage=39%, E-value=2e-18, Identity=32%"; Hit description =UPI00016621D1 related cluster
GLHALAIRGPHVLTFRGLHALAIRGLHVLTFRGLHALAIRGLHVLTFSGLHALAIRGLHVLTFVGLHALTFRGPHVLTFRGLHALAIRGPHVLTFVGLHALTFRGLHVLTFSGLNALGSEDYTSSSSEDYMSSPSEGYAPSPSGLRALAFVGLHALTFRGLHVLTFRGLRALAFVGLHALTFGGLHVLTFGGQHVLALTFRGLHVLTFRGLHVLAFRGLHVLTFRGLHLLAFKGSCTFTFVGLHALTFRGLHVLANRGLHALTLERATRPRQQRAARPHLERSTRPRQQRAARPHLGEGYTSSPTEGCTPSP

SEQ ID NO: 182756 - protein, 199 aa, Glycine max
  Coding DNA Sequence Number=SeqID_91071
  Gene Ontology: Mol. function=aspartic-type endopeptidase activity; Cellular component=intracellular; Biological process=RNA-dependent DNA replication
  Homolog annotation: Hit_ID=A5BQR1; Match level="QueryCoverage=74%, HitCoverage=7%, E-value=2e-10, Identity=29%"; Hit description =Putative uncharacterized protein
  Pfam annotation: Domain name=G-patch; Domain location=95-139; Score =16.9; E_value=0.0017; Accession=PF01585.14; Description=G-patch domain
MALPSTSCPSYFGQAVFQRVTLEAELHGGASFQWMVPSMLHQKLKFVVEGQLIIVSGEEDILAVEESLETSFQALEVVSSAYVESPPVQPHLSGATLMVARVMLGHGYEPGMGLDRNGNGIASLVEFAENCGRFGLGYEPTCVDKRRIALERKERSSAQPQGLQVEEVPFCHIDESFVSAGWMCKGQVVVINEETPQDQ

SEQ ID NO: 182757 - protein, 500 aa, Glycine max
  Coding DNA Sequence Number=SeqID_91072
  Homolog annotation: Hit_ID=Q2HW90; Match level="QueryCoverage=52%, HitCoverage=55%, E-value=3e-24, Identity=31%"; Hit description =Putative uncharacterized protein
MGSNQAPSFKKRFYHVKVKNLELASLRELGQQMDQVRHQAFSKAYGKIWDLTMIEVSVEAIASLAQYYDQSLRCFTFGDFQLVLTIEEFEGILGCLLGGRKSYLFFRFHPSMARVAKVVKISAQELDRVKQNKNGVVGIPRKRLEEKAEALENQGEWTSFINILALLVFGTILFPNVDELVDLAVIDAFLAYHHSKESLVIVVLANAYDTFDLRCEKSDSRIVCCTPALFVWLVSHVFRHEGVVGASVNWFPRWKEGGARVLCSCEGFPNVPLMGTRGAPSEEIIAPFIAWGFNEGNAKILQRIRKLPKPKSLSWKEAEVPEESEEVQALKVELEKIRAVKEKLKTTITRVKKECDELRNVNMTTIEALERETKRARKEEWSRNKFRRALWGSSNELKLRRAERDESRVENMEKVNLAAIHGQRLEDEHAKVSTLQIERVARERLIESLHTEAMKWMDRFALTLNGGQELPRLLARAKAMADVYSTPDEVHGLFDYYQHM

SEQ ID NO: 182758 - protein, 99 aa, Glycine max
  Coding DNA Sequence Number=SeqID_91073
MAKEDPKRKMDYCLGQQAMMGQSDENPEIGQIQAKGPSGEGYSPRVEKDEGLEAETLSRLLITYQGNPYGVYPDLSSFTGSGVYPDLSFFTGSGVIQKL

SEQ ID NO: 182759 - protein, 172 aa, Glycine max
  Coding DNA Sequence Number=SeqID_91074
MAAEWRRKRERRRHFKEKMSLEEAHHHRRPWIRAWRKKEMNEGREREEHEILCSKGALKSEKSTLRFMRTLGPSSAALAQSSWSLLLMVLVIGPFLGRIASILVTWEPNENFDSKSLPITSSDEVALCLDSASIGHCLVVAGHMVGHYVVATGHLVGHCRVVADGQVVDVDE

SEQ ID NO: 182760 - protein, 1187 aa, Glycine max
  Coding DNA Sequence Number=SeqID_91075
  Gene Ontology: Mol. function=binding; Cellular component=nucleus; Biological process=snRNA processing
  Homolog annotation: Hit_ID=A7PA70; Match level="QueryCoverage=90%, HitCoverage=96%, E-value=0.0, Identity=40%"; Hit description =Chromosome chr14 scaffold_9, whole genome shotgun sequence
MEPTSVAQAMEWSIQLEMGLRSTKPGVPVKAISDMEPRLQQWSTEPEFGIAPYAMFGLVPGEDKLFANTILLRLVDAFRGGDIETKLSVVRVFLSERKHRDKEKKKQCKGLLSEAKVANHLELLKRVKSVFDSGELKSKALALVLFGCWADFVKDNAQIRYLIFSSLVSPHDCEVRASLYATGCICEISDDFASISVEMLFNIMNSSSVPLPIKLDAAQVLAKCKSSYSVAYKAYKTGMELVLNSSDEEFLVAMLFSLSKLACILIPCISYQVDFLLSFLNRDRTSHVQDTTLKCLHFLFRRGLYEHSDNLGLIRGLFSIMEGPEISLAMQYKALRVLHKVLLSIPPSSLHKELREFVRLLTVVENASQYPASRKRCLSIRILADLCCRTKDIADIDEVFCCSLPSRVISLIKDHIKLLLKTLLEGCQNDLTIFQELQGLLKILLNIVERHPNLGSLVLDSLKQVIEYLVTVASTNCAVPSTLLTINFTEEKKSFILKLFCKIYRFLVAFLENFYIVGAINTKVFSEVNILVGLVCQCSLIDCYTYTLYHLLLHSQPICDGLVHEIDETHLASCCTMFVNKVLTGTNDWTAYKVGAHAACQGEWLLATNIFRTLIEKVKSDSCCSWLKALFHYAHSEGKIQLLSQPKQGTTSMELMETIKFPITSCDYKGDTCPRLARSINDCNYYDQLTQSHMAVFSSLKILEASVTSSQAFCFQRWFLSLRARVLENLVGVLGALREVSLNVAQNFNQVEIESSDKLQCLKSYQDITQASLQLFRLVEEFDLLRASFIGMDSETSAVLAAHGLSCSILAFATAFGVSNIDQHSQRILIGGKTSNLQALTIQSLRRLFWSVDHETRASFSLLLNYFHPNENCLSPLPSYQNWNIGYKDREVLNVCSYAISGAVRLFEKIAPQFTENALSLTFNTLMKWMHIHFRLPRPFIGSKLFVHNKDSSNGVDISVSQGSHLTLNICLQLKNVPPKLLVKSTKLYCILHVPCGQRQAPGNSHSGYEAWKDDEIVEMNQKLFCLVLDSAAGKRRIGMRSRGHGNSRAVETFMDFRPNEKGQGFSHCSLDVSNFPFLSLRSVERKLQVMLKQVCLLASVEFSHIVESPVIQTEISTVPLGWNNGGVKDGEPLKVYITGFGWHLCTHVQVNERRNGLVFLKCTVVSILHSQECKTSFIVEGLMGVL

SEQ ID NO: 182761 - protein, 401 aa, Glycine max
  Coding DNA Sequence Number=SeqID_91076
  Gene Ontology: Mol. function=protein serine/threonine kinase activity; Cellular component=plasma membrane; Biological process =protein amino acid autophosphorylation
  Homolog annotation: Hit_ID=A9Z0N7; Match level="QueryCoverage=50%, HitCoverage=67%, E-value=3e-31, Identity=49%"; Hit description =FERONIA receptor-like kinase
  Pfam annotation: Domain name=Pkinase; Domain location=202-376; Score=- 109.8; E_value=0.05; Accession=PF00069.16; Description=Protein kinase domain
  Pfam annotation: Domain name=Pkinase_Tyr; Domain location=202-374; Score=-130.9; E_value=0.00021; Accession=PF07714.8; Description =Protein tyrosine kinase
  Pfam module annotation: Pfam domain module=Pkinase::Pkinase_Tyr; Domain location=202-376::202-374
MGFKLMGIDTLYGLRTNTALEIEYRIKVGEINDLATNMNSKMNIMVNPDYVAPKELYRTTRGMGLNKSLELTWEFPVDSGFTYMARFHFCELDPNITNIGDMVFFTYIGSELAEDHADVISWSQKQKGLAVYKDYAILIPRMILIKSLLLLSTNTQDYKLPTNMWDYRLPTNMQDYSEKCWPYNRLCQCFSLDEIKAATNNFDNTSVVGEGGFDHVYKGYIDDISIPVDIKHLKPGSKQGFEEAALSSQISCNCTIIHDEVKTTNILLDEDWVAKGSFGYIDPEYYKRKHLTEKFDMYSFGVVLFEVLCARLALICTTESNQESLAYWVRYCYQNGTIEHIVAPECFKMFCEIGMMSCLSGTERSSMNDIVRMLQFALPIFSSQDFFLRDYRPKAVFGESN

SEQ ID NO: 182762 - protein, 85 aa, Glycine max
  Coding DNA Sequence Number=SeqID_91077
MVQANHQWDWRRVAHAQEQIALAIGDIAGRWNRQSNWRVPGYRLLQVAEVMRSVCRPKGKLQLPLAISWQVATAIGGLRPSSHSK

SEQ ID NO: 182763 - protein, 321 aa, Glycine max
  Coding DNA Sequence Number=SeqID_91078
  Gene Ontology: Mol. function=protein serine/threonine kinase activity; Cellular component=plasma membrane; Biological process =protein amino acid phosphorylation
  Homolog annotation: Hit_ID=Q94KG4; Match level="QueryCoverage=22%, HitCoverage=42%, E-value=5e-21, Identity=72%"; Hit description=Pto -like kinase SG2
  Subcellular localization annotation: CTP_CleavageSite=54; ConfidenceScore=5.15e-01
MDREHRLKLLSVQDGIVTANATTQSPTINKSPTPKLACPVLDSTTLSQSPQAPNSFASSSTLLTTLLFPAPTNPLLFNPTNSSSLMVSMPLSTLMLQTRKPSSENMLSMWIMIRGLSSASLRLNQTDPMLSSMELKQFPCQPICITSNTDGKMNITVNPDHVAPKELYRTAHNMGTNTTLNIISNLTWEFPVDAGFTYVLRFHFWELDPNLDIDGDRVFFIYIASHLVDDRADVMRWTQKQKRFLRKKVYKGYFEGGFTPVTIKHLKLDSQQGANDIMNKIEMLSQLCHLHLVFLIGYCNENYEMILDYDFMACGTPRQHL

SEQ ID NO: 182764 - protein, 146 aa, Glycine max
  Coding DNA Sequence Number=SeqID_91079
  Homolog annotation: Hit_ID=Q9FID8; Match level="QueryCoverage=63%, HitCoverage=9%, E-value=8e-08, Identity=36%"; Hit description =Receptor-like protein kinase
MDGDGGCELQHRVHARERGHDGGVRALCSRRGDVLVSQFELNYSFLVTTGPKFLCMFFHPTSYDPSFPRINTSFMVQFNEITLIYCFNASLTADAENIETIFREYVAIISERLDLSFIISRLNQTPMLSSMELRYFSFQPIYITRL

SEQ ID NO: 182765 - protein, 91 aa, Glycine max
  Coding DNA Sequence Number=SeqID_91080
MGSYWLWSLIEPEFYQVDFTSKLIFKLLETNNSNLQSIIVMEYLKLNVDATLFTNENKSGIGLFVCNEEGTFFKAKTMQDSGRPEAKKAEA

SEQ ID NO: 182766 - protein, 74 aa, Glycine max
  Coding DNA Sequence Number=SeqID_91081
MEVSLACQHPCHCFDHHFDHRFGDIDVIKELLILILTLRKRKRLLPKSCIQSFSVKKLKQKKKKLLMGTTKELH

SEQ ID NO: 182767 - protein, 521 aa, Glycine max
  Coding DNA Sequence Number=SeqID_91082
  Gene Ontology: Mol. function=binding; Cellular component =mitochondrial inner membrane; Biological process=transport
  Homolog annotation: Hit_ID=Q1KUQ8; Match level="QueryCoverage=55%, HitCoverage=91%, E-value=1e-110, Identity=69%"; Hit description =Putative uncharacterized protein
  Pfam annotation: Domain name=Mito_carr; Domain location=187-275; Score=55.0; E_value=2.6e-13; Accession=PF00153.18; Description =Mitochondrial carrier protein
  Pfam annotation: Domain name=Mito_carr; Domain location=286-378; Score=87.2; E_value=5.4e-23; Accession=PF00153.18; Description =Mitochondrial carrier protein
  Pfam annotation: Domain name=Mito_carr; Domain location=392-481; Score=79.0; E_value=1.6e-20; Accession=PF00153.18; Description =Mitochondrial carrier protein
  Pfam module annotation: Pfam domain module=Mito_carr::Mito_carr::Mito_ carr; Domain location=187-275::286-378::392-481
MDDGSQGFFYQPDQAYEVEANDNDENLGGDDIDMHSHPNYPDFFHFIQDEGVLSHGEAVLGNLSELGDTPEIDLGAILERYDNVTPLSNEARHDLYILDHIVAEVLVVLPRQGQGEPKEGEIGEEVRCEVAVLAPPTKNMGEGGGRGHVESRETTTMEGVGFEGDGGTVGSREIKSAASSKRSMQWPPPRLTGTGLFTGVTAALYPVSVVKTRLQVASKDTLERSAFSVVKGLLKTDGIPGLYKGFGTVIIGAIPTRIIFLTALETTKVASFRVVEPFRLSETTQAAIANGIAGMASSFLSQTLFVPIDVVSQKLMVQGLSGHAQYSGGLDVARKVLRSDGIRGLYRGFGLSVMTYVPSNVVWWASYGSSQRYLWRFLGDNSEEYTPSLPKIIFAQATGGIIAGATASCITNPLDTIKTRLQVLGLEKKIPVKQVVKDLIAEDGWKGVYRGLGPRLFSTSAWGTSMILAYEYLSKNLLSDFIVLIILFVYTGLAVDSLKLSMTEISSEVFTRDGRFLKPQF

SEQ ID NO: 182768 - protein, 50 aa, Glycine max
  Coding DNA Sequence Number=SeqID_91083
MTPTQLGDPPRVSPVQQYDTFVEPDVHQQPVAATTHDESNIHVHRPRHAV

SEQ ID NO: 182769 - protein, 307 aa, Glycine max
  Coding DNA Sequence Number=SeqID_91084
  Gene Ontology: Mol. function=oxidoreductase activity; Cellular component=cytoplasm; Biological process=flavonoid biosynthetic process
  Homolog annotation: Hit_ID=A7QVT7; Match level="QueryCoverage=94%, HitCoverage=92%, E-value=4e-72, Identity=44%"; Hit description =Chromosome chr7 scaffold_192, whole genome shotgun sequence
  Pfam annotation: Domain name=2OG-FeII_Oxy; Domain location=162-262; Score=141.8; E_value=2e-39; Accession=PF03171.11; Description=2OG -Fe(II) oxygenase superfamily
METLDQMLVSSWYNVHSSVPPSFVQLPENRPGRVVSSLHKAIPVIDFGGHDLGDTTKQVLEASEEYGFFQVINHGVSKDLMDETMNIFKEFHAMPPKEKDSLTHPCPPSGEYMEYWPQKPSKYRDVVGKYTRELKKLALKILELLCEGLGLNLGYFCGGLSENPSVLVHHYPPCPDPSLTLGLAKHRDPTIITILLQDKEVQGLQVLKDGEWIGVEPIPNAFVVNIGLLLQIITNGRLVGAEHRAVTNSSSARTSVAYFVYPSFESIIEPAQALINESTPAIYKSMTFGEFRRNFFQKGPKIEEELQ

SEQ ID NO: 182770 - protein, 121 aa, Glycine max
  Coding DNA Sequence Number=SeqID_91085
MKGCREGEAATGGRGAAVVSVPSKKGCCRGLRERRKEAFGLGNERCKIQLGSVGLKSQEEGFFFAFLLLLRGKFLLRVSASSTIVAGDGGNRYQEVARLFTDHLIRKPLMDQVDPEEAYRS

SEQ ID NO: 182771 - protein, 157 aa, Glycine max
  Coding DNA Sequence Number=SeqID_91086
YGGLDDDVNLSRSGSFDTGYGGLDDATSGLSKPVSLSHYCCSGQSRYVMQYNEFRQELKRCRWHKALTRQSDNHIDVGQCKVRSKLIKFDATTLNEFLETLVVLEPGERYSTYSRFCHTHLDPHELTSKLCIPGRGFMLNAEGAPWKLLRKDLTTLA

SEQ ID NO: 182772 - protein, 278 aa, Glycine max
  Coding DNA Sequence Number=SeqID_91087
MKLWVLPPSTRTTTEWPTIVSIKRSIFGANWPVKELKLIRDETGSWISGGSRPGPRSRRVIISSGDRRFKVGGGRGGGEREIGGGSNAGEGAGRGYGTSKIGGARLRKGGRVSKSFSSWRRASPVACTKVRGCNTCTSRRMSGLEEGAGGVVVVGRREAGLECLDESGPRSKLAIVGHPLEPREGIRKKVGMGGVAAEDEKEDGGRRSIRASNFWAIVWTVSPREAWRSVSLRMAASRLLEELAVEGGSDMVTRAPNDRNKLVMDFEDQSLLEKKERN

SEQ ID NO: 182773 - protein, 55 aa, Glycine max
  Coding DNA Sequence Number=SeqID_91088
MINANCPQESLHPISNGNLRRNTRIPFQYSCMEWRVSKAQWKLASQQIACLTKYD

SEQ ID NO: 182774 - protein, 77 aa, Glycine max
  Coding DNA Sequence Number=SeqID_91089
MEVTITSYVYGKGYCAHAPAVDMCPIYWFFGHFYITLTGLLVVIVECLMVLYLLRFFALFFMQVVPEAIFCPFEIDV

SEQ ID NO: 182775 - protein, 359 aa, Glycine max
  Coding DNA Sequence Number=SeqID_91090
  Gene Ontology: Mol. function=DNA binding; Cellular component=nucleus; Biological process=regulation of transcription
  Homolog annotation: Hit_ID=A7PMY9; Match level="QueryCoverage=95%, HitCoverage=99%, E-value=2e-94, Identity=53%"; Hit description =Chromosome chr14 scaffold_21, whole genome shotgun sequence
  Pfam annotation: Domain name=NAM; Domain location=18-144; Score =317.2; E_value=3e-92; Accession=PF02365.6; Description=No apical meristem (NAM) protein
MENNNYQREIMEEQRFELPPGFRFHPTDEELITHYLSQKVLDSCFCARAIGEADLNKCEPWDLPCMAKMGEKEWYFFCVRDRKYPTGQRTNRATGAGYWKATGKDREIYKAKTLIGMKKTLVFYKGRAPSGEKSNWVMHEYRLENEHSVQNPPKKAMNDWAICRIFQKSNCGKKMPISRLLRFSTFAKDIPSLMDSSPNNNNNSESKPVLGESSHATCFSDPNQSEDKKTENENIAESYEIIMLASSYSSNPSDVSPDSWTFSKSAPTVSHQSLQVGNSHCSDYFMLHQEQSMLGMLIENHGSSTGQRTQKAQDNNKDFDADMSSVMYNNNEMFQRSFGNQEYSSPSVGHVYSSGLWGF

SEQ ID NO: 182776 - protein, 105 aa, Glycine max
  Coding DNA Sequence Number=SeqID_91091
MASSSHINIKSGPIDTDVLWMQPKHVSEHVWNGEKDRKLHIRRVVPTWLRERAAMVAQGAMVVVRASDRGGSRGFHGCEGATLVARGTAVVALGSGVVVVARERD

SEQ ID NO: 182777 - protein, 88 aa, Glycine max
  Coding DNA Sequence Number=SeqID_91092
MILSWQQEIESKNLLRGGGGARGVGTVLKGWVNEHENFAAQPRTGIPVAVKTLNPNGFLKECLRKSSLHNLKISRKHQINIIPKHKKI

SEQ ID NO: 182778 - protein, 42 aa, Glycine max
  Coding DNA Sequence Number=SeqID_91093
MDIEEDLRSPTDFGSSLHANRQLYGGYGEREALTKAKIAPDP

SEQ ID NO: 182779 - protein, 138 aa, Glycine max
  Coding DNA Sequence Number=SeqID_91094
  Homolog annotation: Hit_ID=Q2A9I2; Match level="QueryCoverage=74%, HitCoverage=62%, E-value=3e-08, Identity=31%"; Hit description=GRF zinc finger containing protein
  Pfam annotation: Domain name=zf-GRF; Domain location=16-62; Score =31.0; E_value=4.4e-06; Accession=PF06839.3; Description=GRF zinc finger
MERSSSSYTFEARSHVLCLCNVEAPLVTSWTEDNPGMRFYRCGLYKVTGRKGYNYFEWHDLVANIRQKKIIVALMKKVDELKLREKDLQSRIRDMKMKEKILGIVLVVSWIVIVELLNWYSVKVVECFVYPSLQVHQL

SEQ ID NO: 182780 - protein, 97 aa, Glycine max
  Coding DNA Sequence Number=SeqID_91095
MDDFNEDEDQQFFDHINHQSDDQSDDQSDDDEGVGRPTTPSSPPLQYHQPRCPVDFNFDHLPHYIDRHHFVQKQHNVQPPTSALEVGMTFDEKAQYI

SEQ ID NO: 182781 - protein, 121 aa, Glycine max
  Coding DNA Sequence Number=SeqID_91096
  Homolog annotation: Hit_ID=A6FJQ2; Match level="QueryCoverage=31%, HitCoverage=84%, E-value=3e-11, Identity=92%"; Hit description=50S ribosomal protein L5
  Subcellular localization annotation: CTP_CleavageSite=32; ConfidenceScore=5.04e-01
MTVKTSDTSSSRRRSQLVCKRMPRADKPVRARQRMRKEKIPHQAPFAIQAAQLLGRAIGAGLFAITPAGERGMCCKAIKLGVRVCNGAGGGINGGCNNIGDDSGSHMHSGGGGDNHKLGGE

SEQ ID NO: 182782 - protein, 160 aa, Glycine max
  Coding DNA Sequence Number=SeqID_91097
MEEKMKTGLSDAKIKILKTHKAGFKRPCGRSPLLGIQKYNDKSIVWPIVLQPDQSLWNYKPADSDFYCQDMAMGSASIHLVNWFIPTRRYCTCSFGCGKRLSMSTPYTTKGHSAIMLCSSSTVFGSKLFSKKSQNSVIHSRPTGVRLDTTLLRLGSKIIS

SEQ ID NO: 182783 - protein, 260 aa, Glycine max
  Coding DNA Sequence Number=SeqID_91098
MTFLDPARDNFTVAQDSDLNVRKPVEHSSDAKLAGESDPLGELMKILFYVYQNPMEVLWEASQFGLPDIGAKFYIRHADLVEIISGDKCLNIAILQLWTIFMNECDRSKADQSLYGLLEPQSIQNAKERRQQFKQYIETWVKESQRQLYLGAYLHQAHWQLFVLHPRENTVVWFCSLRKKPDINMKGAINSKNGCHIYAIFLTSAMKTITSSFEGMSNQGAPRWVEPKSNVQSGGFECGYYVMHWMWCIVTADLKDDWHK

SEQ ID NO: 182784 - protein, 175 aa, Glycine max
  Coding DNA Sequence Number=SeqID_91099
  Gene Ontology: Mol. function=oxidoreductase activity; Biological process=electron transport
  Homolog annotation: Hit_ID=Q9LXP4; Match level="QueryCoverage=80%, HitCoverage=44%, E-value=1e-43, Identity=54%"; Hit description =Putative uncharacterized protein F26G5_140
  Pfam annotation: Domain name=Pyr_redox; Domain location=36-100; Score= -4.8; E_value=0.013; Accession=PF00070.18; Description=Pyridine nucleotide-disulphide oxidor
MNLIWPKQNWMTVFASLLYQLFASNVNEIGVWSLQGGPTGVELAGARLTLVHKGARLLEFVGAKAEDKTLNWLKSKNVVKIYQTSNGGTIEADCHFLCIGKPLASAWLKETVLKNDLDGQGRIKVDERLRVKGRNNIFAIGDVTDIPEIKQGFLAQQQLEVVVKNLNVTIEGGRE

SEQ ID NO: 182785 - protein, 119 aa, Glycine max
  Coding DNA Sequence Number=SeqID_91100
MELRVPVEVEVSLFDSACSPSSTYAGHVPLSHGLFGDFMRSLYLCFDDVPLKLTKRLLLGICFSSWPVEGRAYYFCHFSSSFERKLQHGRHAKVIEVHVQSDPAGRLVISGEPEHPNNP

SEQ ID NO: 182786 - protein, 94 aa, Glycine max
  Coding DNA Sequence Number=SeqID_91101
  Homolog annotation: Hit_ID=A3A002; Match level="QueryCoverage=75%, HitCoverage=20%, E-value=2e-10, Identity=43%"; Hit description =Putative uncharacterized protein
METLIREEEGLLVGEEGADLVNVGTYCITKFDPTHNHEVVTPKVFMLKSHRKVTTTQAATIEQVEKSGIRPKAGYEMMDNEVGEHKNLGFLPED

SEQ ID NO: 182787 - protein, 138 aa, Glycine max
  Coding DNA Sequence Number=SeqID_91102
  Homolog annotation: Hit_ID=A5AUB4; Match level="QueryCoverage=61%, HitCoverage=8%, E-value=1e-07, Identity=37%"; Hit description =Putative uncharacterized protein
MDDFSEDEDQHFFDHINHQSDDQSDGEGVCRPTKPPSPSLQYHQARCPVDLNFDHLPHNIDRHHFVHQQHNVQPPIGELEKRISFVCKLHENGCTWSLGACNSKRHNKWIIKSIRGHHTCLMPMLKQDYHQLNKHVIA

SEQ ID NO: 182788 - protein, 93 aa, Glycine max
  Coding DNA Sequence Number=SeqID_91103
MNLQAICRSFLPDRCRPFGGHHDLRNQISSHQQWCPQKSNTSPSKNSRSRYLGSRICLEEKRDEYRRRCSSDENNVDDDNEGGIGVGGAPVAP

SEQ ID NO: 182789 - protein, 178 aa, Glycine max
  Coding DNA Sequence Number=SeqID_91104
LSSQGVPFEGTIVDDWKFDFSSHDARRMVCTDQAEMIGRLLAGSLTFECRIMHYLIVRILLPRSSNLAQLITLFLRHFNVPLASEPFIQVKRSFSIGAGAITSFGYCKELDASWVKKDAPPLQMSIHLFLHDLRGFRAHVDDHLDGIDTHFEALDLRIDQLADDMNVIRRCFDPPTDP

SEQ ID NO: 182790 - protein, 107 aa, Glycine max
  Coding DNA Sequence Number=SeqID_91105
MESWKLGRALEGCKEFEGFVHVNLGKQEELGVGEEVFGDGEGENPWGCERNLMVATTVEATMTIAMGKMRNVVVSTTTMTVATIIIVVVTNVVGASIEYAEDMCVKV

SEQ ID NO: 182791 - protein, 63 aa, Glycine max
  Coding DNA Sequence Number=SeqID_91106
  Subcellular localization annotation: CTP_CleavageSite=40; ConfidenceScore=5.22e-01
MVLSSTYSPPNSTPPPWKTTFKLEELDSSLSTPPRLSACACSSGLACENAYNEAQRRPKEKIH

SEQ ID NO: 182792 - protein, 154 aa, Glycine max
  Coding DNA Sequence Number=SeqID_91107
MEDKSNPVKDMLGGTFPDKCFLGRYRIESLVSRPKEGGIFPSKLQFTTANSDKALQFPKLEERQVVTMNIQQQELSHVPNTCGMDPLKFEPRTLNLVHFNVQGFNVNRVQWKVTRLSTGFKEMRMLKGSIEGLSAVYRVQRKENVEGHKYVYAV

SEQ ID NO: 182793 - protein, 130 aa, Glycine max
  Coding DNA Sequence Number=SeqID_91108
  Gene Ontology: Mol. function=sugar:hydrogen symporter activity; Cellular component=integral to membrane; Biological process =carbohydrate transport
  Homolog annotation: Hit_ID=Q8LBI9; Match level="QueryCoverage=90%, HitCoverage=19%, E-value=4e-26, Identity=52%"; Hit description=Sugar transporter ERD6-like 16
MEPVLVYVAEIAPKNLQGRLATTNQLFIVTGRSVSFLLGNAINWRELPLASKHIITFGYVERYNNWLDLNLGLVPCIFLLVGLCFIPESPIWLAEVSHKKEFQLALSRLQGKDVDISDEAAKILELSKLS

SEQ ID NO: 182794 - protein, 470 aa, Glycine max
  Coding DNA Sequence Number=SeqID_91109
  Gene Ontology: Mol. function=amylo-alpha-1,6-glucosidase activity; Cellular component=membrane; Biological process=carbohydrate metabolic process
  Homolog annotation: Hit_ID=A2Q3S2; Match level="QueryCoverage=100%, HitCoverage=50%, E-value=1e-155, Identity=59%"; Hit description =Putative uncharacterized protein
MILSALLTSVGINLGLCFLFFTLYSILRKQPGNITVYAPRLVVEGKVKEGGHFNLERLLPNAGWVRQAWQPSEEDFLSNSGLDAFVFMRIFIFSLKVFSFGGIIGTFILLPINYMGSQLSDDSDFQHKSLDSFSISNVNNGSNRLWVHFSAAYIFTGIVCYLLYYEYLYLSSKRITYFYSSKPQPQQFTLLVRGIPVLPGSTCHDTVERFFQEYHPSTYLSHSVVRRTNKLQSLVSCRLKAILDSLYNNLSFEVERFLEKNDADKLYKKLTHLKQKNDAPERQRRDGCLGLFGRKVDTLDHYERSLGDIEDNVRMEQSSLEAKIWIMKSCVVLMDILSYNRYYLLIVRFTMGLMVMSNTSTYSVITFNLKELQAAFVSFKTRFGAAIALHIQESVNPTEWITEKAPEPHDVYWPFFTVSFIKRWISKLVVYVACAFITVLFLIPVAIVQGLTHLDQLEMWFPFLKGILRL

SEQ ID NO: 182795 - protein, 31 aa, Glycine max
  Coding DNA Sequence Number=SeqID_91110
MNQWIFESFYSRLISTSNSGFNHAVLDPGSG

SEQ ID NO: 182796 - protein, 191 aa, Glycine max
  Coding DNA Sequence Number=SeqID_91111
  Gene Ontology: Mol. function=serine-type endopeptidase activity; Cellular component=mitochondrion; Biological process=proteolysis
  Homolog annotation: Hit_ID=Q9XKK8; Match level="QueryCoverage=30%, HitCoverage=26%, E-value=4e-20, Identity=84%"; Hit description=LON protease homologue
  Pfam annotation: Domain name=Lon_C; Domain location=103-191; Score= -128.4; E_value=0.0003; Accession=PF05362.4; Description=Lon protease (S16) C-terminal proteolytic domain
MRLATVVAVQFTAGEAGGEVEEEDEAREAKAENQVDEAADTVDYQPENHCRRLHSAVARRIQLRQSSEAVPLARERKIGAGGSFRLLENVAAFYEKACGIFNSAYIPPPRFDGREAAEHVATPGVTVGLVWAAFGGEVQFVEATAIVEKGELHLTGQLGDIKESAYPVRDQSGKVSAAELVQAVNEILSAA

SEQ ID NO: 182797 - protein, 78 aa, Glycine max
  Coding DNA Sequence Number=SeqID_91112
  Subcellular localization annotation: CTP_CleavageSite=44; ConfidenceScore=5.09e-01
MGSCYVHPALLLGHPANSEVAKLPFNNSSSGRSISGNLPEKLVPKSLRKYFFRKKNLGIPEVLTNFVRKIVIRKFPEE

SEQ ID NO: 182798 - protein, 731 aa, Glycine max
  Coding DNA Sequence Number=SeqID_91113
  Gene Ontology: Mol. function=ubiquitin-protein ligase activity; Cellular component=ubiquitin ligase complex; Biological process =protein ubiquitination
  Homolog annotation: Hit_ID=A7PN20; Match level="QueryCoverage=94%, HitCoverage=72%, E-value=0.0, Identity=82%"; Hit description =Chromosome chr14 scaffold_21, whole genome shotgun sequence
  Pfam annotation: Domain name=U-box; Domain location=634-708; Score =156.3; E_value=8.3e-44; Accession=PF04564.6; Description=U-box domain
QQCFSDASTRRPADLLSSFSTIKTVMNNLYDGLAEVLLILLKSQDTRESVLEYLAEAININASRAHIQVDPITCASSGMFVNLSAVMLRLCEPFLDANLTKRDKIDAKYVHCSNRLKLSGLTALHASSEEVTEWLNSKNPATTGATNQYSDDQKRLQQSQEASSSGSNNFGELSNENSARAEKTKYSFICECFFMTARVLNLGLLKAFSDFKHLVQDISRCEDALATLKAMQERTPTPQAELDINRLEKEMELYSQEKLCYEAQILRMPLPPTCPMEFATMPEHFVEDAMELLIFASRIPKALDGVVLEEFMNFIIMFMASPEFIKNPYLRAKMVEVLNCWMPRRSGSTATATLFEGHQLSLEYLVRNLLKLYVDIEFTGSHTQFYDKFNIRHNIAELLEYLWQVPSHRNAWRQIAKEEEKGVYLNFLNFLINDSIYLLDESLNKILELKELEAEMSNTVEWERRPVQERQERTRLFHSQENIIRIDMKLANEDVSMLAFTSEQITAPFLLPEMVERVASMLNYFLLQLVGPQRKSLSLKDPEKYEFRPKHLLKQIVHIYVHLARGDTNSIFPAAISKDGRSYNDQASFLFSAGADVLHRIGEDGRIIQEFIQLGAKAKVAASEAMDAEATLGEIPDEFLDPIQYTLMKDPVILPSSRITVDRPVIQRHLLSDSTDPFNRSHLTADMLIPDDALKARIEEFVRSQEMKKHLSLQSTKATIQTTNGETMLVD

SEQ ID NO: 182799 - protein, 140 aa, Glycine max
  Coding DNA Sequence Number=SeqID_91114
  Gene Ontology: Mol. function=protein dimerization activity
  Homolog annotation: Hit_ID=Q6Y8E6; Match level="QueryCoverage=49%, HitCoverage=9%, E-value=3e-13, Identity=52%"; Hit description=Ac -like transposase THELMA13
MAIDMKTKFDKYWRDYSNVFSFGCILDSCFKIKFLKYCYSKLGLDPISCQAKLKVVEYKLYNLYNEYIQMYSKETRNNVGLSQGSSQETIATTTNSVAQGNPPTSQVDVMDVSQGKEDEDVEMEKDQATLKMESFVVGDV

SEQ ID NO: 182800 - protein, 286 aa, Glycine max
  Coding DNA Sequence Number=SeqID_91115
  Gene Ontology: Mol. function=ATP-dependent helicase activity; Cellular component=cytoplasm; Biological process=mRNA transport
  Homolog annotation: Hit_ID=A7QJA1; Match level="QueryCoverage=80%, HitCoverage=45%, E-value=1e-76, Identity=64%"; Hit description =Chromosome chr8 scaffold_106, whole genome shotgun sequence
  Pfam annotation: Domain name=DEAD; Domain location=130-286; Score =105.3; E_value=1.9e-28; Accession=PF00270.20; Description=DEADDEAH box helicase
MAEPSSTAATAATAATASTADPPAPVTKSWADEADEETNNTSTAESESSSINLEALTIDDKENNSSKFLDDPDDSNIQAGFELNIIRVLNCVQVTSGDTPYTSAARFEDLSLSPELLKGLYVEMKFEKPSKIQAISLPMILSPPHRDLIAQAHNGSGKTTCFVLGMLSRVDPKVQAPQALCVCPTRELAIQNVEVLRRMGKYTGIASECLVRLDRDAVHVSKRAPIMAQVVIGTPGTIKKFISFKKLGTSRLKILVFDEADQMLAQDGGRPKFRHINTSLQPMAQP

SEQ ID NO: 182801 - protein, 62 aa, Glycine max
  Coding DNA Sequence Number=SeqID_91116
MESSVTLVEDVSHAKGEKISVMLAGDGSRIVCMNFTLVAHVDDVMVIDDGRQWPKICSDNKA

SEQ ID NO: 182802 - protein, 363 aa, Glycine max
  Coding DNA Sequence Number=SeqID_91117
  Homolog annotation: Hit_ID=A9P8I0; Match level="QueryCoverage=67%, HitCoverage=99%, E-value=1e-124, Identity=81%"; Hit description =Putative uncharacterized protein
MILTKQYRCVHSASCQCTKGHVSEDVIFLVFQHLNWNPKLIAALSCVCKWFDDLSKQVLWKEFCKTRAPKMMLDLQSSGSHSVDGNWRALGKLLIFCSGCRQGGLFNNVQVPGHFVNKTRFSRTSGKSFLMPQCINDVLYVSDPCEHIGQSEEGDLGFFRGIFKSFASSNVKRMLINRGAQLHQTEICPYCKAKLWSMLQANMIPQTASCRLGSYEDYIEYYVCLNGHLLGVCTLLPLSDSEDVSEECRIFFGSLAKVRFDEGEGSGVQYCGGHRQHTRYAFLLLVHSGVRLIVTTTTRQMPVEENARGRSIAKHHNNTTTTPPTMVKKQPTPPTTTVHSRPWNGTKEVWSRQKEEETTQKKK

SEQ ID NO: 182803 - protein, 238 aa, Glycine max
  Coding DNA Sequence Number=SeqID_91118
  Gene Ontology: Mol. function=nucleoside-triphosphatase activity; Cellular component=cytoplasm; Biological process=protein metabolic process
  Homolog annotation: Hit_ID=A5AYX7; Match level="QueryCoverage=76%, HitCoverage=23%, E-value=4e-90, Identity=92%"; Hit description =Putative uncharacterized protein
  Pfam annotation: Domain name=AAA; Domain location=35-218; Score=0.5; E_value=1.7e-05; Accession=PF00004.20; Description=ATPase family associated with various cellular activities (AAA)
MATNCWMMQHSYCGHGSEIWRQQHTLTNGPLILEKLCLTNRLAQRIVQGDVPQALMNRRLISLDMGALIAGAKYRGEFEDRLKAVLKEVTESDGQTILFIDEIHTVVGAGASNGAMDAGNLLKPMLGRGELRCIGATTLDEYRKYIEKDPALERRFQQVYVDQPSVEDTISILRGLRERYELHHGVRISDSALVDAAILSDRYISGRFLPDKGINTVILAFFLHAVDSLWIIYRIDDC

SEQ ID NO: 182804 - protein, 114 aa, Glycine max
  Coding DNA Sequence Number=SeqID_91119
  Gene Ontology: Cellular component=plasma membrane; Biological process= protein modification process
  Homolog annotation: Hit_ID=A9PJS8; Match level="QueryCoverage=86%, HitCoverage=84%, E-value=4e-41, Identity=80%"; Hit description =Putative uncharacterized protein
MAGNQDQLEIKFLLSDGTDIGPKSYAAATSIATLKESVLAQWPKDKEYGPRTVKDLKLISAGKILENNRTVGECQSPLCDLPGGVITMHVVVQPPSVEKGMPKVCFTCIYSFKI

SEQ ID NO: 182805 - protein, 60 aa, Glycine max
  Coding DNA Sequence Number=SeqID_91120
  Subcellular localization annotation: CTP_CleavageSite=35; ConfidenceScore=5.23e-01
MGFFAFSKTHLRKLLFSSTVSNSNPSGKVGPENDVAEAIAGNRKRRGFSGEVVGVVEKVV

SEQ ID NO: 182806 - protein, 173 aa, Glycine max
  Coding DNA Sequence Number=SeqID_91121
  Gene Ontology: Mol. function=transferase activity, transferring glycosyl groups; Cellular component=cytoplasm; Biological process =metabolic process
  Homolog annotation: Hit_ID=A4F1R6; Match level="QueryCoverage=75%, HitCoverage=26%, E-value=5e-60, Identity=83%"; Hit description =Putative glycosyltransferase
MSFTIQVAEELSLPIVLFQPASACSLLSGLHFRAIFDKGLIQLKADLVMGGSVILSSEFVNETSDRGLIASWRPQEQVLNQTSIGGFLTHCGWNSTIESICAGVPMLCWPFYVDQPTNCIYICNEWNIGVEIDTDVKREEVEKLVNELMVGEKGKKMRQKVTELKKKAGQDTI

SEQ ID NO: 182807 - protein, 487 aa, Glycine max
  Coding DNA Sequence Number=SeqID_91122
  Gene Ontology: Mol. function=nucleic acid binding
  Homolog annotation: Hit_ID=A7PN40; Match level="QueryCoverage=96%, HitCoverage=94%, E-value=5e-88, Identity=42%"; Hit description =Chromosome chr14 scaffold_21, whole genome shotgun sequence
  Pfam annotation: Domain name=TPX2; Domain location=393-449; Score =81.0; E_value=3.9e-21; Accession=PF06886.2; Description=Targeting protein for Xklp2 (TPX2)
  Subcellular localization annotation: CTP_CleavageSite=70; ConfidenceScore=5.78e-01
MALASTNTDQSTITTPSKKPSKNSENLNPNVPHHRSPSSKSPALRSSKPNNSNPIAQSPQNRIRQRKFVVAKKKNQKGTQNDAVSCKCKHNGGAKCVCVAFQTLRASQEEFFLKEKKDCDYDFEEEREEEAKAVNAIEIYGTKSETVQGEEEKEEGGSTVKRRRERDRLLEEARNSVPENGFGRVMHLVKAFEKLLTIPKSSKEKDHKEEHDHEHEEQKNKSQVMKWALPGLQFQQHPKPKTLEATTDDASVSGSSSFCCTSDLVLTSKNLGIGQGISVSSSWDCNRASVSSRTSGGRRSRRNSSESSGTFGGRRWKQKEKLKVTRQKPFKLRTEQRGKLKEEEFVKKVQEMMTEEEKMRIPIAQGLPWTTDEPECLLKPTVKESTRPIDLKLHSDIRAIDRAEFDQQVAEKMNFIEQLKLEKERQQKLEEEEEIRRLRKELIPKAQPMPYFDRPFVPRRSMKHPTIPREPKFHMPQHKKIKCLVME

SEQ ID NO: 182808 - protein, 222 aa, Glycine max
  Coding DNA Sequence Number=SeqID_91123
MACVPDKIKSIDGSRETLKLTVRIADLWFIGIPDKSEQGEMVIVDSNGDEIHVVCKQDQLKFWKADLKENSTYVMQSDLDHLPFKKFKFVDFSTVVVAGDFQTGLLVDIIGVVDEVVFREHRLRQRALSPLRLLPFAAAADKGKAAFRPLVVVGGLHRRKAVSHKSGIYVGLLDEADLRPVSERPLGTASCHPSSVVSSCARLLLSLSIVWSKLVHSTLSIP

SEQ ID NO: 182809 - protein, 66 aa, Glycine max
  Coding DNA Sequence Number=SeqID_91124
MQDTLYLENIEERETGGTPPLIQTARAWDLFLTLMHCKVSDNPQPKIKEVKEKMKGKVNTSSIPGN

SEQ ID NO: 182810 - protein, 157 aa, Glycine max
  Coding DNA Sequence Number=SeqID_91125
  Gene Ontology: Mol. function=binding
  Homolog annotation: Hit_ID=A7PN44; Match level="QueryCoverage=71%, HitCoverage=6%, E-value=2e-47, Identity=82%"; Hit description =Chromosome chr14 scaffold_21, whole genome shotgun sequence
MLRGMPNNQLLVTVIKRNLSLDFLPQSAKAVGVNPVSLAIVRKRCELMCKCLLEKMLQVDEMNNDGVEVGALPYVLVLHAFCLVDPTLCAPASNPSQFVVTLQPYLKSQALNQDRTGDMSGLGKGHFSRAGLESNHLLLHTLQSSACCQIVECKPSF

SEQ ID NO: 182811 - protein, 347 aa, Glycine max
  Coding DNA Sequence Number=SeqID_91126
MGDFICRPLMKQIEHVGGVMLLSTAPVIGEEGQPPAEKSRAPSSILALRKVAGLTSGVGRPSSVQDVPLTPSVIEAPAANVVIVITLDPPPRHGNRTGRGRRGGFGGGFGSGINNLIPNLEPNFGYRGKPEPNLDPGQLGFSLSESRWEVDLITAEESVPAALASSVVASSSTTVAPLLSVGVVTTNALVVPPLSPSTPMVPPSTALASTSASSQPCVSLYHIYTSNNVDSLWGIGVLAKLLHNRLDGDELQEEKKNLVGRMEDVAAEKDEPSKKGFNKAVRQVGFFAKELSLGLFNPFKDVKDDVLLDEDDIVVKEEAVVRSRLLGPNFCCQFQTYNERLILHLIV

SEQ ID NO: 182812 - protein, 125 aa, Glycine max
  Coding DNA Sequence Number=SeqID_91127
MPRSRPSSSCWTSLNEELEQLLATVPKLTIEEHGEWRKMTNMMQNVVVPLETIFQTIHARDQIFGEVSKVYAVRTFQAACIIFLKTKAELICTWKTLQNAGLRSIIGGRHLKLELDGNISAKPCP

SEQ ID NO: 182813 - protein, 160 aa, Glycine max
  Coding DNA Sequence Number=SeqID_91128
MIAETEPFGSDENGEEEEEKGVVEICVPNRGSTHNRKGEANVEEKDTATGWLCVGPVTGGWEGVGEECVVLVNGKVESCHGKGRQRGFYCWWRQYEDGLVTLGSKGDIGGDFAKAGDGEGCLFGSNGSLGCSNESLDCNEFGHGGLKTIHTSGVKFSVRH

SEQ ID NO: 182814 - protein, 452 aa, Glycine max
  Coding DNA Sequence Number=SeqID_91129
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=99%, HitCoverage=99%, E-value=1e-163, Identity=60%"; Hit description=UDP -glucosyltransferase HRA25
  Pfam annotation: Domain name=UDPGT; Domain location=4-451; Score= -73.0; E_value=6.3e-07; Accession=PF00201.9; Description=UDP -glucoronosyl and UDP-glucosyl transferase
MNIPNVLIVPYPVQGHVNPLMNFSQKLVEHGCKITFVNTDFTHKRVMNSMAKQESHDESPMKLVSIPDGLGPDDDRSDVGELSVSILSTMPAMLERLIEDIHLNGGNKITCIVADVIMGWALEVGSKLGIKGVLFWTASATMFALQYNIPTLIQDGIIDSDGFPITQRTFQISPSMPTMDTGVIWWSKVYDRETEKKVFNYVVHCTQNSNLAEWFICNTTYELEPKALSFVPKLLPVGPLLRSYDNTNTNASSLGQFWEEDHSCLNWLNQQPHGSVLYVAFGSFTHFDQNQFNELALGLDLTSRPFLWVVREDNKLEYPNEFLGNRGKIVGWTPQLKVLNHPAIACFVSHCGWNSIMEGLSNGVPFLCWPYFTDQFYNKTYICDELKVGLGLNSDENGLVSRWEIKKKLDQLLSNEQIRARCLELKETGMNNIEEGGGSSKNISRFVNWLKS

SEQ ID NO: 182815 - protein, 288 aa, Glycine max
  Coding DNA Sequence Number=SeqID_91130
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=89%, HitCoverage=67%, E-value=1e-104, Identity=62%"; Hit description=UDP -glucosyltransferase HRA25
MDKHIINGVVLCPASTTLFTLLYSIPKFIYDGIIDSDFELTLTTGKRIRISPSMPEMDTEDFFWLNMGHPIIGKKVLKYLVHCTRSLHLTEWWLCNTTHELEPGTLSFVPKILPIGPLLRRHDDNTKSMGQFWEEDLSRMSWLDQQPPGFVAFGNIVGWAPQQKVLSHPAIACFATHCGWNSIMEGLSNGVLLLCWPYFADQLYNKTHICDELKVGLGFEKDKNGLVSREEFKMKVDQFFNDENIKSRFMELKEKVMNNIEKGVARCTQQFSIFPNCPYDFQVINTML

SEQ ID NO: 182816 - protein, 461 aa, Glycine max
  Coding DNA Sequence Number=SeqID_91131
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=97%, HitCoverage=99%, E-value=1e-177, Identity=66%"; Hit description=UDP -glucosyltransferase HRA25
  Pfam annotation: Domain name=UDPGT; Domain location=3-456; Score= -66.4; E_value=2.9e-07; Accession=PF00201.9; Description=UDP -glucoronosyl and UDP-glucosyl transferase
MIPTVLVLPYPAQGHINPMMRLSQKLVENGCKVIVVNTDYDHKRVVSSMGEQQHSLDESLLKFVSIPDGLGPDDDRNDMGKVGEAMMNIWPPMLEKLIEDIHLKGDNRISLIIAELCMGWALDVGTKFGIKGTLLWPASAALFALVYNLPKLIDDGIIDSDGGLTPTTKKTIHISQGMAEMDPETFFWFNMGDTVNRTTVLKYLMQCTQRLNLAEWWLCNTANELEDGPLSSIPKLVPIGPLLTSHDDTIATTKSIGQYWEEDLSCMSWLDQQPRDSVLYVAFGSFTHFDQNQFNELALGLDLTNRPFLWVVRQDNKRVYPNEFLGSKGKIVGWAPQQKVLSHPAVACFVTHCGWNSILEGLSNGVPFLCLPYVGDHIYNKTYICDELKVGLGFDSEKNGLVSRMELKRKVEHLLSDENMKSRSLELKEKVMNTIAEGGQSLENLNSFVKWVKELGSTFYA

SEQ ID NO: 182817 - protein, 42 aa, Glycine max
  Coding DNA Sequence Number=SeqID_91132
MKAMPSKPTRKGRKWANVFQEGGNDENPETGQIQAKGPSGEG

SEQ ID NO: 182818 - protein, 108 aa, Glycine max
  Coding DNA Sequence Number=SeqID_91133
MKRQQSADGKLDVLIHPTKLVAVGPGYNDFITGLSLIVHQNARLNVLQWKKVPQSTRDTIVQSILAKVGSYKNFHQRLEVTWKLLKLPSTTVFKIEKTSINRQKPPVL

SEQ ID NO: 182819 - protein, 319 aa, Glycine max
  Coding DNA Sequence Number=SeqID_91134
  Homolog annotation: Hit_ID=A5C6V8; Match level="QueryCoverage=65%, HitCoverage=60%, E-value=2e-26, Identity=43%"; Hit description =Putative uncharacterized protein
MAFLNYENKKGSGKKLKVHFDLPEDDDFPNHRHSSSSVSSESSLDSDDTDNDNSINNVDSKYGLYGSPVWSFQGGSVTQSPPVQFMNSPGYDPNRIPSSVFNKPTSPMEWSVASNESLFSIQLGNSSFSRDYAFAFNNKSGELPRTSDLPNMPATLPSVQEVPAKEKNVDMERQSVSSDSSSETADSIRGHDHDKTSHESAGSVVDLKKTENSEEIGTDEVVLDKYPDDHSKEAKIPNGEAKNYASVSYRSVESNMSTRSFQFPILTAEGGRTSSSTVESEKQEQQPEKPQQPPSPKTEKAPKKSGKSWCFCFSCSPCF

SEQ ID NO: 182820 - protein, 123 aa, Glycine max
  Coding DNA Sequence Number=SeqID_91135
MALASTRTSTPCGTKCKVVMVDVTDTQFDKFNTGLDNVVEAIGCGSVYALKQSNVAEKQGDIWELLEGMSSTNQPLMEQCYDYLCSNQSETQRLFSMPSHLQCNHLIKLMKDPTSLPSDSCVE

SEQ ID NO: 182821 - protein, 93 aa, Glycine max
  Coding DNA Sequence Number=SeqID_91136
MDTMGISPEVLAGAHGLSIFRQRDWRNHMHGYSVNHIGVTHVVACNGGHVCMGWGACMHAWVFLATAAGVTHMYAASGDGVTLWGVSPNAMAE

SEQ ID NO: 182822 - protein, 465 aa, Glycine max
  Coding DNA Sequence Number=SeqID_91137
  Gene Ontology: Mol. function=acyltransferase activity; Cellular component=cytoplasm; Biological process=alkaloid metabolic process
  Homolog annotation: Hit_ID=A7BID0; Match level="QueryCoverage=100%, HitCoverage=99%, E-value=1e-127, Identity=50%"; Hit description =Malonyl-CoA:isoflavone 7-O-glucoside-6''-O-malonyltransferase
  Pfam annotation: Domain name=Transferase; Domain location=5-461; Score=69.1; E_value=1.4e-17; Accession=PF02458.6; Description =Transferase family
MEKATRVKILEICLVSPPQEKTTTQTSLSLTFFELLWLRLPPVERLFFYEFPNQTISFFDTILPNLKHSLSLTLQHFLPFAGSIIWPLDSPHPIINYVPGNAVSLTIAESNTDFNMLCSNICDASLRHPLIPHLANSHEQASVMALQVTLFPNHGFSLGIATHHAAMDGKASTLFLKAWAYACSNNNNNLIGESFSSPLLSLPQHLTPFYDRSTIRDTSGIGADYLSAWLHYGGDNNSRSMKVLDQFGGGVNATTKEAIRWSFELTSSNIQKLKHHAQSKLKEENAHFSTFSVTCAYVLQCLVKADKPKANGVAFLFSVDCRSRLEPPLPSTYVGSCIIGHKVLYETKNLSGDDDFINALKGIKEALQKLENEVLSGATTLAEKVQMRMNNKIFTVGGSPRFEVYSIDFGWGRPKKVDVTSIGPTGGFFISESRNDSGGIEITLVLYKQEMESFMTHFAEGLESL

SEQ ID NO: 182823 - protein, 93 aa, Glycine max
  Coding DNA Sequence Number=SeqID_91138
  Gene Ontology: Mol. function=transcription regulator activity; Cellular component=cytoplasm; Biological process=regulation of transcription, DNA-dependent
  Homolog annotation: Hit_ID=Q9LN63; Match level="QueryCoverage=78%, HitCoverage=24%, E-value=3e-11, Identity=44%"; Hit description =Protein BRASSINAZOLE-RESISTANT 2
  Pfam annotation: Domain name=DUF822; Domain location=10-89; Score =20.6; E_value=4.1e-06; Accession=PF05687.4; Description=Plant protein of unknown function (DUF822)
MADDGATLTRMSQRKASWRDRENNKRRERRRRAIAAKIYSGLQAQGNFNLPKHHDNNKTLKALCTKAGWCVKEAWLRVDGGGTVEKEKKRMMY

SEQ ID NO: 182824 - protein, 33 aa, Glycine max
  Coding DNA Sequence Number=SeqID_91139
MEKGKKEKEKGGDTVVVIPVGEVEEDDMTMTCY

SEQ ID NO: 182825 - protein, 49 aa, Glycine max
  Coding DNA Sequence Number=SeqID_91140
MDKSLKVGEDEWRERERRGTNMPQMSPLIQDQVQYSPLSVLRCREAYKT

SEQ ID NO: 182826 - protein, 151 aa, Glycine max
  Coding DNA Sequence Number=SeqID_91141
  Homolog annotation: Hit_ID=Q6RSW7; Match level="QueryCoverage=32%, HitCoverage=2%, E-value=1e-07, Identity=55%"; Hit description =Polyprotein III
MEDIKILRTFLGLLNYARNFIKDLGKYTTPLYNKTSLTGQRKFNTEDIKYALGKYHTKPQEYNKMKPCKVSYQNIKQKMKFGNQELPITKEFLFLQKPLLLEKAIQLLSCYQDRIKVFIPISKTFASQRRVFKAQSIKVSIQGKKQKKPLN

SEQ ID NO: 182827 - protein, 330 aa, Glycine max
  Coding DNA Sequence Number=SeqID_91142
MAPRKLPTKRSIKDTAGDGSSAAPRADVEFDRHRERRVQLRDEEYVEFQEEIGWKQWAQLASPMAKFDPEIVMEFYANAWPTEEGVRDMHYWVRGQWVPFDGDAINQFLGHPLILEEGQQCEYSQRRSQALGFDEEAIDQLLCVPGQLRPSPTEVSTGLCHPDIGVTPPRHPVNPEKSNRALGFPTLITCLYQFYGVSVTPTKLIRPLINKAFIVKYCMPRQQQPAADAPPPPLQEEHSLRSISDHLRRLELQMHRYIHHVTSQQAANHRGQSQDPNPFPWPTPEEFEATVAWLEDETNFETQAGPAGALGGDGEDQKDDDMVDMLDFFT

SEQ ID NO: 182828 - protein, 139 aa, Glycine max
  Coding DNA Sequence Number=SeqID_91143
MVLEDKLKACQRSKRNLSKQLSKTEENMWAIIDQYKEKLSLVSTHEQRLEDEYAKVSVLQEEREARERVIDSLHREAMMWMNRFSFTLNESQELPRLLAKAKAMTDMYSAPEEVHGLLDYYQHMINLMAHIAKAFVLSI

SEQ ID NO: 182829 - protein, 79 aa, Glycine max
  Coding DNA Sequence Number=SeqID_91144
MDNSEGGGAGPGNYVRMTMVVVGLGEKVVHDGAESQTTGKRHSKFKPMQVGRIKPRSKPKQQKLITVADDLPIMNDIAN

SEQ ID NO: 182830 - protein, 109 aa, Glycine max
  Coding DNA Sequence Number=SeqID_91145
MSSPQDISLAVALGSATQIAMFVALAYLLSLPEMKNGGIDPNQKSDSNSRNAGKSTTIIRTIDVACFSMGNFLRRFTATTNAECFSMDNILRRFTITTDVKCWTFYDGY

SEQ ID NO: 182831 - protein, 108 aa, Glycine max
  Coding DNA Sequence Number=SeqID_91146
MFTNNFGANTEKNPKEECKVIFTRSQRRENAKREKRAEGVLEDVSNEERKNNKREKGDEEKEESKEKGEKVLPTKTKSQLARKARIEIPSVPVKDIPYPLVPSKKYKE

SEQ ID NO: 182832 - protein, 128 aa, Glycine max
  Coding DNA Sequence Number=SeqID_91147
MSSSSSIAGSSSTGSEGARIGVVSCGIRGAELDGAEGSGKEVEEGAEVSGAVEVGGTEDVGASDLLAWAFLGPLNVTVGSSRFQKFFFMYAMLMAGLRLSKDLESKVTPLALHKAVIKVGNPSLEESC

SEQ ID NO: 182833 - protein, 304 aa, Glycine max
  Coding DNA Sequence Number=SeqID_91148
MIGRLLAGSLALESRILHYLIVRILLPRSSNLAQVSEEDLIVMWAFDTDRQIDWAHLVRYRMHKALRFNAPLPYPHLFTLFLQHFNIPFDSEPYVPIKRSFLIGAVVVASFGYRKEHDGTWVKKGAQPNDDEGQLPVQEDSSLLQSILDRFDGLQTYVGERFDSLEHEVDTRFEEMNSRIAKVEEDVCHHQKGGDYGSKAFQVYFDDAKDSSQESRVKQVSRIKESFNRESRFKRRLKMYKNFKKSIKIRYILCGTSRAYIYLGCNTENKREYISCGSVQVECISTWLFKENKGGNQWLLGDWM

SEQ ID NO: 182834 - protein, 82 aa, Glycine max
  Coding DNA Sequence Number=SeqID_91149
DLLLVTVFKRRSSWLQTLNCGSNDFQGYFDDAKESRVKKSFKQRFENQASSFKIRDSRIKIQVSRSRFKTQDSRIKRRLDQD

SEQ ID NO: 182835 - protein, 180 aa, Glycine max
  Coding DNA Sequence Number=SeqID_91150
MHENVDHAIQATFEAQPPQPIGGAHEEPREHAQVNFDSYPPLTDEGSAFNAMPQPNTAGASQPHPMQPLHFSVGATPPTMEGNEKLDLIEERLRVVEGFGDYSFVDMTDLCLVPDVAILPKYKTSVSFDQDYCGLHFVIQRQSSPMACRDRHGHTLSLFQDYQSPLYHPKTSKFDGMWGQ

SEQ ID NO: 182836 - protein, 321 aa, Glycine max
  Coding DNA Sequence Number=SeqID_91151
  Gene Ontology: Mol. function=ubiquitin-protein ligase activity; Cellular component=mitochondrion; Biological process=regulation of G2/M transition of mitotic cell cycle
  Homolog annotation: Hit_ID=A7PKF0; Match level="QueryCoverage=85%, HitCoverage=31%, E-value=6e-90, Identity=63%"; Hit description =Chromosome chr15 scaffold_19, whole genome shotgun sequence
MKGCQNMRYIVVNCLAHGPCSRLCLALLDEDYTRLLLIGELASTVKELEESNHKLATLKAERDAAKGVLPLLNVGSTHIPSDKIKDKQKDLQDMESTLKELLDQGSARLMELKSLHEERIRILQQLCDLQNTLKNLKCITSSHAFQLVRDQIEKSKAEVLEYQALYEKLQVEKDNLAWREREWYIKNDLADVFQRSVAVSDFRVADLRFEIQKKIEERYVIENKLKEEARGPGRKQIIAEFKSLVSSFPDEMGSMQIQLRKYKESASDIHSLRADVKSVSSILDRKVKECDVFSVRSAGQLAEIKRLLGVVRIGPVPKFNN

SEQ ID NO: 182837 - protein, 136 aa, Glycine max
  Coding DNA Sequence Number=SeqID_91152
MSNDGSKVRKDAKISLNYQGTSLESQLPRRKPRRVPLDVGFQQRITAVCGGHRWFWVVEKKLGMLGRVLGKRKGKKWLLFHYHTKTKLATLKCFCSREKEHLSHSRSHIAYHNGQNVDSCPMNLLNKFRDDPTVNK

SEQ ID NO: 182838 - protein, 153 aa, Glycine max
  Coding DNA Sequence Number=SeqID_91153
MGHESCVPNLLQTRLTLLPLCGLEKVVVAGKDVEINKASSVSQNYTQLQLGIRAEFSWVVRCLRPPSLPPATIFSDEARVRCALKSATHPWKSRRHTLPQSRANFGACSPRAAIRSPDLFQQPRPLLLDTFQTSSLLFGKLHVPALAFPPLLC

SEQ ID NO: 182839 - protein, 143 aa, Glycine max
  Coding DNA Sequence Number=SeqID_91154
MMIWKQRAKLVMAIARRALKHPIYGIVILRSGIYTNRPIVSQLCSFISSMNSSILISDDVPKWKTPHDSGISKNTIDNNETSTNVTTQTIYSIQMINDGTYEFGDPTVMWLRMPPDSWDTVTKGGVVDKSRAFAPTYLRAVSA

SEQ ID NO: 182840 - protein, 36 aa, Glycine max
  Coding DNA Sequence Number=SeqID_91155
MATKMKQCPFEALGSIASIMSIPHIENGQGAAKTFK

SEQ ID NO: 182841 - protein, 129 aa, Glycine max
  Coding DNA Sequence Number=SeqID_91156
MSASSSRDCEKVLFAIRQTQGSDGKSDDMRIYLMVIRTFCQLAASEPIDTQRLTSSSAPFSSRDGKSDDMRRYLMVIRTFCQLEASEPIDTQRLASSSTPFLEMSASSGRDCKKVSFAIRQTQKSSSMQ

SEQ ID NO: 182842 - protein, 80 aa, Glycine max
  Coding DNA Sequence Number=SeqID_91157
MGSSQAPSLKKRFYQVKVKRLGTTSLKELGQLMGQLQQQAFRKAYGKIWDLAMAEVSIEAIASLAQYYDQPLRCFTFGDF

SEQ ID NO: 182843 - protein, 224 aa, Glycine max
  Coding DNA Sequence Number=SeqID_91158
LKVDILPFIVDYKEDYPWHKYIVSLRYGALANDLFFFEKSMFAFIVERPGGSFDPAHQPLFHSPMNCVFVHVSSTFEFGAMLSDCLMQFSILNLFRSPMNCIFVHVSSTFEFGAMRKFGAMRSDCLVQFSILNLFRSPMNCVFVHVSSTFEFRAMRCDCLVQFSILNLFRSPMNCVFVHVSSTFEFGAMRSDCLVQFSILNLFRSPMNCVFVHVPSTFEFGAMR

SEQ ID NO: 182844 - protein, 104 aa, Glycine max
  Coding DNA Sequence Number=SeqID_91159
MHETSRFSSPGDNIEHRNVFRSPTGNLVPLDLEIEATLRRNRAERRRKLLQDRTIASILEEEAQSSNSTSFDSLSSRESTIYLPEASVMADEHQQRVTLEDYSS

SEQ ID NO: 182845 - protein, 111 aa, Glycine max
  Coding DNA Sequence Number=SeqID_91160
APPPHQAGPLGLFDTEQYLRHLVRQQAANHRAHVQTHDCIYQMSLSLQSQDFTSFPCPTPDQFRAEVAWPGDWPEARAGEAPVEALDEADEAREDEEMTDLLDFLGGSGAT

SEQ ID NO: 182846 - protein, 119 aa, Glycine max
  Coding DNA Sequence Number=SeqID_91161
MPLRGRIVSLGHIIGRGVGRGDCDDSDDAPKRRRPTASARRQRVPMIVAQDEPMVPAPDVEADVFPVDPMALADVEDTRADIPADTGTQVAEDEHEGFPGGPSDPSVLTQYADHVACSV

SEQ ID NO: 182847 - protein, 141 aa, Glycine max
  Coding DNA Sequence Number=SeqID_91162
MVARVMLGNGYEPRMGLGKNNGSRTSLEEQRPRLQLGRQVEGIPPCHISRSFISVGLGHEGQVVAICEDDSPSGSDDESLEGTNTWDPTIDFKQEAGQTESEEDEDVGLPPELEKIDAQEDREMGPHQEETELVDLGTGNG

SEQ ID NO: 182848 - protein, 44 aa, Glycine max
  Coding DNA Sequence Number=SeqID_91163
  Gene Ontology: Biological process=auxin mediated signaling pathway
  Homolog annotation: Hit_ID=P33081; Match level="QueryCoverage=81%, HitCoverage=43%, E-value=3e-13, Identity=97%"; Hit description=Auxin- induced protein 15A
  Pfam annotation: Domain name=Auxin_inducible; Domain location=1-44; Score=11.1; E_value=2.7e-06; Accession=PF02519.5; Description=Auxin responsive protein
MSEEKIEADLLSQAEEEFGYDHPMGGLTIPCSEDVFQRITSCLN

SEQ ID NO: 182849 - protein, 104 aa, Glycine max
  Coding DNA Sequence Number=SeqID_91164
MDNKEGVQEQMKADMSALKDQMASITKAMLKIQKSIEDNAMAAASKTAREAEPVLQPAMNLGRDRSATGFNRRLHPPYRSKRFAPSPYLRGATPSSCRLSSAGR

SEQ ID NO: 182850 - protein, 48 aa, Glycine max
  Coding DNA Sequence Number=SeqID_91165
MEDVYFMQLNLQLKAQSIQTIEELRRQYARTDNNQNFNLEIKSSVYAV

SEQ ID NO: 182851 - protein, 57 aa, Glycine max
  Coding DNA Sequence Number=SeqID_91166
MASYGGELFLDSSFSLKWRLLSLFLSSGALSFIFQEAKESIDEEDPRPTSSNRACIM

SEQ ID NO: 182852 - protein, 204 aa, Glycine max
  Coding DNA Sequence Number=SeqID_91167
  Homolog annotation: Hit_ID=Q2HW90; Match level="QueryCoverage=29%, HitCoverage=12%, E-value=4e-08, Identity=43%"; Hit description =Putative uncharacterized protein
MGQLQRQAFRKAYGKIWDLARVEVSMEPIASLCQYYDQPLRCFTFEDFQLVPTVKEFEEILGCPLGRKEAISFLWVLSLHDKSCQGLVDLAAIDAFLAFQHGKESPVVAILAMYDTFDRGCEKSDARIFCCALALYVWLVSHPFLQEGRPVYPLQGHRSCVEKGKANWDQLLASMEGRLLICSLARRKEESGFYLHAKDVQMFP

SEQ ID NO: 182853 - protein, 131 aa, Glycine max
  Coding DNA Sequence Number=SeqID_91168
ATRLRSLATGLVGAERPLVHVDPATGKADNPHRKKLRTYLGIVARDMVDVTYENWKQVPTTQKDLIWEDIRDVRKKAQTIQKQNTAPHVLSRGGYEFLEKKLMDEKKKKQLEEDAKSGSTDTVIDPPSPIR

SEQ ID NO: 182854 - protein, 88 aa, Glycine max
  Coding DNA Sequence Number=SeqID_91169
  Homolog annotation: Hit_ID=Q6WAY6; Match level="QueryCoverage=53%, HitCoverage=8%, E-value=7e-12, Identity=65%"; Hit description =Putative uncharacterized protein
MERRRRKRVLISCGGFPNVPLMGTRGCINYNLVLAIRKLGYPMRGAPLEDELAPVISQGFNKTPRGDTSEGPQGMGGVAKKGQGTQGQ

SEQ ID NO: 182855 - protein, 482 aa, Glycine max
  Coding DNA Sequence Number=SeqID_91170
  Homolog annotation: Hit_ID=Q6WAY6; Match level="QueryCoverage=87%, HitCoverage=78%, E-value=2e-35, Identity=27%"; Hit description =Putative uncharacterized protein
LMGQLQRQAFRKAYGKIWDLAMPLRCFTFGDFQLSPIVEEFGEILGCPLGGRKPYLFSGFYPLLARISKIVQISAQELNRQKQVENGVVGIPRKCLEAKARILAGKGEWALFIDILALLIFGGVLFPNVDGLVDLAAIDAFLAYHDHKESPVVSMLADLYDTFDRRCEKSSTTIFCYTPTLYVWANWDQLLANREGASVNWFPRWKEGITGVVISCGGFPNVPLIGTRGCINYNPVLLIRQLGYPMRGAPLEEELAPVRKAWEVVQKKDKELRGSKNGPIGGYREWLKAHVQGLDWLPSLRIAKREQVEAPEEDEEVQALRTELEQAQTVKERFKSVALRIRKENAELRDVNVATTKALEQETKRARALWGSNNELKLWREERDQSRVDSLILKDELKACSSSKRSLSQCLCEIETNMLAIITKYQEELSLATAHEHRVSDEYAQVYAEKEARGRVINSLHQEATMWMDRFDLTLNGSQELP

SEQ ID NO: 182856 - protein, 152 aa, Glycine max
  Coding DNA Sequence Number=SeqID_91171
MGVQCPRSGQSEGRIPPNRWSPDEIRARMIIRYLRMSSGLPPLDDKRCRMTIICLCMSSDSIVSGRQKAQNDCRNVPFCGRAKAWLTGVFPKEERCTESPPTFICGKRRENRRKPVKMKILSSGVVFTFEEGQQKRGSCSYVPSIKEEIRPT

SEQ ID NO: 182857 - protein, 78 aa, Glycine max
  Coding DNA Sequence Number=SeqID_91172
MTFQWFRKHFPEEVVLPEIMARTRGLGRAIGRVVGRDRPADQDAADVPERRRPTASARRLRVHQMTTEGRDMAETSLT

SEQ ID NO: 182858 - protein, 263 aa, Glycine max
  Coding DNA Sequence Number=SeqID_91173
MNTLSAPAALSRAFILLMSFNDELTKRVYALSETSVSGRLCIPGKEFELNADGPPLKILRKNLTTLTHTWSVLSFSNLVPTSHTSDITLDRARLIYDIIQKMDMNLGKTNGKRSESPPSPALPTPAPFTSTTAPSVPAPALASTPLPPIKRVEEFISQVAWPGVQPSSSGGGEASAAQEPVLEEDEPIPPEPFVYETDPTSAQEEVASPESVPQSSPSPTTILDDIPEPSALALVSDQPIVQDPLVTPVLDLNEHAEDHLQDD

SEQ ID NO: 182859 - protein, 84 aa, Glycine max
  Coding DNA Sequence Number=SeqID_91174
MAARPGELMLHLESYHNPSNCAQCIDVAPCGACRPWIFFINGVLCFFKIMAAEWRRKKDDWRCHFKEKMSLEEAHHHRKPWIRA

SEQ ID NO: 182860 - protein, 56 aa, Glycine max
  Coding DNA Sequence Number=SeqID_91175
MDFIEDLPRAQGKNVILVVVDKLTKRKTKALAFLLKLGRIFVEANDFDVLMMIIMI

SEQ ID NO: 182861 - protein, 66 aa, Glycine max
  Coding DNA Sequence Number=SeqID_91176
QAQGETPQQPGDGQQRATDTPPSPLEFTSAHPQKGYSVADDPWPPNRQPSPEPKVAKYLMGKKRAK

SEQ ID NO: 182862 - protein, 59 aa, Glycine max
  Coding DNA Sequence Number=SeqID_91177
MGCKNWTQTWPMGLEIYPEVHENPRAFFSSSSPILLEPLAHDSSDWSFPRVDCITELLE

SEQ ID NO: 182863 - protein, 48 aa, Glycine max
  Coding DNA Sequence Number=SeqID_91178
MELQWKKKEKSLVHGKLPWQARKVASLASKEESFLEKLEEGYSHPSNS

SEQ ID NO: 182864 - protein, 48 aa, Glycine max
  Coding DNA Sequence Number=SeqID_91179
SLSEVIVSFALSARLALSKISLTRAKCENGAKRAFKVLRGGGDIPTAM

SEQ ID NO: 182865 - protein, 66 aa, Glycine max
  Coding DNA Sequence Number=SeqID_91180
MPTRDRRMLLFRTPLAPYEKSKSLGSGGIGGAICLVNSVNERDLSLLNSYVEVTLHGQLLRGTMAA

SEQ ID NO: 182866 - protein, 72 aa, Glycine max
  Coding DNA Sequence Number=SeqID_91181
MSSTFEFGAMLHDCLSADPLVQSSILPLFRSPMNVIAYAVHVSSTFEFGAMFHDCLSADPLESSILLFFGAP

SEQ ID NO: 182867 - protein, 82 aa, Glycine max
  Coding DNA Sequence Number=SeqID_91182
MENCTKKSLRTAPNSWVDDEDMTKSKGKDPLEGLGGPMTRARARKAKEALQQVLSILFEYKPKFQGEKSKVVSCIMAQMEED

SEQ ID NO: 182868 - protein, 105 aa, Glycine max
  Coding DNA Sequence Number=SeqID_91183
  Subcellular localization annotation: CTP_CleavageSite=56; ConfidenceScore=5.25e-01
MDVLCLVGTSVKPTKHRGRARKASIAARPTKPSTPAMPFRVCFYAVQTSCGILDHSCNSAQGGGDIPEERYGFLPPRGHPRILSNSSMVGTNWKSPNVKHLKGWS

SEQ ID NO: 182869 - protein, 72 aa, Glycine max
  Coding DNA Sequence Number=SeqID_91184
MTYIHILVEVKSHQLDLALYVSGSYNAQWNAPKLLHGKHMLRPSRILEKMEVEEPWLGLGLPLNYRVDMGAS

SEQ ID NO: 182870 - protein, 111 aa, Glycine max
  Coding DNA Sequence Number=SeqID_91185
MRKQEVILHGIWKWNVYWLMYLEIKGICATRVAEVGKDRATGHGAETAMDADEAMSRETNEVEFMGLGATAIDLEEPSSNTKGKKTRFDFFWHTSSQEKDERKRRNSSFFG

SEQ ID NO: 182871 - protein, 161 aa, Glycine max
  Coding DNA Sequence Number=SeqID_91186
  Homolog annotation: Hit_ID=Q6UUU1; Match level="QueryCoverage=37%, HitCoverage=40%, E-value=1e-18, Identity=78%"; Hit description =Putative uncharacterized protein
WIPRAAGIRWTLRRLAASFFMSGGTLYKRNHDMTLLRCVDAKEAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 182872 - protein, 95 aa, Glycine max
  Coding DNA Sequence Number=SeqID_91187
MPIGWTSQKSGADIEEEELTDLRSNPLQGEGDDEILPRKEPVTRTMSKRHQEDRARAAEEGPRVLMNLRVDFCAHGPRLNPIIFVHIRLGFGPYI

SEQ ID NO: 182873 - protein, 57 aa, Glycine max
  Coding DNA Sequence Number=SeqID_91188
MGRIYVSDRLGKNDDKGDDKKLKGQSKDEFKMFKKKSRTIQDSRRKVEGHFKIQEES

SEQ ID NO: 182874 - protein, 89 aa, Glycine max
  Coding DNA Sequence Number=SeqID_91189
  Gene Ontology: Mol. function=aspartic-type endopeptidase activity; Biological process=DNA integration
  Homolog annotation: Hit_ID=Q0ZCB7; Match level="QueryCoverage=95%, HitCoverage=8%, E-value=8e-15, Identity=41%"; Hit description =Integrase
MNYATTKKEMLAIAFALEKFRPYLVGSKFDIVIRDKKGSENVVAYHLSQSTNEEVIKEETKIRGELPDEFLLQATTRPWFVDVANHKAT

SEQ ID NO: 182875 - protein, 159 aa, Glycine max
  Coding DNA Sequence Number=SeqID_91190
  Subcellular localization annotation: CTP_CleavageSite=42; ConfidenceScore=5.18e-01
MRTQSFTNPQFLKIGLTHKNSPQWSCQLSQRALLWASEARVTGALSKGGKMHGVTTNVYLWKTSEKPKETGRQKRGFAPTYPPSKRNQTYVVFLRVNQAIFYLEGGPFKAWDLKIIHFYLVRKTKVSNLKILFSDFLRTSLTLRVDFSLSFTLVISQFN

SEQ ID NO: 182876 - protein, 131 aa, Glycine max
  Coding DNA Sequence Number=SeqID_91191
  Gene Ontology: Mol. function=RNA-directed DNA polymerase activity; Biological process=RNA-dependent DNA replication
  Homolog annotation: Hit_ID=A5AQZ7; Match level="QueryCoverage=67%, HitCoverage=12%, E-value=9e-09, Identity=30%"; Hit description =Putative uncharacterized protein
MKREKYASYSSHDSCKSLSEKPSNYYGGRHRSHTKHHSQRREKDRRPLEVNISLPYFHGKDNVEAYLDWEMKTSLVRKRMIHRDPLVEYWNDLKSSLRKRYILSYYERELMDKLQSLRQGSMSVEEYRLQM

SEQ ID NO: 182877 - protein, 62 aa, Glycine max
  Coding DNA Sequence Number=SeqID_91192
  Subcellular localization annotation: CTP_CleavageSite=26; ConfidenceScore=5.26e-01
MGIPPTACPSVAYPRCRNVPFYGRARARLTGALSKGGKMRGVSTNEGISTSRVCLKGQQPIF

SEQ ID NO: 182878 - protein, 68 aa, Glycine max
  Coding DNA Sequence Number=SeqID_91193
MKRYSTLLFSVKEQGWETRKLRKLLAKEEEEEEVQKDVQRDSMVVKETGNRLPESKNSGNLENFEKNS

SEQ ID NO: 182879 - protein, 184 aa, Glycine max
  Coding DNA Sequence Number=SeqID_91194
MAYSELWPSLLENHLVVAIPGKVFQPPYPKWYDPGAKCAYHSVQHLISAGWLSFQGEGPNVKTNMLASHGGASVNTVEEDGPSRAKRLGEVATSRRFIYQSLQAACMVSRVGDERDEFLFHLGESHDMETCPAVEELLQWLMDCGQLEVSIGGRKEPQICMQSEEKKVPLTPKALVICFTRKGT

SEQ ID NO: 182880 - protein, 93 aa, Glycine max
  Coding DNA Sequence Number=SeqID_91195
MARSVFAPCPYLRDLYGRELKGILVIIPKVVISFLMVSRVPSGVTNCRNLPFGGRAMRDSRVHLPRKEYARSRHQRLFEENVGKARKDVVYEL

SEQ ID NO: 182881 - protein, 88 aa, Glycine max
  Coding DNA Sequence Number=SeqID_91196
  Gene Ontology: Biological process=transposition, DNA-mediated
  Homolog annotation: Hit_ID=Q1J7G7; Match level="QueryCoverage=34%, HitCoverage=42%, E-value=2e-10, Identity=100%"; Hit description =Transposase
MVKVGTSYVPINVSFSPKVGPGLPGINRDTRIYLFLRSDLPSQWLLFLSAVPPVQLLTGWCVTAKAPPDISAGKCSGHAARNHHTRRA

SEQ ID NO: 182882 - protein, 144 aa, Glycine max
  Coding DNA Sequence Number=SeqID_91197
  Gene Ontology: Biological process=transposition, DNA-mediated
  Homolog annotation: Hit_ID=Q1J7G7; Match level="QueryCoverage=22%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDEDLKLLTTDAQLYKADEI

SEQ ID NO: 182883 - protein, 167 aa, Glycine max
  Coding DNA Sequence Number=SeqID_91198
  Homolog annotation: Hit_ID=Q2HW90; Match level="QueryCoverage=92%, HitCoverage=33%, E-value=3e-14, Identity=32%"; Hit description =Putative uncharacterized protein
MGQLQRQAFRKAYGKIWDLARVEVSMGPIASLSQYYDQPLRCFTFEDFQLVPTVKEFEEILGCPLGGRKPYLFSGFYPSTTRVAKKWSSRSTKEVFGGKGKGLGKIKANGLSFIDILALLIFGVVLFPNMEGLVDLAAIDAFLAFHHGKESPVVAILAMYDTFDRGM

SEQ ID NO: 182884 - protein, 159 aa, Glycine max
  Coding DNA Sequence Number=SeqID_91199
  Gene Ontology: Mol. function=transferase activity, transferring phosphorus-containing groups; Cellular component=membrane; Biological process=nucleobase, nucleoside, nucleotide and nucleic acid transport
  Homolog annotation: Hit_ID=Q1H0F7; Match level="QueryCoverage=83%, HitCoverage=11%, E-value=2e-50, Identity=76%"; Hit description =Sensor protein
  Pfam annotation: Domain name=HisKA; Domain location=73-139; Score =81.3; E_value=3.1e-21; Accession=PF00512.16; Description=His Kinase A (phosphoacceptor) domain
MAAPEWWCGALFVVDVPGVDASFQTGLSEASRRVAQEESNRQTGLLLEEIESHKKTDAQLQKARRLAEEANQAKSRYITGISHELRTPLNSILGYAQLLTNDDSIPEHRRQAIRTISRGGEHLLSLIESTLDIARIESGKMAFDVKPLHFPEFISQIVS

SEQ ID NO: 182885 - protein, 287 aa, Glycine max
  Coding DNA Sequence Number=SeqID_91200
  Gene Ontology: Mol. function=(S)-2-hydroxy-acid oxidase activity; Cellular component=peroxisome; Biological process=electron transport
  Homolog annotation: Hit_ID=A7QK66; Match level="QueryCoverage=25%, HitCoverage=19%, E-value=3e-28, Identity=90%"; Hit description =Chromosome chr19 scaffold_111, whole genome shotgun sequence
MGHATDDVDACGPGKWREGEREIGLVEPLVEGFHLGGELAEALESARGEFFYCDSGTAKEAGLVDEAEVVVVDDEVKGEVVGGAGELVPGDFDEVGVGGPAGVHGGEGGGGFTVGARAGSDMRGASSSLGGVAVVLVEEDGSSEKEGDHEEAADRGDNGLLVTQCVGLGVELVQNFRFKCVAILSYKGDCYFVEGVVGDQGDVHHGIFRWSSKSVRGFMAGFKAIALTVDTLRLGRREADIKNRFTLPPFLTLKNFEGLDLGKMDKADDFGLASNVVGQIDRTLSWK

SEQ ID NO: 182886 - protein, 218 aa, Glycine max
  Coding DNA Sequence Number=SeqID_91201
  Gene Ontology: Cellular component=nucleus; Biological process =regulation of transcription, DNA-dependent
  Homolog annotation: Hit_ID=Q6H974; Match level="QueryCoverage=64%, HitCoverage=18%, E-value=1e-60, Identity=77%"; Hit description=SEU1 protein
MAARIVVQSGAARIIVSNHKARHLFMCWDNSIAYWRKFVAEYYSPRAKKRWHLSLYSNVGHHALGVLPQATMCDICGSKSGRGFEATYEVLPRLNEIKFGSGVIDELLFLNLPRETRLGESVYELLRVVCEGQLRIIFTQDLKILSWEFCARCHEELLPRRLVAPQTDDADYVEPSFAVGKSPENVNVASNQLWLWSNVSSSPCRQFIHYELNLWTIL

SEQ ID NO: 182887 - protein, 115 aa, Glycine max
  Coding DNA Sequence Number=SeqID_91202
MQRVKKQHIEEPMSINTSHEKKRIGKLNINDLRIQLSQPTLLRASEARLTGASSKGGKCAESPPTFICGKRRKNRRKPVMKNIPDSGVVFTFEEGRQKRGSCSYAPSIEEEIRPT

SEQ ID NO: 182888 - protein, 140 aa, Glycine max
  Coding DNA Sequence Number=SeqID_91203
  Gene Ontology: Mol. function=heat shock protein binding
  Homolog annotation: Hit_ID=A7PLM4; Match level="QueryCoverage=52%, HitCoverage=14%, E-value=8e-18, Identity=62%"; Hit description =Chromosome chr7 scaffold_20, whole genome shotgun sequence
MANPTLMNLQSTVKAILTRVIKPCSNLSSESSFVILILHTTIIDGLGVAGWAVGGIESEAAMLGQGSKLQIYKSRATAFKEMEVAEWLKWGRLTINNILAEKKTVVGTGYFDVFERFYSTIHAAYYGPKIQSMELLLDVV

SEQ ID NO: 182889 - protein, 138 aa, Glycine max
  Coding DNA Sequence Number=SeqID_91204
MEERGHGMYYTPPTFSQYPSQMYRYPFEGHHTDMSPSEHSFGGVAETHPHFSWPTMTPSQQHDAPMATPNAPLAPQWNVPGAIPDMGDLLGVDLQHESVEAEQVEAGRHRGRRNPDRQVQRWDRPCGTSSRHHRHHNE

SEQ ID NO: 182890 - protein, 74 aa, Glycine max
  Coding DNA Sequence Number=SeqID_91205
MGSRDVWFVVGSCKCGKLRESWAGMHSCYGGEVMKGIKQQQWTQQSNNTLTEMLEADTRETNTNQRLRRKIIKP

SEQ ID NO: 182891 - protein, 157 aa, Glycine max
  Coding DNA Sequence Number=SeqID_91206
MDKIPSKNRIKFCQKVLNSNRFYRRNQIHYPQLKDPNPSPLFFHFAIFLYVPQSCGHNRRASIVPSLSAHAANSLVGDGGGLVGGGGLGLEWLMMVWIRGIGNVALFLFQVGYFMRRGVTLKFNNLGKLVSSSNCAHVASLLTICLQEALRKSIKHV

SEQ ID NO: 182892 - protein, 45 aa, Glycine max
  Coding DNA Sequence Number=SeqID_91207
MVIEVLAIKISIPANMGSNQAQSFKKRFYQVKVKNLEVASLRKLG

SEQ ID NO: 182893 - protein, 112 aa, Glycine max
  Coding DNA Sequence Number=SeqID_91208
  Subcellular localization annotation: CTP_CleavageSite=47; ConfidenceScore=5.27e-01
MNYTTDFVIIIFLEGTWIMGSPPASPPPPPPSPPPPSDTSPLPSAVKRTQKASRLRSLSTRPPGAERPVVHVDPATGKAEGPHMKKLRTYLGIVACDKVDVTYENWKEVPTG

SEQ ID NO: 182894 - protein, 175 aa, Glycine max
  Coding DNA Sequence Number=SeqID_91209
  Pfam annotation: Domain name=MAP7; Domain location=4-134; Score= -84.5; E_value=0.1; Accession=PF05672.2; Description=MAP7 (E-MAP-115) family
MSLHSSSSVNGEGSTPKDPLYKILDELRSLKLWKEKQERKEKGKKRVEEISQDERVKIREEERRKIRKKMKREKHASYSSHNSCKSLSEELRDYYEGRHRSHLRLHSHRRENERKPTLKSYGYHSYPKKDQGLGILGATPSKPNDDKGKTIEKQPPKASMQEKTSSIKCFKCLRR

SEQ ID NO: 182895 - protein, 264 aa, Glycine max
  Coding DNA Sequence Number=SeqID_91210
KKKLEETAQSGSTDTVIDPPSPIKRHVKWKLARTKKTGHMTSEAAKEIVDKIASQGFFVTHGCDDVLTVVIGRSEHPGRVRVAGVGVTIKQYFGSASSTSCTSSSMAPKDLQLLTQQIKDQLEDSITEKMQSQGLALPPEPEVGPSAARVNTKENCVDPSGNGPDTGNSDKCGLYIKEYPPCLVSLGRVYDGSTTVDNIPLLHDQVKVGVEEVRDAYAPIPVPTKEVKGAVGPTKPADRPDHEVDDPLYLMTLTIPQLFLKPLQ

SEQ ID NO: 182896 - protein, 106 aa, Glycine max
  Coding DNA Sequence Number=SeqID_91211
  Subcellular localization annotation: CTP_CleavageSite=49; ConfidenceScore=5.64e-01
MYPLLFSITTTQVDVPSTCTTKDVPSVATCPFVGGRRVTRGCAFQRGKRCTESPPTFICGKRRENRRKPVEMKILSSGVVFTFEEGRQKRGFRSYVPSFGEEIRPT

SEQ ID NO: 182897 - protein, 80 aa, Glycine max
  Coding DNA Sequence Number=SeqID_91212
MGIHNQGGCPARCWLMKDIPRMPPFRAYLTCLQLLWVFSLLSHDAISGPPRPALSPKPHSIHIPSTKYSLPAQMRQSAYR

SEQ ID NO: 182898 - protein, 51 aa, Glycine max
  Coding DNA Sequence Number=SeqID_91213
MGAKHLTRTKEWSHVIEQRFPDEIRGPEIIQLYCAIRPNFLDDEGSRPFGF

SEQ ID NO: 182899 - protein, 227 aa, Glycine max
  Coding DNA Sequence Number=SeqID_91214
  Homolog annotation: Hit_ID=A3UVR1; Match level="QueryCoverage=96%, HitCoverage=77%, E-value=2e-31, Identity=34%"; Hit description =Putative uncharacterized protein
MTSNEVPAYYKHLKDDDAPPCSLRCGSIQYKKYATQEDAKKAIEDEELIVISGFLQTRPENNPRADFGGDEVPIDSHFEREDGKEVSLPIARHNGESFRVPSQITSIQSLCANFIHNYYREIYLLDEDGRAKRYRVEKFKGHSNIWLRIDNSTLYRDFRIRITNDTAEGRGFLNDRNVGRIAIFYSKVHGAGLGFITPELGWGEVALLPDKYDDFLNRVYHEEDTDN

SEQ ID NO: 182900 - protein, 249 aa, Glycine max
  Coding DNA Sequence Number=SeqID_91215
  Gene Ontology: Mol. function=adenylate cyclase activity; Cellular component=cytoplasm; Biological process=cAMP biosynthetic process
  Homolog annotation: Hit_ID=P40130; Match level="QueryCoverage=100%, HitCoverage=29%, E-value=1e-129, Identity=89%"; Hit description =Adenylate cyclase
  Pfam annotation: Domain name=Adenylate_cycl; Domain location=1-249; Score=-151.3; E_value=3.5e-07; Accession=PF01295.9; Description =Adenylate cyclase, class-I
MMQSYRNLIRFARRNNLSVSASPQDIGVLTRKLYAAFEALPGKVTLVNPQISPDLSEENLTFIHVPAGRANRAGWYLYNQSPDMSSIISHQPLEYNRYLNKLVAWAWFNGLLTRKTRLHIKGNEFCDLPRLQELVNDVSSHFPLRLPAPTPKALYSPCEIRHLAIIVNLEHDPTSAFRNQVVHFDFRKLDVFSFGQQQQCLIGSIDLLYRNSWNEVRTLHFSGEQAMIEALKTILGKMHQDAAPPDTVE

SEQ ID NO: 182901 - protein, 81 aa, Glycine max
  Coding DNA Sequence Number=SeqID_91216
MVAVRGGQGSSTSIFPRIRLECNWIFRFMPFDLCPSSSHNYIFASTGMWVQAIGLFAQATRAPEFGLPRPFNQKLLVLHIW

SEQ ID NO: 182902 - protein, 75 aa, Glycine max
  Coding DNA Sequence Number=SeqID_91217
MMAHQNPPYLAFCTPGQNETKNKIQGYQRETNENIHIFLNEHQGMKVMGPRTRYGKIWNKWLNPKGIEEQWGISA

SEQ ID NO: 182903 - protein, 138 aa, Glycine max
  Coding DNA Sequence Number=SeqID_91218
PPTYLALLIRLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 182904 - protein, 66 aa, Glycine max
  Coding DNA Sequence Number=SeqID_91219
  Gene Ontology: Mol. function=nucleic acid binding
  Homolog annotation: Hit_ID=A5C693; Match level="QueryCoverage=78%, HitCoverage=31%, E-value=5e-12, Identity=53%"; Hit description =Putative uncharacterized protein
MTGDTSKFTDISPKKSGHVTYGDNNKGRILGVGKIGLKHSLLSVSQLCDKGYLMMIHGCGINGLHI

SEQ ID NO: 182905 - protein, 115 aa, Glycine max
  Coding DNA Sequence Number=SeqID_91220
PHQLDLAPYASDPYNAQWNAPGLLHDKHTLRSSRILGEMEVDEPWLGLSRCKIHFLVGVLVYAKGMAFVDNWAVGKEKVCYWLSNDIVGLVGNLAVLEWQSQHRLLLHPHPLHLP

SEQ ID NO: 182906 - protein, 105 aa, Glycine max
  Coding DNA Sequence Number=SeqID_91221
  Gene Ontology: Mol. function=structural constituent of ribosome; Cellular component=intracellular; Biological process=translation
  Homolog annotation: Hit_ID=Q32703; Match level="QueryCoverage=36%, HitCoverage=90%, E-value=3e-11, Identity=84%"; Hit description =Putative uncharacterized protein
MGSLPQRGWSERSFEPSHRRRRGTHQSIPNLVVKLYCGDDTVGEISSGDDGVGPVAQRIRARGYEPRCRGFESLLAHNRPKKGRIFPSGGRKIMIGLADPKLWNL

SEQ ID NO: 182907 - protein, 143 aa, Glycine max
  Coding DNA Sequence Number=SeqID_91222
  Gene Ontology: Cellular component=mitochondrion
MRALGPKDTGGESKKSFHFPFRSSTSFLLVHQSEIKQDKPGTTTWSKLGRKVLNAQVKIERAIEKALLSDGYSRDELSQRSKRDERRTLLFYRTGKLLSMKTYDSYVKEVELGTHRSQPYKIGLTEYFRAGHAPVRNCISGIL

SEQ ID NO: 182908 - protein, 248 aa, Glycine max
  Coding DNA Sequence Number=SeqID_91223
  Gene Ontology: Mol. function=microtubule motor activity; Cellular component=microtubule associated complex; Biological process =microtubule-based movement
  Homolog annotation: Hit_ID=Q9ZUS4; Match level="QueryCoverage=38%, HitCoverage=9%, E-value=1e-39, Identity=83%"; Hit description =Putative kinesin heavy chain
MSLKIHANRLCCFRDSKLTRILRDSLGGKTKTCIIATISPSAYCMEETLSTLDYASRAKSIKNKPEANQKVSKVVLLKDLYMEIDRMKEDIRAAREKNGVYISHERFAKEEAEKKWKEERNRKKKENEESGRKKNEMKERLRYCVDSEDPKASKLVASKKHKLDSVAKDNKNKKTTPLTGRERRLHFEELADARKKKRKRHFTLKQELARLWEKMRRHEIAKEDKAKLVTEALQKMKGKIPKIAKMNV

SEQ ID NO: 182909 - protein, 152 aa, Glycine max
  Coding DNA Sequence Number=SeqID_91224
MEAHQELTGNNTDRELSGVVVERVTVEGDTTGGLVAGAGVVGVDRVVLGACATRVYGDVTHNDACLQSRNEAREHRGLGTKLANDGSMVGGVRCGGVDRDDAKLGVTGEVHETEVVSGTTRGLREHGDDLARGGGGRGRRLNQDVSEGKQEM

SEQ ID NO: 182910 - protein, 47 aa, Glycine max
  Coding DNA Sequence Number=SeqID_91225
MVEQQADTVELLTVYHVLVVEASFMMMNQVDSSSFDDDKDDDKKPKK

SEQ ID NO: 182911 - protein, 202 aa, Glycine max
  Coding DNA Sequence Number=SeqID_91226
MNMLKIEISQAARARKPCPPSSLCHREIAFLFLLPPENCRNPLPRHPHCPRSNPHNPLHCRKTHIVLARTHRTPYTTGKPTLSSLEPTEPPTLFFEVWLEENPTYTVATRVLKLSWVLKAQSFLREVLLLIEVRGKLKVSCHFVRSHCHCHCLGSRLLGAPVEITSDKDPVIVHNKLLTLLAIILEFGALVCQRRDKMQFPP

SEQ ID NO: 182912 - protein, 92 aa, Glycine max
  Coding DNA Sequence Number=SeqID_91227
MSGFKPGISWYDQAKMSWLNKQVCGSADFELLAKPILWLSEPSTKRSNSWLKFGCGRDWREPSLKRKLSCRALDEILSDCEVPRGGGDIPTT

SEQ ID NO: 182913 - protein, 105 aa, Glycine max
  Coding DNA Sequence Number=SeqID_91228
MPQWHLRMISWNLACGTNCAHMAAIVREMAPKKLPAKRSRKDVARKGSSAAPQADVDFDRHRFWSEEHQQRFEAIKGVKASFMMMNQVDSSSFDDNKDDDKKPKE

SEQ ID NO: 182914 - protein, 114 aa, Glycine max
  Coding DNA Sequence Number=SeqID_91229
MIMRGQDIYSSQDEATTSPSSSESEEAKGEKSSEEIYPQEEGQPLMVKEKCKERLASIATPLGLEVIPQVKKLLDEGLVRVDERSPEYEEPKDFRSNSFLGGWNDAILTRKGIG

SEQ ID NO: 182915 - protein, 118 aa, Glycine max
  Coding DNA Sequence Number=SeqID_91230
MEAMKRANGHNDGGHDEHEKDNGSHAVIVAATSTVAKVNPMPPSGFNQMNHPTSDMAHEIPHHNLADFEPCLRYATEGQAVGGIPMPNTLEGPQFRPQPQPLHFAVGRAPPAMAEKGK

SEQ ID NO: 182916 - protein, 97 aa, Glycine max
  Coding DNA Sequence Number=SeqID_91231
MSGFTRNSPQISASPYQLDFAPYASEPYHAQWNAPGLLHDKHTLRLSRILGEMEVNKPWLGLWLPLNYQVDMGASQHMTTEFGVVFVIGSAVDRLCG

SEQ ID NO: 182917 - protein, 153 aa, Glycine max
  Coding DNA Sequence Number=SeqID_91232
STLEDPTRSAWTNSGFQMSVGSHMGSTDRVVRQFGYTQTIPAPPVDSWVSYDDIHDRWMHYSDYMVLAGHASDPLPDGHAPQPRVIPQAPQTDIPHVLEPGAPSTSTRPAVEEPRHVVEVCHGIAKRLQRHLSLGVVTPGSSTHEVIEECLRM

SEQ ID NO: 182918 - protein, 42 aa, Glycine max
  Coding DNA Sequence Number=SeqID_91233
MPFSRDLLFGNGLPEDVIDYQWPNDYTALEMINLHCVSIHMD

SEQ ID NO: 182919 - protein, 163 aa, Glycine max
  Coding DNA Sequence Number=SeqID_91234
METLWKWLKAHVQGLDWLPSLRTAKGEEVEAPEEDKEVQTPGQNSSKLKQSKKATTKALEQETKRARREEHGRNKFRGALWGSNNELKLQREERDQSWVDSLILKDKLKACSRSKRNLSQRLCETETNMLAIISKYQEELNLATAHEHKVADEYAQVYAEKEA

SEQ ID NO: 182920 - protein, 207 aa, Glycine max
  Coding DNA Sequence Number=SeqID_91235
MAWGAVQSKDKELRGSSNGIVGGYHKWLRVRTQELDWLPKLKAAREEEAETSKESEEVQTLNAELERAQVVKEKFKSTAIKVRKEYNELRDINMTTTEALERETKRYKEKLSLAATHEQRLEDEYAKVSVLQAEREARERVIDSLHREAMMWMDRFTFTLNGSQELPRLLAEVKAMADVYSAPEEVHGLLDYYQHMIDLMAHIIRSR

SEQ ID NO: 182921 - protein, 69 aa, Glycine max
  Coding DNA Sequence Number=SeqID_91236
  Subcellular localization annotation: CTP_CleavageSite=50; ConfidenceScore=5.03e-01
IAPARHPVDPKKFNKVLWFPALITGLCQFYGVPIAPNKVIRPLLTGLSSRSTAPPGRRRTRHHSSGQQA

SEQ ID NO: 182922 - protein, 239 aa, Glycine max
  Coding DNA Sequence Number=SeqID_91237
  Gene Ontology: Mol. function=transcription factor activity; Biological process=regulation of transcription, DNA-dependent
  Homolog annotation: Hit_ID=A6TD13; Match level="QueryCoverage=100%, HitCoverage=81%, E-value=1e-111, Identity=82%"; Hit description =Putative transcriptional regulator LYSR-type
  Pfam annotation: Domain name=LysR_substrate; Domain location=32-239; Score=95.3; E_value=1.9e-25; Accession=PF03466.11; Description=LysR substrate binding domain
MALSEYVSAFLPYAMTMLNTENKAREEMALIRGAGKGILRIGCVSSLLTSHFIDKLAAFHKRHPRIHIKIFDRIDSELFKLLLMHEIDIALCGPLPHDDKIVVRGKINWQDRICIISRPGHPLQKEKRLSLAAMLDYPWIMPPPLSTPMLILEDIFRSHQLPCPVPIIECASSAAIKSFIAESDLLTSMPAPVYRLEEKLGLLRPLEAEGSVFVRDFYAWSHFGVLSGAALQLIQHLKQ

SEQ ID NO: 182923 - protein, 224 aa, Glycine max
  Coding DNA Sequence Number=SeqID_91238
  Homolog annotation: Hit_ID=Q6WAY6; Match level="QueryCoverage=83%, HitCoverage=35%, E-value=7e-18, Identity=33%"; Hit description =Putative uncharacterized protein
MAEVSTEAIASLTQYYDQPLSTEKMFGGKARLLAGRGEWASFIDILALLSFRGVLFPNVDGLVDLAAIDAFLAFHDRKESLVVAILADLYDTFDRRCEKSSTRIVCCTPALYVWLVSHLFRQEVRHACPLESHRSCTEKREARFPNVPLMGTRGCISYNSVLAIRQLGYPMRGAPLEEELAPIIARGFNRTNVEALQKVCKAWEMVQKKDKELRGSNNGPIVGY

SEQ ID NO: 182924 - protein, 21 aa, Glycine max
  Coding DNA Sequence Number=SeqID_91239
MDCPPYKGAGSWNGNGAGSGI

SEQ ID NO: 182925 - protein, 100 aa, Glycine max
  Coding DNA Sequence Number=SeqID_91240
  Subcellular localization annotation: CTP_CleavageSite=36; ConfidenceScore=5.26e-01
MNKYLPHAYILKCTKSNKIKWPNSQKSISPVELPTVATYRSAGGRRVTRGMRVPRKEYARSCHQRLFEENVGKTKKDAIYELLSERFKSCIYARGRLSEK

SEQ ID NO: 182926 - protein, 90 aa, Glycine max
  Coding DNA Sequence Number=SeqID_91241
MGEVEEAQEQMKADMEAMKEQMTTMIEAMMSIKEIIEVKSLQLWKKWEKLDHLEERLRVVEGGRDYAFTDIEELFLVSKHGYSQVQGAGL

SEQ ID NO: 182927 - protein, 177 aa, Glycine max
  Coding DNA Sequence Number=SeqID_91242
MASSRGGNGRRIGGCYKLELLEEGAATGGGTSIFLPDHKPSAPSDLSDSEWRLLSLVEIAYPGWSFASLTPLRKVEKGSQLLVVFVVVAATALEEEHMACLDQQHSGKEGQAVVVVEDLPISDLDDSSNLDCIYCLKDHNYSIVDCCKEGQRSVWLSVEEHRPQILATGADFLFMAS

SEQ ID NO: 182928 - protein, 324 aa, Glycine max
  Coding DNA Sequence Number=SeqID_91243
MEGTSLVDLCLKWLRRNSPRRGLERTPLEKAPMPPQSYSHRFRSVEHLQRFEAIKGWSFHKERHVQLREDEYHDFQGEIACRHWARLVTPMAKFDSEIVIEFNANAWPTKEGVRDMRSWVRGHWVPLDAKAINQFLGDPLILEEDQQCEEAIAQLLCQDFAWTATGRQVRIMCTNMTTLTQIWMTLLLSNVLPSDHNSDLPLPKCQLVYVILTLMSVHVAQVIADVIYLFVGMAPTRHPLDPEKSNRALEFLTLITGLCQSEGVPVTPSKVIRLPITRAFIEKYCKPRQAQGDTHQDAGAPLPPRLADSAGPLGVERYLQHLVR

SEQ ID NO: 182929 - protein, 310 aa, Glycine max
  Coding DNA Sequence Number=SeqID_91244
  Homolog annotation: Hit_ID=Q6WAY6; Match level="QueryCoverage=90%, HitCoverage=48%, E-value=5e-15, Identity=26%"; Hit description =Putative uncharacterized protein
SHLFRQEVRHACPLESYRSCTEKGGANWDQLLASKEGASVNWFPRWKEGRTGVLISCGGFPNVPLMGTRGCISYNLVLATRQLGYPMRGAPLEEELAPVISRGFNKTNMETLQKVCKAWEVVQKKDKELRGSNNGPIGGALPSLRTAKREEVEAAEEDEEVQALRTELEQAQTVKERFKSVALRIRKEKVELRDVNVATTKALEQETKRARREEHGRNKFRGALWGSNNELKLRREERDQSRVDSLILKDELKACSRSKRSLSQRLCETETNMLAIISKYQEELSLATAHEHRVADEYAQVYRKRRLEEG

SEQ ID NO: 182930 - protein, 136 aa, Glycine max
  Coding DNA Sequence Number=SeqID_91245
  Homolog annotation: Hit_ID=Q6WAY3; Match level="QueryCoverage=80%, HitCoverage=4%, E-value=2e-08, Identity=34%"; Hit description =Gag/pol polyprotein
  Subcellular localization annotation: CTP_CleavageSite=44; ConfidenceScore=5.19e-01
MQSRGGMHLQAKGRKRPPTSARCQPSRVFAPPDLPTQPANVKGKAKMVEEQNDKTTLTSNEDIPVKGLSEKWDGCGKNEASLEEAGEFLRIIQQSEFKVIEQVNKTPTKVSLLELVMSSEPHRALLVKVLNETHVA

SEQ ID NO: 182931 - protein, 66 aa, Glycine max
  Coding DNA Sequence Number=SeqID_91246
MMTKVVNKKAQKSKNISSESRTSQEFKNQGQFKTQEESLESRIKIQDLKNQDQDSRMKKRVNQDKY

SEQ ID NO: 182932 - protein, 462 aa, Glycine max
  Coding DNA Sequence Number=SeqID_91247
  Homolog annotation: Hit_ID=UPI00005F72ED; Match level="QueryCoverage =100%, HitCoverage=54%, E-value=1e-145, Identity=55%"; Hit description=COG1357: Uncharacterized low-complexity proteins
  Pfam annotation: Domain name=Pentapeptide; Domain location=409-448; Score=39.7; E_value=1e-08; Accession=PF00805.13; Description =Pentapeptide repeats (8 copies)
MRLDWRRAYGGTQFADNPHGIGATPETFPQGRIHRLPNIEPLQGRLASPRQSAQPASFDALDITWPRRFSRIGKNYDADWLKNGFPGFANDIDWRLFNMAEGDQQFPQRDSLPPRAAYRIWNMHPSEPVQQGHLPPWRTRCFINRLRGDETHFEEIAMRHTTVWFFPHREQMLLIYQGSTRINEDDAADVMQLMPALEIEGEPRSTAHYRQVLTQRLDKERGALHAFREQELLPEACIGAWLDTETPTQQSPMAENIAAYEHRQREEHRQRLLREGQDIDELFPLPSQDAPPKLDELAEFVERLESQAEAQYQDMLKLAQAEGIDPRNPGGDHVPPSGAESYQQQRDLLFQEARRHPDAFSEKQLGESERALHQMYLMSAQAQSPALRLSGDLAQIIRQRVTAAMLRDKDLSGLDLTGADLSGMDLCQANLRGALLENANLRQTRLVGCDLREAMLARADLS

SEQ ID NO: 182933 - protein, 74 aa, Glycine max
  Coding DNA Sequence Number=SeqID_91248
MSSKKVQAGVCQNIAPTDIRSKIVSIDVVATYPSAGGRRVTRGMRVPRKEYAWSRHQRLFEENVGKTGKDAIYL

SEQ ID NO: 182934 - protein, 193 aa, Glycine max
  Coding DNA Sequence Number=SeqID_91249
DCHHQKGGDCGNNDLQDYFDDAKESRVKQVPKNQASRIKSQRIKIQEQLSFKIQDSRTIKIKIQGSREADLKIQEKKSRNNSQDFTREVFFKNPNIAQSCFTKEFSQKFSKLPEYLLSGYILCGTSRGYIYLGCYTENKRGYISCGSVQVEGTSTWLFKENKGGYIPCGSLHCKGFYKVERNLKNRWLLGDWT

SEQ ID NO: 182935 - protein, 265 aa, Glycine max
  Coding DNA Sequence Number=SeqID_91250
  Gene Ontology: Mol. function=translation initiation factor activity; Biological process=translation
  Homolog annotation: Hit_ID=Q6ZNE1; Match level="QueryCoverage=47%, HitCoverage=15%, E-value=5e-43, Identity=65%"; Hit description=cDNA FLJ16186 fis, clone BRTHA2007060, moderately similar to EUKARYOTIC TRANSLATION ...
  Homolog annotation: Hit description=INITIATION FACTOR 3 SUBUNIT 10
SSNSTKKRAPSESNISFLNSSITDMDSMADLGPEEKGKREVEEDDDDSSELHDLVAHLGEEGTRERSKVQTLVSLMRKRKTRRRKKVSVGTVVWWNRPARNDEVFLGVLSLFMGFPCSLFSEEWSHPVHWEFDQARTNPHVPRAQQVLKVGAQERRELVFVQVQLAQYVPALERLATMRLLQQVSNVYQSMKIETLSGMIPFFDFSQVEKSLESDGLRDHLANFAEELNKARQMIYPPDKRSSKLGALLPSLSEVVAKEHKRLLA

SEQ ID NO: 182936 - protein, 72 aa, Glycine max
  Coding DNA Sequence Number=SeqID_91251
MTPRSTTMLFKLLEILCNFNPSKLTLSNRSKISIRSPESRDKEIHGCEKIQKETQTRYIESVSGDEEGKRVA

SEQ ID NO: 182937 - protein, 55 aa, Glycine max
  Coding DNA Sequence Number=SeqID_91252
MVNLAAKFNSMGMQETHNSRDKQPLDLNKSLKKVQMFFFLLEKKIEDGVLRRILN

SEQ ID NO: 182938 - protein, 217 aa, Glycine max
  Coding DNA Sequence Number=SeqID_91253
EVRALKLKLGKARLAKEKFKSAATHIQKECTELQEENAATARALEQETKRARKEEHGREKFRGALWGSNNELKLRREERDQSRVHGMILKEELVACARSKRSLAQHLEATEQSMAIIGQYKEELNQSMAHEQKLVEDFAQVYAEKEARGRVIDALHQEATMWMDRFALTLNGSQDLPRLNFIITKCRNLPFGGRATRDSRDACSMKGIRAESPPTFI

SEQ ID NO: 182939 - protein, 97 aa, Glycine max
  Coding DNA Sequence Number=SeqID_91254
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=42%, HitCoverage=40%, E-value=3e-11, Identity=78%"; Hit description=LacZ protein
MIGRADIEGSKSNVAMNAWLPQASYPCAHPPFASWRNSEEARTDRPSQQLRSLNGEWDAPCSGALSAAGVVVTRSVTATLASADVRRCFCRYAPPRQ

SEQ ID NO: 182940 - protein, 126 aa, Glycine max
  Coding DNA Sequence Number=SeqID_91255
  Homolog annotation: Hit_ID=A0PAV3; Match level="QueryCoverage=30%, HitCoverage=17%, E-value=5e-07, Identity=76%"; Hit description =Restriction endonuclease
MVKVGTSYVPINVSFSPKVGPGLPGINRDTRIYLFCEVIFLVTGGAYQSFSASLRSATDGVGHDVVKRRPVNCNTGLTIGRIGAPPRWRPSELKGGPGAQEYDTGYIPLPRSPDRYARSRVRPAGT

SEQ ID NO: 182941 - protein, 134 aa, Glycine max
  Coding DNA Sequence Number=SeqID_91256
MGGHCSDSVKGDKVFAKSDGHSNNHKSNGKNHNSTNMPSDLTSARDHGLDNKKQEVVVAVGNGSDNFYDGLGCCHVQGYYKLNSNRLTTSPLDTQKDHSCIFTACSIIIRTFIYFSHINITIKRNNISNEKNEA

SEQ ID NO: 182942 - protein, 26 aa, Glycine max
  Coding DNA Sequence Number=SeqID_91257
MDAKANNILMASNLATGAFVVLRSST

SEQ ID NO: 182943 - protein, 127 aa, Glycine max
  Coding DNA Sequence Number=SeqID_91258
  Subcellular localization annotation: CTP_CleavageSite=59; ConfidenceScore=5.03e-01
MEKAISRICTLDLMMKYVQFQAKRASIAKHSFSALSVKEESGRASASRPCAKRVISVLSAAGVFCRSKASKLILMMPKTQVKNQDSSKFQESKIHSKRLKKSRRFKRRLKICKNLKISIKRIFQRKD

SEQ ID NO: 182944 - protein, 247 aa, Glycine max
  Coding DNA Sequence Number=SeqID_91259
  Homolog annotation: Hit_ID=UPI00016621D1; Match level="QueryCoverage =88%, HitCoverage=40%, E-value=6e-16, Identity=32%"; Hit description =UPI00016621D1 related cluster
GLHALTFRGLHVLAFRGLHALTFRGLHVLAIRGLRVLAFRGLHVLAFRGSCTFTFRGLHALTFRGLHVLTFRGLHVLAIRGLHALTFRGLHVLAFRGSCTFTFRGLHALAFKGLHALIFSGLPVLSFKGLHALIFKGLHALTFRGLHALTVRGLDVLALRGLHILAFGGLHALVFRGLYVLPLRGLHVLVFGGLHALAFRGLHVPLFRRLHALAFRGRHVLAFGGLRSPSPFGGYASSLLVGSISTP

SEQ ID NO: 182945 - protein, 287 aa, Glycine max
  Coding DNA Sequence Number=SeqID_91260
GVRDMRSWVRGQWIPFDADSISQLLGYPMVLEEGQECEYGQRRNRSDGFDEEAIAQLLCIPGQDFARTAAGRRVRIMRTNMTTLTQIWMTLLLNNILPTDHNSDLPMPKCQLVYAILTRMSIHVAQLIADAIYIFAGMAPTRHPLDPDKSNRALGFPALITGLCQSFGVPVAPTQGAPPPPHQAGQAGAFDMEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGD

SEQ ID NO: 182946 - protein, 87 aa, Glycine max
  Coding DNA Sequence Number=SeqID_91261
  Subcellular localization annotation: CTP_CleavageSite=19; ConfidenceScore=5.10e-01
MDHFKVQRLKRTTVQVLIPSSNVNTTPESGIFFMTGFLQFFQRFPQINVGGDSAHFPPLEDAPVSLASLTRKRVGCDSWRLHWGLFL

SEQ ID NO: 182947 - protein, 55 aa, Glycine max
  Coding DNA Sequence Number=SeqID_91262
MPISPCGSISWDHAHKTHSGPGEAQQGPGVSSSSYEPLSVLTGARPPQQGHAIVT

SEQ ID NO: 182948 - protein, 185 aa, Glycine max
  Coding DNA Sequence Number=SeqID_91263
MEEEVNEKSSRLVALGKVYENSSTIHNVPYADDVVRYSQKHLAKPIGSAEMDNIVVVVDPSGELVKNLFGVYQKPIKLSWDGVKFGIPNVKDGFFITHVDVTEIILGYKCLNISILYLGMIRIELFGTNCGARQKIIRRFGKECGKYPNGRAKSSPGRLSEQGYFRLKQQLAWVSYRSTKSPHFL

SEQ ID NO: 182949 - protein, 36 aa, Glycine max
  Coding DNA Sequence Number=SeqID_91264
MTSSGTGSPSIANVVKVDVLKKVKVEWLAKVEVVDV

SEQ ID NO: 182950 - protein, 54 aa, Glycine max
  Coding DNA Sequence Number=SeqID_91265
MDVGLPYIQMNGILRFNTSIRIRGKSCLLMFSRLTSLFITISNHKGGSGWWWMM

SEQ ID NO: 182951 - protein, 850 aa, Glycine max
  Coding DNA Sequence Number=SeqID_91266
  Gene Ontology: Mol. function=protein serine/threonine kinase activity; Biological process=protein amino acid phosphorylation
  Homolog annotation: Hit_ID=A2T3V2; Match level="QueryCoverage=7%, HitCoverage=7%, E-value=2e-10, Identity=60%"; Hit description =Ethylene control element
  Pfam annotation: Domain name=RRM_1; Domain location=188-258; Score =28.5; E_value=2.4e-05; Accession=PF00076.13; Description=RNA recognition motif. (a.k.a. RRM, RB
MTGPAVNHSGRMDLQKTEALGANYAGGNSHLIALIPGAEEYESFNEANQSIMDYPSHEVDLDKEDLDIPWSELILKENIGTGSFGTVLRADWRGSVCLGVLTEPHATGQCTGRRRNLACMDAQHEGQRSNNRGRSDEPDEEEKWTRVVSRRSMKAVQKFSPMGGQLEAGGRSIQLSRNWRHEANITSFYFTHFPVEANEKLLWWHFKKWGDVREVYIAKRLNKEGRRYGFVRFKDVKDAKGLELRLDNIFINEHKLYVNLPRFDRSARQEAPQANKLARGKKTIEERCRDATNHGPPRRSYVDAVTMGGCQGHKRVDETRYSPVYINLEVTGRAWCEGTWTGKLKKMMEVDALEDRLAWELGYSVGSQFLGDDMVLPPGLSDEKARALIQSETERGDSIFYELKKWSPLSRPSNRIVWLQLWGFPVQAWEIQSFRKVVAAIGDIIEPDDDTEDRRRFDRARLLVRTPLPPTIRSAVNVRVGELEYKVWIVEEAGSDGGLTKRRPSPSEGWSESITSDDDGVGCDEGDDVDTNFSFSPELSNRSSSPTFSQRVHCRTHGCSRDGEPLVNTHTNETFQDKANSLEATMLESISGKVSLGDSFAAPQKTAAYTKRDTGQNIPQDGCRHSHHTQGNNLNVERKDVEGQTCIGELQKQIMQTPSPIPLEQNGPQRLKGPLESQGGCNKEFLYPVEHMGINEGQTHKEGRPSEITGPLMSVEGCHREEPSSETHSLKVNSDKFVKVYSRQKPTSQSGARMSQPAIQHSSIPLCSLNPAATQPEVHNQPPVNSGGRLSSVIQCSDELKSEAQHLWNLGKELGMETKSDSSEFLQNYTSMECRDRDEAKDLGNRRFSQ

SEQ ID NO: 182952 - protein, 240 aa, Glycine max
  Coding DNA Sequence Number=SeqID_91267
  Homolog annotation: Hit_ID=Q2HTA0; Match level="QueryCoverage=73%, HitCoverage=26%, E-value=5e-17, Identity=35%"; Hit description=IMP dehydrogenase/GMP reductase, related
  Pfam annotation: Domain name=DUF1723; Domain location=156-205; Score =57.4; E_value=4.9e-14; Accession=PF08330.1; Description=Protein of unknown function (DUF1723)
MTRTRGLGRAIGRLIGRDRHDDHDAIDVLERRRSTASARRQQVHQMTADARDMTEDVPDLAEEAPEMRADVQGVDGVEGSDADDVEGSLGGPRDPSVLTSFADHVAHVAWSGQERPDLKLVSHGRKVTLIGRPVPEIEGLVGATRLSPLVDCSVVTGNLGLISAFVERWHNETSTLHLPVGELTITLDDVSSLLHLPITGALYSFHALSMDEVRFLLTQLLEVSTEEARAETTLTRGAYV

SEQ ID NO: 182953 - protein, 264 aa, Glycine max
  Coding DNA Sequence Number=SeqID_91268
MERIQKSTSSDNFQGWFHVTLLNSRDIILLGDTSWQSGLSAAMHHQRRKTLDEASLFQASQRPSMTTDRPPLLMAHIDPGIRPSISMCVRGVGAMYKHNNIAKPNSLTVPSGVANCHNLPFGEGAKRPKFDRPKHFSPKEKTSGVATNVYSRKTLEKIKKTQGVSLTPKYPKVLDLEMMFEKKRESLRHWTLKQSSQVRKAERIVKALHLEGSFKFERRRESLRRWTLNDLFKFERRRELLRRWTLNDSLNFERAKETVKALNL

SEQ ID NO: 182954 - protein, 131 aa, Glycine max
  Coding DNA Sequence Number=SeqID_91269
MWYSWMHFMTSAKLEATHGELLQWSIYYHERKPHACHWKSGKALPVLTYHKRLDRLRRLMIDGWTSLNTFALVGQICVAPRQCAVDYMEWFYMISHPSMSLTQPEDPPRHPPVVLHVYVRSRRRRQTHEDC

SEQ ID NO: 182955 - protein, 123 aa, Glycine max
  Coding DNA Sequence Number=SeqID_91270
MSSVIYDFKRTQRPLFLCFEKKREREELQCLHVSSVSLPWFSPVAWSNSKALGSPKPASGSPRPPENLGVKREGAKEKGSASYIERFLVKLVTRRNKKTKMRLRHFRIASVIHSYTVLHSSTD

SEQ ID NO: 182956 - protein, 108 aa, Glycine max
  Coding DNA Sequence Number=SeqID_91271
MTPTCGNCAVIRSLDDAFQIMRLTQSCSSVILPHREVIWVFKGQLAKCLAVAFIGPPSLKMSGRSAALVSNVREQEVHSYCEYFVKGFYKESGKSQVGCLRTGRRHRK

SEQ ID NO: 182957 - protein, 193 aa, Glycine max
  Coding DNA Sequence Number=SeqID_91272
MGRNMLPERKVEFYHTELDDFKAELERRNFHKRLTNLVDGSIDLALVKEFYANLYSSKECPPKQSRVRGHLVKIDVDSLNTFLETPVVLAEGETLPTYSRYYRLPIDFREIEAALCIPGRGFILNSKGHPGKIHRKDLTTLAQVWSVLSHFNLAPISHTSDLTVDTARLIFGLVSHLDMNIGALIFGQMTSIA

SEQ ID NO: 182958 - protein, 151 aa, Glycine max
  Coding DNA Sequence Number=SeqID_91273
  Homolog annotation: Hit_ID=UPI00016621D1; Match level="QueryCoverage =76%, HitCoverage=40%, E-value=4e-13, Identity=38%"; Hit description =UPI00016621D1 related cluster
MIGTSKPYTGAMRGIVHETQVDIGADQKGLHVLAFKGLHILTFRGLYILAFKGLHILAFRGLHALTFRGLHVLTFRGLHAFTFLGLHVLTFRGLHVLAFRGLHVLAFRGLHALTFRGLQVLTFRGLHAFTFLGLHVLTFRGLHVLAFRGLH

SEQ ID NO: 182959 - protein, 36 aa, Glycine max
  Coding DNA Sequence Number=SeqID_91274
MTVKKRLSHEVLKVTVELSSSVGLTAHPPLSIASAR

SEQ ID NO: 182960 - protein, 94 aa, Glycine max
  Coding DNA Sequence Number=SeqID_91275
LGRIDGDPVLRETRIWATWEYVSSVGGGQQGMETLGTSGGVPLPKTKLDQSRPNPGIVAVNFVCGLWPLVIDYQGLENEVRKLGKPLVIDYQGV

SEQ ID NO: 182961 - protein, 981 aa, Glycine max
  Coding DNA Sequence Number=SeqID_91276
  Gene Ontology: Mol. function=binding; Cellular component=integral to membrane; Biological process=porphyrin biosynthetic process
  Homolog annotation: Hit_ID=A7MQJ4; Match level="QueryCoverage=38%, HitCoverage=94%, E-value=1e-152, Identity=70%"; Hit description =Putative uncharacterized protein
  Pfam annotation: Domain name=HemY_N; Domain location=1-114; Score =145.7; E_value=1.3e-40; Accession=PF07219.4; Description=HemY protein N-terminus
  Pfam annotation: Domain name=TPR_1; Domain location=309-342; Score =24.3; E_value=0.00046; Accession=PF00515.19; Description =Tetratricopeptide repeat
  Pfam annotation: Domain name=TPR_2; Domain location=309-342; Score =33.0; E_value=1.1e-06; Accession=PF07719.8; Description =Tetratricopeptide repeat
  Pfam annotation: Domain name=TPR_2; Domain location=99-132; Score =10.7; E_value=1.4; Accession=PF07719.8; Description=Tetratricopeptide repeat
  Pfam annotation: Domain name=TPR_4; Domain location=100-124; Score =6.2; E_value=7.1; Accession=PF07721.5; Description=Tetratricopeptide repeat
  Pfam annotation: Domain name=TPR_4; Domain location=244-269; Score =6.6; E_value=6.3; Accession=PF07721.5; Description=Tetratricopeptide repeat
  Pfam annotation: Domain name=TPR_4; Domain location=309-334; Score =12.2; E_value=1.4; Accession=PF07721.5; Description=Tetratricopeptide repeat
  Pfam module annotation: Pfam domain module=HemY_N::TPR_1::TPR_2::TPR _2::TPR_4::TPR_4::TPR_4; Domain location=1-114::309-342::309-342::99 -132::100-124::244-269::309-334
MVAGHQGYVLIQTDNWNIDTSVTGLAIILILSLLVILLVEWILRRLFRTGARTRGWFTGRKRRSAQRHTQSALMKLAEGDYRQVEKLLSKNADHADQPVANYLLAAEAAQQRGDEIRANQHLERASELSENDTIPVEITRVRLQLARNEDHAARHGIDRLLEVAPRHPEVLRLAEQAYIRTGAWGALLDILPSMQKAQINDENQRNALQQQAWLGLMNQAMADQGSEGLKKWWQNQSRKTRQETALQVAMAEHLIECDDPDTAQSIVLEGLKRQYDDRLVLLMPRIKSGDPQALEKALRQQIKQHGATPLLHSTLGQLLMRHGEWQQAAEAFQQALAQRPDGFDYAWLADVYDRLHRPEDAAKMRREGNTASIRERQIKKHLPEAGVRSGALHHSQVYVALANIRGGMSIYAEIIAQSVPEWHESRERLRCRENATDRFEAVSAERQAVQGKGLEPSRSGVANGTRTHDNWNHNPGLYQLSYSHHYYFLLTRAALYPAELRARSAVAGGDTTDLRQSCLVLFRRNVAFDYALLTPAHKSALRSPFSPFIGAFLPDFQPDDGNARIRVDSHADQHANQKSDGQIVHIREHDRLKAVVFDRFLMGAAEIELAYQHHEPRHHARQHARAVDINENLLRIRDDVVQRGAHQQAADGDGDAVHRHAAGGKLGERRRQLAVLGQGVQHAAAAVHATVATGERGGQHHEVDDAGGGNDADLGEGQHERAAGGADAVPREDGDNDEDRTDIEDQDAPQDIVDRAFQRHLRVLGFPGGDAHQFNPLIGRHHDAQRKQEAFPAAGKETAVRRQIGETDRFTAVAEAEEDHPQPHQNHHDDGGDLDHGEPELQLTVQAHRRQVGQRDHRHGDQRRHPLRYFREPELHIHPDGGDFRNADGNPHKPVAPGGQVTEVGIHVLMRVNGKRPGDRLEEQHFPHRTHNEEHEQPGDDVSQQHRRPRPFQRTGRAHKQADTDGAPQSDKLDMPGLKAP

SEQ ID NO: 182962 - protein, 152 aa, Glycine max
  Coding DNA Sequence Number=SeqID_91277
  Pfam annotation: Domain name=zf-CCHC; Domain location=80-97; Score =14.6; E_value=0.0094; Accession=PF00098.14; Description=Zinc knuckle
MELLRLNQHEENDKKKKRITLKASLSIQEESDKEDSIDLDEEEDLSLFVKRFNKFLRMRGTQRRQNFKPKRMTEESSQTPRCYECNQLEHLRVHCPIFKKRMEKFEKKNIGEKKAKKAYITWDDNDLESSDDYEKEVINLCLMGKNYENDEE

SEQ ID NO: 182963 - protein, 122 aa, Glycine max
  Coding DNA Sequence Number=SeqID_91278
  Homolog annotation: Hit_ID=A0ST23; Match level="QueryCoverage=20%, HitCoverage=51%, E-value=3e-07, Identity=100%"; Hit description =Putative reverse transcriptase
MASKDLEKTTFVTIWETFCYKVMSLRLKNARDQAYRYRRPRGGARYQLLFPLVRVNFELGVIMVIAVSFGKPVVPAALMNRPTRGERRFAYWALAECILAYYVGTDEGVSEVLHVAREKCCT

SEQ ID NO: 182964 - protein, 103 aa, Glycine max
  Coding DNA Sequence Number=SeqID_91279
MTSGASRDLHIVQQRVPSILKRPIKGCMSSSNNPRMKLGYSLEIPNKGVWKQSLQAYFDDAKDSSQESRFKQVSRTKKSFNQDSSEDSREDSRYARTSRKASR

SEQ ID NO: 182965 - protein, 59 aa, Glycine max
  Coding DNA Sequence Number=SeqID_91280
TYQGNPCGVYPDLSSFTRSGVYPDLSSFTGSGVIQTSVACIKQSASTQVHIIWYQSFGS

SEQ ID NO: 182966 - protein, 70 aa, Glycine max
  Coding DNA Sequence Number=SeqID_91281
MYGFLEPQSIQRSSQSQFEFGDYIKKWMQNSQRYVYIGASLNGALKRLNDNKGSKSKATVKWIPVKYLLI

SEQ ID NO: 182967 - protein, 179 aa, Glycine max
  Coding DNA Sequence Number=SeqID_91282
MEFGDIVVHFNILDAMKHPSEDHSIFCAEIIDQIVDDYMFDFDPLHDRKHPFLSDLHTCHFLCIDSEPEFEFDPVSDFYAKSEFEFESDVVPLDVDFLESECTNHVAGSTYTSNFLYEVQAEEPSSSPTLVPPTVQPPPTPELKPLPATLKYAYLELLFSVYAYMFLVEVGIVGARYAG

SEQ ID NO: 182968 - protein, 260 aa, Glycine max
  Coding DNA Sequence Number=SeqID_91283
  Homolog annotation: Hit_ID=Q2HW90; Match level="QueryCoverage=87%, HitCoverage=57%, E-value=9e-27, Identity=32%"; Hit description =Putative uncharacterized protein
MGQLQRQAFRKAYGKIWDLARVEVSMEPIASLSQYYEQPLRCFTFEDFQLVPTVKEFKEIRGCPLGGRKPYLFSGFYPSTTRVAKEWGSRSTKEVFGGKGKGLGKSRNGLSFIDILALLIFGVVIFPNMEGLVDLAAIDAFLAFHHGKESPVVAILAMYDTFDRGCEKSSARIVCCALALYVWLKEGRIRILSSCEGCPNVPLMGTRGCINYNPVLAIRQLGYPMRGVPSDESITPFIARGFSDHNARVLQGVRKAWDAA

SEQ ID NO: 182969 - protein, 172 aa, Glycine max
  Coding DNA Sequence Number=SeqID_91284
MAPRKLASKRSRKDKAAEGTSSAPEYDSHRFRSAEHQQRFEAIKGWSFLRERRVQLRDDEYTDLQEEIVRRRWASLVTPMAKFNPAVVLEFYANAWPTKEGVRDMRSWVRGQWIPFDADAISQFLGYPLVLEEGQECEYGQRRNRSDGFDEEAIAQLLCIPGQDFARTVQGG

SEQ ID NO: 182970 - protein, 210 aa, Glycine max
  Coding DNA Sequence Number=SeqID_91285
  Homolog annotation: Hit_ID=Q6WAY4; Match level="QueryCoverage=88%, HitCoverage=33%, E-value=1e-20, Identity=34%"; Hit description =Putative uncharacterized protein
MGANQNSKRFYQVKVKGLDVTSLKELGRLMGPLQRQAFRKVYGKILDLTIAEVFMEAIVSLTQYYDQSLRCFTLGDFQMVPTIEEFEEILGCPLEGEKTVSFLRFLPSLSKIAAVIGDSAKELDRMKQIRNGVVGLPQKYLEGKARDMASQEKWGPFADILALLIYGVVLFPNVDGLVDLATIDAFLAYHHSKESPVVAILADLFDTFDR

SEQ ID NO: 182971 - protein, 105 aa, Glycine max
  Coding DNA Sequence Number=SeqID_91286
VVCAEDDINLRVSTGLLAAIDKGCLRMPPDSWVTVTKVGWSTKAGLLLPLRGEKVASAQDFVDNQRERTTLGRGQGLTFSPWVKVYGKLGFWLKACRTTGHDICQ

SEQ ID NO: 182972 - protein, 76 aa, Glycine max
  Coding DNA Sequence Number=SeqID_91287
MAAEWRRKRERRCHFKEKMSLEEAHHHRRPWIRAWRKKEMNERRGREEHEILCSKRALKSEPTNPRSIPRFSTKCA

SEQ ID NO: 182973 - protein, 42 aa, Glycine max
  Coding DNA Sequence Number=SeqID_91288
NLIFVKLNDDAQSEEDLDDDGDGDESDDIHGDDPIRGYDMLL

SEQ ID NO: 182974 - protein, 66 aa, Glycine max
  Coding DNA Sequence Number=SeqID_91289
MARYAPKVRRKMWGESFNDVDVAIFGQTYDDFLPMKGPVTRAMSKRLQEDWARAAEEGPRVLMNLR

SEQ ID NO: 182975 - protein, 185 aa, Glycine max
  Coding DNA Sequence Number=SeqID_91290
LVYNALGGRIASTIHHPMLYMCPTRTPTTPLLFPLKANNPEPKDHALADFEPYLGYVIVGSAFGGMPQPNTSEERLMAIEGIGDHPFADMAELCLVPDVVIISQEPPEDVLSKDRAQVAPLMMERRRIKMIVDTLPVFYYEKMVGYMPSSFTDLVFVGERIEVGLRRGKFDYVASTSAGNRRTDI

SEQ ID NO: 182976 - protein, 229 aa, Glycine max
  Coding DNA Sequence Number=SeqID_91291
  Gene Ontology: Mol. function=subtilase activity; Biological process =proteolysis
  Homolog annotation: Hit_ID=Q33BC0; Match level="QueryCoverage=78%, HitCoverage=19%, E-value=1e-08, Identity=27%"; Hit description =Transposon protein, putative, CACTA, En/Spm sub-class
AEFEIPEASDNRTKKKILQIVGERWRQFKSDLTSKWALSADQDGVDDTVCEKYDISKEKWAKFCQRRRDPSWEDVRKKAQTIQKQNTAPHKLEEAAQFGTADGVIDPPSPIRRHVKWKMVCIKKTGQMTSEAAKEIAEKIASQGSFVPHGRQDVLTAAIGRAEHPSHVCGVGARVTIKQYFGSAPQTQMQSQMQSQGLALPPELMVGPSSPHVITKESYVDPSGNDPET

SEQ ID NO: 182977 - protein, 85 aa, Glycine max
  Coding DNA Sequence Number=SeqID_91292
MLCVIDYKDLGTSFVVQVEGTSTWVVVTENKKGYISYGSVLVEGTSTRLLKENKGGYIPCGSLLVKAFTRLKRNLKDRRSLGDWM

SEQ ID NO: 182978 - protein, 128 aa, Glycine max
  Coding DNA Sequence Number=SeqID_91293
MASKKRKTSAYSSTQARFDRSRFHSQEAWERYTDIIVPRKLLPERNVEELERRKWDQELTSFTKGSIDVAIAKEFYANLYDPEDKSPKQVRVRGHLIKFDEDTLNTFLKTPVVLEEGKIFVLILYLHS

SEQ ID NO: 182979 - protein, 90 aa, Glycine max
  Coding DNA Sequence Number=SeqID_91294
MTFRGPRKARGVQPSPIGGGGASVTQEPESVEPAEVPTIEDDELIPPDPASGIAQEEALASEMILEPSPTPIFEDILPSSPAMEPEQPTI

SEQ ID NO: 182980 - protein, 194 aa, Glycine max
  Coding DNA Sequence Number=SeqID_91295
  Pfam annotation: Domain name=Transposase_23; Domain location=72-142; Score=-14.2; E_value=0.042; Accession=PF03017.5; Description =TNP1ENSPM transposase
MFLSLWWWFGGKQRWPPVVVWVVEGELYGLVGGLERKRVKIMFFTLKNVGPSATCIITKESCVNPSRQDPNTSDSEKCGLYVDENPPRLVSLGRVYEGSTIIYNIPLGNDQVKVDVEEVRNVDARIPISTQEVQLVGQTLNTFLAWATHLVKHLSEYDKQKTEGPAKLVDRLDPDVDPLYLMTLTISQLFLKLL

SEQ ID NO: 182981 - protein, 78 aa, Glycine max
  Coding DNA Sequence Number=SeqID_91296
MDHQKRKTQDEASLLSSESETQHDHRSTSTPYGSHRPGGVAIFCNLPYDGRARRKAKGASSEGENEQESPPMFIRGKR

SEQ ID NO: 182982 - protein, 144 aa, Glycine max
  Coding DNA Sequence Number=SeqID_91297
AGDHKISPHATESLSLDDKGAKFVYARLPPNLLLLNDKGKNARPTGSRMSSGLPPLDYKRCRRRQIVCAEDDVNLRVSTGLLAAIDKGMIEIVCAEDDVNLRVSTGLLAAIDKGMTEIVCVEDDVNLRVSTGLLAAIDKGCRRQ

SEQ ID NO: 182983 - protein, 345 aa, Glycine max
  Coding DNA Sequence Number=SeqID_91298
  Homolog annotation: Hit_ID=A5B3T6; Match level="QueryCoverage=80%, HitCoverage=68%, E-value=6e-11, Identity=22%"; Hit description =Putative uncharacterized protein
NPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLAGEDPHKNLKEFHIVCSTMKSPDVQEDHIFLKAFPHSLVGSGKGLAILPCSKYMERSMIDAASGGALGDMTPAEAINLIAKMASNSQQFSVRSDVIVIRGVHEVATNSSSSAETKKLEGKLDALVNLVTQLAMNKKSAPVARLCGLCSSADHHTDLYLSVQQSKAIEQPEAYAANIYNRPPQPQQQNQPQQNNYDLSSNRYNPRWRNHPNLRWSSPSQQQQQQ

SEQ ID NO: 182984 - protein, 233 aa, Glycine max
  Coding DNA Sequence Number=SeqID_91299
  Homolog annotation: Hit_ID=UPI00006A2D9E; Match level="QueryCoverage =81%, HitCoverage=97%, E-value=3e-16, Identity=17%"; Hit description =UPI00006A2D9E related cluster
  Subcellular localization annotation: CTP_CleavageSite=16; ConfidenceScore=5.03e-01
RAARPRHQRTTRPSPSDDYTSSLSEDCASSPSENFTSSPSQDCRSLAFRRLHALTFRGLHVLAIRGPHALTIRGLHVLAIRGLHALTFRGLHVLSIRGVHALTFRRLHVLAIRGPHALTFIGLHVLAIRGLHALTFIGLHVLTIKGLHAVTFKGLHVLAFKGLHALIFGGLHALDFRGQHVLAFRGLHVLAFRGLHVLVFRGLHVLAIKGLYALAIRGLHVLAIIGSHALTFR

SEQ ID NO: 182985 - protein, 49 aa, Glycine max
  Coding DNA Sequence Number=SeqID_91300
MDSGRFQVSVLGNSYPLGVILRAFRSVFKGYTTNCLPFSGISEPRLEVG

SEQ ID NO: 182986 - protein, 84 aa, Glycine max
  Coding DNA Sequence Number=SeqID_91301
MKVEEEPQLLVVFVVTTIVAIAVLEEEHMACLDQQHSEKEGQAVVVAEDLSILDLDDSSNLDCIYCLKGHNYSVVVGFAAEEVY

SEQ ID NO: 182987 - protein, 293 aa, Glycine max
  Coding DNA Sequence Number=SeqID_91302
  Gene Ontology: Mol. function=helicase activity; Cellular component =nucleus; Biological process=viral genome replication
  Homolog annotation: Hit_ID=Q2R1R7; Match level="QueryCoverage=99%, HitCoverage=27%, E-value=6e-64, Identity=50%"; Hit description=AT hook motif-containing protein, putative
  Pfam annotation: Domain name=DUF889; Domain location=14-231; Score =180.8; E_value=3.6e-51; Accession=PF05970.5; Description=Eukaryotic protein of unknown function (DUF889)
MQAVNNNEGDMFFLYGYGGTGKTYIWRTLASSLRAKNQIVIMVASSGIASLLLLGGKTVHSKFKIPMPIFEDSTSNILQGIKSTFPDLYQHHSNPEFFKSRAILASTNETVEKVNDYILSLIPGEQMEYLSSDYIEKSETIDSWHFQSITTEFLNSLNTSGLPNHRIKLKIGSPIMLLRNLDQTQGLCNGTRLIVTRLAKHVITAEIISSKNVGDNVYIPRMSMSPSQSPWPFKLLRRQFPIMLSYAMTINKSQGQSLSMVGLYLPKPVFSHGQLYVALSRVNSRQGLKVLIS

SEQ ID NO: 182988 - protein, 99 aa, Glycine max
  Coding DNA Sequence Number=SeqID_91303
MAFLGETSSQTIVNSRLTFIFPNGTVIHNECGVYFQSSSPVPMRVPNLYDFSTLKSRIHNSLQLNNNQVVDEIHYRRPVEDTGGTCHAKTTLWVTRSPE

SEQ ID NO: 182989 - protein, 123 aa, Glycine max
  Coding DNA Sequence Number=SeqID_91304
  Subcellular localization annotation: CTP_CleavageSite=37; ConfidenceScore=5.21e-01
MIAHSIKGCRPLGRTCGVLIPSPSRLFRFFRRFPQINVGGDSARIPFVEHASRESRVALPPKGRLRHYLIVTGEPIHEGKQSEIGRIILEDINVRQRKIVLGTGSIQVPIIYTHSHLPILLRD

SEQ ID NO: 182990 - protein, 219 aa, Glycine max
  Coding DNA Sequence Number=SeqID_91305
MRCKQIAMIMMKDYGKPIIMATPPASPPQSNQQSEAIDFRSHARLKTLPYLFSLSSSCLKSLFSFSFRPKSAGNRSVDTHIVVGRTHRTPYTAGKPTLSSLEPTEPPTLPENPYCRRSNPTEPTLSWVEENPRYRVATRVLKQSSVLKGQTFLCEAPLTNVCCWVLFIKRINHDFCRWIHRVVEIACNCFNILLSNRGGFTIVVLTYFLFLEQVMLKYR

SEQ ID NO: 182991 - protein, 45 aa, Glycine max
  Coding DNA Sequence Number=SeqID_91306
  Subcellular localization annotation: CTP_CleavageSite=25; ConfidenceScore=5.02e-01
MYPLLFSVTTTQVDVPSTCTTKDVPSNALRQRKGKNQKNSQTVSF

SEQ ID NO: 182992 - protein, 110 aa, Glycine max
  Coding DNA Sequence Number=SeqID_91307
MAPKKLSTKRSRRDAIGEGSSAAREFDSHHFRSAKHQQRFEAIRGWSFHRERRVQLREDEYTDFQEEIAHRCWTPLVTPMAKFDPEIVLEFYANAWPQKTEFKDMRSWVR

SEQ ID NO: 182993 - protein, 19 aa, Glycine max
  Coding DNA Sequence Number=SeqID_91308
MAQGKFVPNLGQLLSRYES

SEQ ID NO: 182994 - protein, 178 aa, Glycine max
  Coding DNA Sequence Number=SeqID_91309
  Homolog annotation: Hit_ID=Q6UUU1; Match level="QueryCoverage=33%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPVTIVLSPTRKDMQKHHWQQPLDKFGDCAPPSQLPRFKELVAQRTFEKPPCKA

SEQ ID NO: 182995 - protein, 67 aa, Glycine max
  Coding DNA Sequence Number=SeqID_91310
NETVSQSRPEDADTSKKGAGDDVSHYLLFRLANETRPEDADISGKGAANETFSQSRPEDADISVKGA

SEQ ID NO: 182996 - protein, 98 aa, Glycine max
  Coding DNA Sequence Number=SeqID_91311
  Subcellular localization annotation: CTP_CleavageSite=59; ConfidenceScore=5.10e-01
MTDRLNESISCFLIRVNPWRTTRPRHQRATRPRHRKATHPHLPRTTCPHLQRAKRPRLRRATRPHLPRTTCPHLQRTTCPRHQRTTRPRHQRAARPHL

SEQ ID NO: 182997 - protein, 87 aa, Glycine max
  Coding DNA Sequence Number=SeqID_91312
MAKYEPEIIMEFYANAWPTEEGVMDKRSWVWRQWIPYDEDAINQFMGHPLVLEEGKHCEYGKRKSQVSGFDEKAIGQLLCSPGQDFA

SEQ ID NO: 182998 - protein, 72 aa, Glycine max
  Coding DNA Sequence Number=SeqID_91313
  Subcellular localization annotation: CTP_CleavageSite=63; ConfidenceScore=5.34e-01
MGVQIATWHTRAFQDVPPEGGCFWRKQPSSPGRAGKSKPRRFRNVSVGDFAKIFNRSSTFFVPSSSFFDLQP

SEQ ID NO: 182999 - protein, 103 aa, Glycine max
  Coding DNA Sequence Number=SeqID_91314
  Subcellular localization annotation: CTP_CleavageSite=23; ConfidenceScore=5.06e-01
IPLQLNYSSSCGGPTTSKDGSWRSSVVSGGGGGAWGHWGGFRGRGGGRKWLFHTASLKNLGELASGDYPTFGALIWRRELIDLTLLLLTGSESILFGVGSLGI

SEQ ID NO: 183000 - protein, 147 aa, Glycine max
  Coding DNA Sequence Number=SeqID_91315
MVERENFDHIEERPTTIKGGGDYAFADMAELCPVLDVGIPPKFKVPDFNKYKGTTCPKNHLKMQYQYNSDMAPDKMQLQNMCKREHESFKEYAQRIEVGLRRGKFEYPTLMNRKPRANGENKKEGGTHAMTVIPSWPNFPPAQQYQY

SEQ ID NO: 183001 - protein, 79 aa, Glycine max
  Coding DNA Sequence Number=SeqID_91316
MSEQPKQSSQGVSSWGGAASGISGIGVPPLTEARTAGGAAIGSSGTGVSEGTAIGIGGTCLHGQSRHWSWRDRLWFKII

SEQ ID NO: 183002 - protein, 156 aa, Glycine max
  Coding DNA Sequence Number=SeqID_91317
  Subcellular localization annotation: CTP_CleavageSite=49; ConfidenceScore=5.15e-01
QLISDAIYQFVGIIPPRHPMDPKKSYRALGFSALITVLHAKASTAAKARLAAAAGRRRTTTTSTAATISRHLADQQAANHRGQVQLNDSFYQYTLHQQRQDPSPYPWPTLEQFRANVAWLRDRPNFQAGAGPIEAPGDEDEAEEDGDMENEMDFFL

SEQ ID NO: 183003 - protein, 101 aa, Glycine max
  Coding DNA Sequence Number=SeqID_91318
MWAIIDQYKEKLNLVATHEQRQEDEYAKVSVLQAEREVRERLIDSLHREAMMWMDRFAFTLNGSQELPRLLVKAKAMADVYSVPEEVHGLLDYCQHMIDLM

SEQ ID NO: 183004 - protein, 105 aa, Glycine max
  Coding DNA Sequence Number=SeqID_91319
MTTFKVPNCTLTILRKNCPKISTHKWKFGNLLEAPNTLPMKGLFVTKLESNEVLLSPIALKVVGPLLLDSNSSRDGTNRPFQFLIWQLTNKETKRQAITKDKKMN

SEQ ID NO: 183005 - protein, 118 aa, Glycine max
  Coding DNA Sequence Number=SeqID_91320
  Subcellular localization annotation: CTP_CleavageSite=38; ConfidenceScore=5.30e-01
GVTPIVSSPSVPLCVAQRSLSFVLVNPNARLRSQDYLREATKGRIEGVFSTESLRRILRIPLRLQRSSWCVGLAASNGSSWWPPVVVSCGEGSVRISLSELVSLSGSLLFALSASIRT

SEQ ID NO: 183006 - protein, 61 aa, Glycine max
  Coding DNA Sequence Number=SeqID_91321
MDLSSIFTLERLDGTSYPEWHQKGKKVESPKENSTAATEIVAKSGTFQPICGFSVTTKGSD

SEQ ID NO: 183007 - protein, 69 aa, Glycine max
  Coding DNA Sequence Number=SeqID_91322
MGAKYLEAVKQRLHAIKQWSRMKLGKDILDDVAESLERMHIHGQDSKGKGKGSNEDPPKEAKSNDELPK

SEQ ID NO: 183008 - protein, 61 aa, Glycine max
  Coding DNA Sequence Number=SeqID_91323
MFLVFNSALKELDDTPQPNSEVGDRWIVVKYFDDVRPLEAERLKALRIQWAQYYLKVRNQT

SEQ ID NO: 183009 - protein, 30 aa, Glycine max
  Coding DNA Sequence Number=SeqID_91324
GSRVPIDPKRIKVIPEWPTPPSVEGRSPEF

SEQ ID NO: 183010 - protein, 72 aa, Glycine max
  Coding DNA Sequence Number=SeqID_91325
MTWHDTWTCLLKDATSFDDNKTKRKRERRRHFKEKMSLEEAHHHRRPWIRAWRKKEMNEGRGREEHEILCSK

SEQ ID NO: 183011 - protein, 201 aa, Glycine max
  Coding DNA Sequence Number=SeqID_91326
MAPRKLASKRSRKDKAAEGTSSAPEYDSHRFRSAEHQQRFEAIKGWSFLRERRVQLRDDEYTDFQEEIVRRRWASLVTPMAKFDPDIVLEFYANAWPTEESVRDMRSWVRGQWIPFDADAISQFLGYPLVLEKGQECEYGQRRNRSDGFDEEAIAQLLCIPGQDFCPDCCRETSANHAHQHDHPDPDMDDIATRQHPAQRS

SEQ ID NO: 183012 - protein, 82 aa, Glycine max
  Coding DNA Sequence Number=SeqID_91327
MVILRPLSFRSSESSDKHAETNYGHSAPSVIQGQRSSSMARRDKLWSFYALPPRLDRVQGHVEKNYGHSAPCVNQKEQTRQY

SEQ ID NO: 183013 - protein, 219 aa, Glycine max
  Coding DNA Sequence Number=SeqID_91328
MRTNMLANHGGSTMNAVEEWESRGLKHIRDVSTSRWFILEALREANVIDLDSDKGDPCLMHPGASHDVETCPVTEELLQGMINRGQIEIRSSKKKEGETPAPFPYKSDKAIPCKYGVRGPDERQDVFVIRVGNDLPSAKITNISGTSGMTHSGRIFTTPELSTRSKDKGKAKADIGKRERADPTVNDEVLVGKIAEEGDDFRMREISAEEVTKFMRIIQ

SEQ ID NO: 183014 - protein, 131 aa, Glycine max
  Coding DNA Sequence Number=SeqID_91329
  Subcellular localization annotation: CTP_CleavageSite=52; ConfidenceScore=5.20e-01
MGLKVESVAINSSADRLKKKWLGVIAAASWRTKVMGRSESVTKVYVRRKVVLASRGQAQYPKSPTVNSVTSLQSVCIPSDQEEELERQYALVKDLELTHGGAASKVQQFMKDMDTRDNKMAVEMGIKKQLL

SEQ ID NO: 183015 - protein, 137 aa, Glycine max
  Coding DNA Sequence Number=SeqID_91330
MEAMKERMAIMMEAMMSMKKIMEVNAAIVAATSTIAEVDLTPPPYGLNQINHPTSDMVGLEGKELGGTDDPHLVRKTSMPSYHMACLPTIRHPMWCTLPMKMSITPLPYSLRADNPKLIMHMSLKPWGRHMKFPTTI

SEQ ID NO: 183016 - protein, 49 aa, Glycine max
  Coding DNA Sequence Number=SeqID_91331
MTTMMETMMSMRQLMEVNMATVVAASTTTEVDPTHPSGLNQVNRPVSDM

SEQ ID NO: 183017 - protein, 136 aa, Glycine max
  Coding DNA Sequence Number=SeqID_91332
MFLLHPLLLYNNFFLLLLLMGRLFGLDLSLLLPKDPFNLYSKAKSFQSLVFINNSLGQFLLPLLLNVILVYNTEVLLSSDEAALVDNGLLGVIIHSFEDVEDLVFQKNFVDEVGIVDVIHSSQSLHIPQDVDLDCV

SEQ ID NO: 183018 - protein, 42 aa, Glycine max
  Coding DNA Sequence Number=SeqID_91333
  Homolog annotation: Hit_ID=A5B591; Match level="QueryCoverage=80%, HitCoverage=3%, E-value=9e-09, Identity=79%"; Hit description =Putative uncharacterized protein
YDGSGEQRLGPSALFLKECGIVPQYTMPSKPSMNCRMTKPNS

SEQ ID NO: 183019 - protein, 122 aa, Glycine max
  Coding DNA Sequence Number=SeqID_91334
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQPVTSVQELVAQRTFENRPAR

SEQ ID NO: 183020 - protein, 160 aa, Glycine max
  Coding DNA Sequence Number=SeqID_91335
  Homolog annotation: Hit_ID=Q6UUU1; Match level="QueryCoverage=43%, HitCoverage=47%, E-value=2e-21, Identity=74%"; Hit description =Putative uncharacterized protein
HLIKFDVDSLNTFLETPMVVEQGESLPSYSRFARLRPDPQELAARLCIPWRGFVLNAEVGKPVVPAALMNRPTRGERRFAYWALAECILAYYVGTDEGVSEVLHVAGEKRLHRCVSRICDTGYIPLPRSLTRYARSFDCGERKWLYERGGDFLEDARKNT

SEQ ID NO: 183021 - protein, 159 aa, Glycine max
  Coding DNA Sequence Number=SeqID_91336
MASRKRKAAASLSQARYDRSRFVSQDAWDRYADNDLGQKILPEINVKLYITEFDEFRREIERRNWHKELTNFSEESIDVALGKEFYANLYDPKDKSPKQVRVRGHLIKFDDNALDTFLKKPVVIKEGESLPSYSRRAASEDFEEESYYSGPDLECPILF

SEQ ID NO: 183022 - protein, 49 aa, Glycine max
  Coding DNA Sequence Number=SeqID_91337
MATMMEAMLSMNKIMESNAAAFATISAAIEVDPTHPSGMNQISRPIPDV

SEQ ID NO: 183023 - protein, 64 aa, Glycine max
  Coding DNA Sequence Number=SeqID_91338
MGTTWQAWWSSLRIVEGLGWVTRLHMPTRGSHVVATYPLEGGDARLTGVSSKGGKCTESPPMFI

SEQ ID NO: 183024 - protein, 205 aa, Glycine max
  Coding DNA Sequence Number=SeqID_91339
MVKEECKEVSVSSKRLANKESHFAIKIKIKETSPLRQPPHLFLCKKTLVSTATPLGLEVIPQVKKLLDKGLVHKSLNPCALLVPKIGIFRHQIPNISDMMNVLSVATLFCKITHAPNIFMIHVHWDSVGRFVLIFGFNTNLGAHMGYPSDQGVPTDPKRIKVIPDWPTPPSIREIWGCRGVTNFYKRVFPSLLYILECDEEIRPT

SEQ ID NO: 183025 - protein, 379 aa, Glycine max
  Coding DNA Sequence Number=SeqID_91340
MTGERSMFLDLNLVEGGTISFGGIGMGNITGIGKIDIPSLASMKEQMTTIMEAMMDMRKIMEVNATAAATAYTTTKRDLTHPPIFNQESHLVSDVGGQGGVAGVVAYGPQYTQSHNRYIFPPYGLPPNYTPPMVVPVPAENVTNLIPVCTENHQTQPDQTQAYNSNAMEEAQEAPIDHTITGFKPHPGYIAEGHAFSGVLVLNTLGASQYRPLSQSLHFMRGEGAPAVFEKEKIEHIEERLRAIEGGGSYGFADMLELCLVPDVTIPPKFKVMPPMAEREMITMIMDTLPVFYYEKMGKFDYATSTNSGSMRLGMNGVKKREGEAQVVAMVPTWTNFLQAPYNPMVLDRRLQEDWARAAKEGPGVLMNLRVDFLSPWAK

SEQ ID NO: 183026 - protein, 129 aa, Glycine max
  Coding DNA Sequence Number=SeqID_91341
  Gene Ontology: Biological process=cell division
  Homolog annotation: Hit_ID=A9PI29; Match level="QueryCoverage=32%, HitCoverage=16%, E-value=5e-15, Identity=88%"; Hit description =Putative uncharacterized protein
MDLILVHPPHLIALACIYIASVLREKDTTAWFEELRVDMNVITFWILIKRIHEIPFEKARASASLGEADPVAVVVMGRGLCCKLSRGRCASRKCCALNLRPLGEIIRYLQEIENKGVQDFYTFPAILDE

SEQ ID NO: 183027 - protein, 134 aa, Glycine max
  Coding DNA Sequence Number=SeqID_91342
MSEIYPYISAPMFMSIFITGPQTNLALSRLRSESCKILAQELPWQALNVKNKSSSKDTQSGCQLLRVWPQPVEPRVRRLKKGIMTLKACLAPFSRLARKRQPPCLASYIRAKRMLAWTNSLQAYPYALSHCCLT

SEQ ID NO: 183028 - protein, 61 aa, Glycine max
  Coding DNA Sequence Number=SeqID_91343
MGHLSDQGVPTDPKRIKVIPDWPPPPSVEGRSLEYEEPWDLRSNPFQGGGDDAILPPKGIG

SEQ ID NO: 183029 - protein, 193 aa, Glycine max
  Coding DNA Sequence Number=SeqID_91344
MHYIIVRILLFRSSNLAQAFEEDLILMWAFLTSRQIDWAHLIRYRMHKALRANAPLPYPHLVTLFLHHFKIPLEDEPFVQVKRSFAIGVGAIILFGYRKDDDGQWVRKQDLPQPIPDERTLSPPPQRVDSSSLLNDVLSELHSLRAFVGDRFDAMDTPLDAMDAHFDGMDTRITRLEDDMSFIRRCFDPPANP

SEQ ID NO: 183030 - protein, 94 aa, Glycine max
  Coding DNA Sequence Number=SeqID_91345
MDLEGKCRGICFGAVATYPSAGGRRVTRGMRVPRKEYARSRHQRLFEENVGKTGKDAIYELLSERFGSCIYARGRVFPFAPTYSSIWDEKIRPT

SEQ ID NO: 183031 - protein, 215 aa, Glycine max
  Coding DNA Sequence Number=SeqID_91346
  Gene Ontology: Mol. function=transporter activity; Cellular component= membrane; Biological process=transport
  Homolog annotation: Hit_ID=P0AGM8; Match level="QueryCoverage=45%, HitCoverage=22%, E-value=5e-41, Identity=89%"; Hit description =Uracil permease
KRKSAQYANRLSPRVGRFINAAGTTGFPTGKRAIIPVPVMGGVSLLLYGVIGASGIRVLIESKVDYSKAQNLILTSVILIIGVSGAKVHIGAAELKGMALATIVGVGLSLIFKLISVIRPEEVVLDADESEKACSQRRGSLKDDVYNRAKDRPVLSWQSRPAGMQAWHWPSFYNVVTGKTLALPNLIALQHIPLSPAGVIAKRPAPIALPNSCAA

SEQ ID NO: 183032 - protein, 115 aa, Glycine max
  Coding DNA Sequence Number=SeqID_91347
MSTHCRYVGGITRGIKEHDKCWIYEHFSSVGSALDAEDYDERRPRACRWTSSRALPVSTYHKGLDRLTPDVVCWISCGDHYSFREFEIISLFFDHLRWGSLTVIHRPNRVVRQFG

SEQ ID NO: 183033 - protein, 185 aa, Glycine max
  Coding DNA Sequence Number=SeqID_91348
  Homolog annotation: Hit_ID=Q6CQE3; Match level="QueryCoverage=16%, HitCoverage=26%, E-value=7e-09, Identity=87%"; Hit description =Kluyveromyces lactis strain NRRL Y-1140 chromosome D of strain NRRL Y- 1140 of Kluyveromyces lactis
  Subcellular localization annotation: CTP_CleavageSite=12; ConfidenceScore=5.12e-01
MIRFSGLLTTSRAANRSRRRNPNTSPDHSIGRSDGRLRSRSLTELTRQIAPPTKNGHAPPPIESRKSSQSVNPYYVWTCTGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 183034 - protein, 53 aa, Glycine max
  Coding DNA Sequence Number=SeqID_91349
  Subcellular localization annotation: CTP_CleavageSite=41; ConfidenceScore=5.11e-01
MVESSKKRKGSSSTTAAAGHRRHRPSEAPTTPIHPSLSSPRSSTLFSSDDQRL

SEQ ID NO: 183035 - protein, 56 aa, Glycine max
  Coding DNA Sequence Number=SeqID_91350
MHPASHASPSRRRVGYDKVVLNEKIIQSTSGAASQSQDQAENIASSMTFDESNWFP

SEQ ID NO: 183036 - protein, 86 aa, Glycine max
  Coding DNA Sequence Number=SeqID_91351
MPRNFTNYLTMGVKYFEVVKRRLHATKQWSPNKIRFKRNIIRPVNIPTSGTCHSERKKRHQKRQQNFSVLKAIKWDNHDISPRHRT

SEQ ID NO: 183037 - protein, 190 aa, Glycine max
  Coding DNA Sequence Number=SeqID_91352
  Homolog annotation: Hit_ID=Q84VH6; Match level="QueryCoverage=93%, HitCoverage=12%, E-value=3e-07, Identity=28%"; Hit description=Gag -pol polyprotein
MDDYKFLQTKLEIFKKDHHAECMKMQTKLSYLKYFFGKLNKEKSDLNHMLNVQKHTIDKTDLGYNKQTSFSKKTQFVSSKGVNPTKVSKKRNMVYSKINAKTCHYCMKKGYTSYNFYVRRFDIQRGQCTWIPKDLFVKINPIRPNLNWVCLKARDSLRYLDSGCSRHMMGDKSKLSDFVSKDGGYVTKLR

SEQ ID NO: 183038 - protein, 207 aa, Glycine max
  Coding DNA Sequence Number=SeqID_91353
  Pfam annotation: Domain name=Transposase_23; Domain location=49-119; Score=7.3; E_value=0.00019; Accession=PF03017.5; Description =TNP1ENSPM transposase
  Subcellular localization annotation: CTP_CleavageSite=32; ConfidenceScore=5.18e-01
MASFSHLQSQMQSQGLAVPPEPLVGPGPSGPRVSTKGSCVDPSGNDPETGDSDRCGLYIEADPARLVAIGRVYEGSTVVHNTPLLPGQVKVSVEEVRDADALVPVPTDEVSLVGQALHTFIAWPTHLVVVSPPKPPPKPDPEVNDPLYLMTLTIPELFLRPYQVRWDATVFGVVNPDFPLYIKHEDLSEIAHGGQCLSISVLQLWIL

SEQ ID NO: 183039 - protein, 86 aa, Glycine max
  Coding DNA Sequence Number=SeqID_91354
MELQRLNQNEDTDKRKRSIALKASSSMQEEEEEEEESDDEEDFSLFVKKFHKFVINRRMERSHNFNNGKKSQEVSPTLKCYKCNQP

SEQ ID NO: 183040 - protein, 199 aa, Glycine max
  Coding DNA Sequence Number=SeqID_91355
MDMNLGYLISYQISLISQHDTSRLGFPALIAALCKARGDQSDSRSLENLSSAINLANIKKNYWNLDDPIVTFRGPRKARGKRSEVPTTSAPPETPAPSSSIAPVPSLAPVIPPTSTQLPPSPYGGGKAPTAQEPALEEPAATAEGEDELTLPEPFYFDVDAHMAQEEGTSTDQIHEPSSAPVPEETQPSTPIMETEQPI

SEQ ID NO: 183041 - protein, 56 aa, Glycine max
  Coding DNA Sequence Number=SeqID_91356
MVIFNRGVGVENEGEEHIPRICQRHLSIFPLDAIRMEGVTLAHGKGICHKNMPRTS

SEQ ID NO: 183042 - protein, 48 aa, Glycine max
  Coding DNA Sequence Number=SeqID_91357
MACTNIPVEAKMIHKRFSSNFSQSALIRLCTLRFKVIQCSMECPGTPL

SEQ ID NO: 183043 - protein, 54 aa, Glycine max
  Coding DNA Sequence Number=SeqID_91358
MVPFIAPVQGFEAQSLSFAMTLQQGTYWVRTSNLPLGLRGTNYCLVFTPRSEEE

SEQ ID NO: 183044 - protein, 68 aa, Glycine max
  Coding DNA Sequence Number=SeqID_91359
MALGKVYDSLSTIHNVPYAEDVVRVSVVKVYHSDAQLPFLTSEIQFVRQVVGTFVGWSTHLMKPVSNE

SEQ ID NO: 183045 - protein, 76 aa, Glycine max
  Coding DNA Sequence Number=SeqID_91360
MAPKKISKKRSRRDAAAKGSSVAPKFDSHRFRSTEHQQRFEAIKGWSFHRERRVQLKENEYTYFQEEIVLDRVTSE

SEQ ID NO: 183046 - protein, 342 aa, Glycine max
  Coding DNA Sequence Number=SeqID_91361
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=54%, E-value=1e-180, Identity=77%"; Hit description =Photosystem I P700 chlorophyll a apoprotein A1
  Pfam annotation: Domain name=PsaA_PsaB; Domain location=32-342; Score= 171.9; E_value=1.7e-48; Accession=PF00223.10; Description=Photosystem I psaApsaB protein
MIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQIWRASGITSELQLYCTAIGALVFAALMLFAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFM

SEQ ID NO: 183047 - protein, 315 aa, Glycine max
  Coding DNA Sequence Number=SeqID_91362
  Gene Ontology: Mol. function=oxidoreductase activity; Biological process=electron transport
  Homolog annotation: Hit_ID=A8GHZ7; Match level="QueryCoverage=100%, HitCoverage=57%, E-value=2e-49, Identity=80%"; Hit description=Twin -arginine translocation pathway signal precursor
MSELAIRYLQQTTHDFQTVGIDGTSCSDARICDLPGLDGMNLPPLDEESQADLDDPYVFHVPDGNATLARLMARKLIPTVAPAGQDMDDVVLAKFDYGQLDRPESPVKHAFEQHRAACGQRRRQGGSHLHDRREDDQGARRAGGDGRLQHDDPIPGAGDVARAAGGAEAERQVAAGVQQGGDPQLATVHQAGRARDLFAGRAVQPREAGLPGEHGRMIREQLQGMLGEAGFDHQRDIQAITVNRWSHGYSYFLNGLFDDEDEATKIIETARQPIGKIVIANSDADWSPYANSAIDQAWRAVNELAYGKVAAKEGA

SEQ ID NO: 183048 - protein, 55 aa, Glycine max
  Coding DNA Sequence Number=SeqID_91363
MYICVEMAPRKLSSKRSRKEAAAVGTSATPEFDSHRFRSAEHQQHFEAIKGWSFH

SEQ ID NO: 183049 - protein, 136 aa, Glycine max
  Coding DNA Sequence Number=SeqID_91364
  Pfam annotation: Domain name=Transposase_23; Domain location=47-117; Score=15.0; E_value=2.7e-05; Accession=PF03017.5; Description =TNP1ENSPM transposase
  Subcellular localization annotation: CTP_CleavageSite=30; ConfidenceScore=5.29e-01
MASFSQMQSQMQSQRLALPPKPLVGPLGPRVSTKGSCVDPSGNDPKMGDSDRCSLYIEANPDRLVALGRVYEGSTIVHNTPLLPSQVKVGVEEVKDEDAPVLVPTDEVSVVGQAIHTFLAWSTHLVKSLSQQRASN

SEQ ID NO: 183050 - protein, 208 aa, Glycine max
  Coding DNA Sequence Number=SeqID_91365
MYELYVLELGRKGCAEVTIFKTGYIVFKGGTQEWAYGFNAGMFGSRSVPAVGVSLGIERVFATMEQTKGSATNSHQHMNSRRKMGKAWSLEEGQYHIKDMICDMILFYGGAGTSGGGNDKSIVNHAAQIAHIPNQNATSQQQFQTQQRKMRILGGNLELEPLRNINVQPLAQAMVNESTGATNVVSSLGTQIQTVEPSNAMYCTRQMK

SEQ ID NO: 183051 - protein, 195 aa, Glycine max
  Coding DNA Sequence Number=SeqID_91366
  Gene Ontology: Mol. function=DNA binding; Cellular component=nucleus; Biological process=regulation of transcription
  Homolog annotation: Hit_ID=A7NV85; Match level="QueryCoverage=40%, HitCoverage=16%, E-value=3e-17, Identity=50%"; Hit description =Chromosome chr18 scaffold_1, whole genome shotgun sequence
MEDDILRDQIGVHGTEKWYTYLNSDFKKGGWSLEEDKLLCEKTWVVQSLRLEPTIVKEQYLQRLMGEVEAKSNFLVQDLLRVGQCQSVVTNGSLPVSPMLPVQGKEGSNIPINCKVDSYRCQLIVMEIFVVVLGILWGVRGALVKAEFNNGGNVDKLWFASMVGPIGVWIRWFLASLNGRGLGKPGFFKWIQLMI

SEQ ID NO: 183052 - protein, 32 aa, Glycine max
  Coding DNA Sequence Number=SeqID_91367
MAVKEGFALREWRRQNAIQLEVKEKKETEMRL

SEQ ID NO: 183053 - protein, 265 aa, Glycine max
  Coding DNA Sequence Number=SeqID_91368
WLQEKEKARLSGPNLTMMQGGLPQKKPGIDIPTTELERRNLHKRLTNLANGSIDVVVVKEFYANLYDPKDNSPKQVKVRGHLIKFNANTLNTFLGTPVVLEPGETIPIVARLYILGRGFVLNAEGMSWKLLRRDLTTLAQTWSVLSYSNLAPTSHTSDLNLDRARLGFPALITTLCKARGVTSDSLSCESLSPTINLTYIKRNCWNLDEPLVYFPVTHMARARAAKIPSSSTPQDPLVPTFALPPAPAHPGLSIDLIMAMLQSLY

SEQ ID NO: 183054 - protein, 66 aa, Glycine max
  Coding DNA Sequence Number=SeqID_91369
  Subcellular localization annotation: CTP_CleavageSite=42; ConfidenceScore=5.11e-01
MLYHPQGNSLSVSTRHSHLGKLGSLGYSSSMDSFASWKMNGNGMEKEEREETTLQGEDESRRSSPP

SEQ ID NO: 183055 - protein, 395 aa, Glycine max
  Coding DNA Sequence Number=SeqID_91370
  Gene Ontology: Mol. function=transporter activity; Cellular component= integral to membrane; Biological process=transport
  Homolog annotation: Hit_ID=A6T920; Match level="QueryCoverage=97%, HitCoverage=93%, E-value=1e-116, Identity=55%"; Hit description =Putative tranport protein
  Pfam annotation: Domain name=MFS_1; Domain location=25-357; Score =176.5; E_value=6.9e-50; Accession=PF07690.7; Description=Major Facilitator Superfamily
  Pfam annotation: Domain name=Sugar_tr; Domain location=19-392; Score=- 89.2; E_value=1.7e-05; Accession=PF00083.15; Description=Sugar (and other) transporter
  Pfam annotation: Domain name=Voltage_CLC; Domain location=62-385; Score=-185.6; E_value=0.1; Accession=PF00654.11; Description=Voltage gated chloride channel
  Pfam module annotation: Pfam domain module=MFS_1::Sugar_tr::Voltage _CLC; Domain location=25-357::19-392::62-385
MSLDTEVVETSIAVEKPAWGAVFAMAFGVFGLITAEFLPVSLLTPIADSLRVSEGQAGQTVTVTALVALLTSLVIGNVTRRLDRRLVMLAFTLLLIASALLVAFAENLPMILLARVLLGMAIGGFWTLSTAITMRLVPADQVPRALSIVFSGISLATIIAAPLGSYLGGLIGWRNIFLLTGVLGVLALFWQFFTLPSMPPENKARSGGVLDLLRQSVMRWGMLAVIMMFTGHFAFFTYLRPFLETSAQLNVNQLSLVLLAFGVANFFGTSLAAWLVTRSVSLTLTGMALVMSVTAVLLVSFGHVSWLVASGVALWGLAFGSMPTGWSTWLSRAVPDDAESGGGLLVATIQLAITAGAAAGGWMFDLQGAGGVFLASGVLMLLAAITIFTRVRHHG

SEQ ID NO: 183056 - protein, 49 aa, Glycine max
  Coding DNA Sequence Number=SeqID_91371
MTKARQKGGKEGEACHPARPGELGCFRCLLEELPGRPKWAWLLFAPPIY

SEQ ID NO: 183057 - protein, 133 aa, Glycine max
  Coding DNA Sequence Number=SeqID_91372
FQQGPYNQQGQWRSHPGNQFNKDYGGPSNRPIQQGPNIFQRTTKLEETLTHFMQQITDKSSNSFVANTKRNPKEECKVVMTRSKRFVEAEDEESGMHKKKAAEKKGVEGKRKDVRGESNQEKEKQRMVKKKRI

SEQ ID NO: 183058 - protein, 179 aa, Glycine max
  Coding DNA Sequence Number=SeqID_91373
  Subcellular localization annotation: CTP_CleavageSite=50; ConfidenceScore=5.23e-01
MSFLGETSSQTIANSRLAFIFSNGSITHNQTGVYFQSPTPTPMRVPNDCSFDTLKRRMYNTLQLTNDQLVDEIYYRQPFINAELLCTIIRTPDAILNLLQSTITPTRDALMYYNGKWNIPRQGKFLGYSFTGTNPIRFGIPSGCSMDKLKDLIKQVAPIEFPLMEFTNPNWLDNCSFDN

SEQ ID NO: 183059 - protein, 141 aa, Glycine max
  Coding DNA Sequence Number=SeqID_91374
MGTNHTGKRFYQVKIKGLDVTSLKELGRLMGPLQMQAFRKAYGKILDLTIAEISTEVVDVLLGEGNRIFSPGCGKGFNKRVQLCKANSKRHSGPTTEVLRRQGKGNGESRGVGPVYGCISIANLWGCPLSKRAWFGGPSRN

SEQ ID NO: 183060 - protein, 338 aa, Glycine max
  Coding DNA Sequence Number=SeqID_91375
MAPRKLASKRSRKDKAAEGTSSVPEYDSHHFRSAVHQQRFEAIKGWSFLRERRVQLRDDEYTDFQEEIGHRRWASLVTPMAKFDPEVVLEFYANAWPTEEGVRDMRSWVRGQWIPFDADAIGQLLGYPLVLEEGQECEYGQRRNRSDWFDEEAIAQLLCIPGQDFARTAAGRRVRIMRTNMTTLTQIWMTLLLSNILPTDHNSDLPLPKCQLVYAILTRMSIHVAQLITDAIYIFAGMAPTRHPLDPDKSNRALGFPALITGLCQSFGVPVAPTKVIRPPITWAFIEKYCTQRQAQGDAPQAAGAPPPPHQAGQAGSFDMEQYLRHLVRQQAANHRAH

SEQ ID NO: 183061 - protein, 26 aa, Glycine max
  Coding DNA Sequence Number=SeqID_91376
VTCAPELISKFVQSKITRSTRLVGVS

SEQ ID NO: 183062 - protein, 184 aa, Glycine max
  Coding DNA Sequence Number=SeqID_91377
  Subcellular localization annotation: CTP_CleavageSite=25; ConfidenceScore=5.27e-01
MSSTNKRWWRLCTFSSFGRRTREPRLARLQKGRLRQQVLHNNNSLSLLSRMLLVQESHMFLLQYSSNNNSSHNKELVRQMTIQNIQFQQETRASIQSLTNQIGHMATQMNQAQSQNSDKLPSQTVQNPKNVSAITLRSGNQIQVHPPVAAPTPEKKDEIFAQKRKLPNKKFYAGRPSSSNSDLQ

SEQ ID NO: 183063 - protein, 111 aa, Glycine max
  Coding DNA Sequence Number=SeqID_91378
MPLSAAADSLAVTSHCCSAGCHTLISSGDLCLVACNFCLVLVRCLAPIIRQFVKFRDMPEIKRSKNGGANSNQAHLGPPEGCCFWRKQPCSPGRAELAWASWVASFSPNFL

SEQ ID NO: 183064 - protein, 217 aa, Glycine max
  Coding DNA Sequence Number=SeqID_91379
QKLLAEKTKKKLEECAQSGSIDGIIDPPSPVRRHVKWKMACTKKTGEMTTKAAKEIAEKIIRSFIPHGRQDVLTAAIGRPEHPGHVRSAGAADPSNQGPARGVHHRKHDATTHGIVQPDVVPDSVPDAISGTCTASRASGWSLRCGLYIEADPNYLVALRRVYEGSTIVHNTPLLPGQVKVGVEEVTDADAPVPVSINEVSLARQAIHTFLAWPTHL

SEQ ID NO: 183065 - protein, 93 aa, Glycine max
  Coding DNA Sequence Number=SeqID_91380
  Homolog annotation: Hit_ID=A5AYU6; Match level="QueryCoverage=79%, HitCoverage=13%, E-value=2e-13, Identity=43%"; Hit description =Putative uncharacterized protein
MEKSDKKTFKDKKGKKTCITWEDNDMDSSGDSENEVVNLSLMAKNYESEEEDSLKQSWYIDSGCSKHMTGDASKFTHISPKNSGHMTYGDNNK

SEQ ID NO: 183066 - protein, 114 aa, Glycine max
  Coding DNA Sequence Number=SeqID_91381
MEHFLEQVAWPEAQLPLVRPNEAAPPKPTPVQVVPEPADPQSLVVNPPSSPEHEVVPPSPPLIVISDASSDEAVAPPDSPARETADPPTSPVGGIVDLSDSSFGEVVALTDSPV

SEQ ID NO: 183067 - protein, 54 aa, Glycine max
  Coding DNA Sequence Number=SeqID_91382
MERELITMMVDTLPVSYYEKMVGYMPSSFANSVFAGERVKVGLRRGKFDCLALT

SEQ ID NO: 183068 - protein, 86 aa, Glycine max
  Coding DNA Sequence Number=SeqID_91383
MSSNLNYMLKGREVLKELPPEIVKLYEEIKTLRDKLGKFVGGHEALNKIIKVQRNLKDKSIHGHETHKCKDLHEKGNPSRGLSSAY

SEQ ID NO: 183069 - protein, 126 aa, Glycine max
  Coding DNA Sequence Number=SeqID_91384
MGAKHLTRTKEWSHVIKQRSPDEIRGEIVEAKLHDGVLMITMMTTKDDDKGDEQKAQRSKNNSSESKNISSESRTSQEFKNQEEFKTQEESLESRIKIQDSRSQESRSRFKTQDSRMKKRLNQDKY

SEQ ID NO: 183070 - protein, 132 aa, Glycine max
  Coding DNA Sequence Number=SeqID_91385
  Homolog annotation: Hit_ID=A5AK77; Match level="QueryCoverage=47%, HitCoverage=7%, E-value=8e-07, Identity=42%"; Hit description =Putative uncharacterized protein
MTRGNPSNLQPFDPEIDRTFHRLVRHHLVPFEHPEHFVIGDFEHYCFEHSDFEHSENMTQPPPRERTLREMAAPDFTYENLFIQYPDEGVPYVLKTGLIHLLPKFHGLAGEDPYKHLKEFHIVCSTMKPPDV

SEQ ID NO: 183071 - protein, 26 aa, Glycine max
  Coding DNA Sequence Number=SeqID_91386
DSLEDQASQGSFVAHGCQDVLNTAIG

SEQ ID NO: 183072 - protein, 38 aa, Glycine max
  Coding DNA Sequence Number=SeqID_91387
MWTTTGEKLAAQLAQVSQVASSRSNNLLEESSGRPKWA

SEQ ID NO: 183073 - protein, 153 aa, Glycine max
  Coding DNA Sequence Number=SeqID_91388
VDPKKSNRALGFPALVTGLYQSYRVPVPPRQGHVIIGIAPARHPVDPKKSNRVLELSSSKYGSLSVQGSACCPQQGHQAPYQSSFHLEVLRPQAGAGRDTTAALGWTVAGNRHTAITTKVHLSSSIKSRMHLVAHDPGDLNKTSASSEGRKIP

SEQ ID NO: 183074 - protein, 141 aa, Glycine max
  Coding DNA Sequence Number=SeqID_91389
MADTELSIACVDRLEAAMAKLAAIQTSIAADQTSITSKLDAIIRILNTMVPKQPSPSSASAKSPPMPPLLPKTTNPTSSSAKPPPTAETMLPPLPMATFHLPVNKHHALSFESLPVASHRSHTKSSSHGILPSDIHFSLSV

SEQ ID NO: 183075 - protein, 45 aa, Glycine max
  Coding DNA Sequence Number=SeqID_91390
SWRYAQAIGNRQSNWRVPIAEGSRPSSCHGSAAERKSPLVQAICR

SEQ ID NO: 183076 - protein, 218 aa, Glycine max
  Coding DNA Sequence Number=SeqID_91391
  Gene Ontology: Mol. function=transferase activity; Cellular component= cytoplasm; Biological process=auxin mediated signaling pathway
  Homolog annotation: Hit_ID=Q948X4; Match level="QueryCoverage=97%, HitCoverage=99%, E-value=1e-89, Identity=74%"; Hit description =Glutathione S-transferase
  Pfam annotation: Domain name=GST_C; Domain location=108-203; Score =68.0; E_value=3.2e-17; Accession=PF00043.16; Description=Glutathione S-transferase, C-terminal domain
  Pfam annotation: Domain name=GST_N; Domain location=2-77; Score=89.6; E_value=1e-23; Accession=PF02798.11; Description=Glutathione S -transferase, N-terminal domain
  Pfam module annotation: Pfam domain module=GST_C::GST_N; Domain location=108-203::2-77
MATIRLHGNPFSTATMRAAASLHEKQLEFEFVLIDMKNGEHKKEPFISLNPFGQVPAFEDGDLKLFESRAITQYIVHEYADKGTQLISKESKKMAKLRLWLEVESQHYDQPASKLVWELMVKPMYGLPTDPAAVEENEGKLGTVLDFYEKTLSQSKYVAGECFTLADLHHLPTIHYLMKTQSKKLFESRPHVGAWVADITARTAWSKVLAMQPLLSSK

SEQ ID NO: 183077 - protein, 976 aa, Glycine max
  Coding DNA Sequence Number=SeqID_91392
  Gene Ontology: Mol. function=nucleoside-triphosphatase activity; Cellular component=protein complex; Biological process=cell division
  Homolog annotation: Hit_ID=A7Q0A4; Match level="QueryCoverage=93%, HitCoverage=79%, E-value=0.0, Identity=67%"; Hit description =Chromosome chr7 scaffold_42, whole genome shotgun sequence
  Pfam annotation: Domain name=AAA; Domain location=869-975; Score =24.7; E_value=1.2e-07; Accession=PF00004.20; Description=ATPase family associated with various cellular activities (AAA)
MMFCNNALFVGGLKWGEENCLELIFLLFMLLQNPHVCMTEPIFTVGQGQHCNLWLKDPTIGSVLCKLSHIERGSSSGALLEITGSKGSIHVNGKTYRKNACLILSGGDEVVFGSSAKYAYIFQQLTNSIISTADIASSVSILEAQSAPINGMQVEARSGDLSAVAEASILASLSNNICKELSLLPPAAKTGKNVQQNTDISSLHSGCGDDITDNEMSDTTNNDEPAGDFSADKTVLGSSTTVNENPNLGSAEVDTNIDADVGKMTTATYELRPLLRMLTGSCPEFDLSGSISKILEGQRELRELLKDVDTPTVLASTKRLAFKDSLQQRILKAEKIDVSFETFPYYLSDTTKNVLIASTFIHLKCKGFGKYASDLPSVSPRIVLSGPAGSEIYQETLSKALVKHFGARLLIVDSLSLPGGSPSKEVDSAKESSGAEKPSVFSRKRNFQTAMLQHKKPASSVNAEIIGGPMLISSASSKGATLRKGDRVKFIGSFPSAVSSLPNYISRGPSYGSRGKVLLAFEDNGSSKIGVRFDKSIPDGNDLGGLCEDDHGFFCSANHLLQVDGSGGDDLDKVAINEIFEVASNQSKSGALVLFIKDIGKAMIGNYEILKSKFESLPPNVVVVGSHTQLDNQKEKAQPGSLLFTKFGSNQTALLDLAFPDNFSRLHDRSKETSKVMKQLNRLFPNKVTIQLPQDEALLSDWKQQLDRDIETMKAQSNVVSIRLVLNRIGLDCPDLETLCIKDHTLTTESVEKIIGWALSYHFMHSSEASIRDSKLVISAESIKYGHKILQGIQNENKNMKKSLKDVVTENEFEKKLLTDVIPPTDIGVTFDDIGALENVKETLKELVMLPLQRPELFGKGQLAKPCKGILLFGPPGTGKTMLAKAVATEAGANFINISMSSITSKWFGEGEKYVKAVFSLASKIAPSVIFVDEVAKHLGNPPLKDSCSGRRTKHLNTPPSTWGIPYYSIWGLGAP

SEQ ID NO: 183078 - protein, 281 aa, Glycine max
  Coding DNA Sequence Number=SeqID_91393
MEGILKMEDLFKKWTEYLDSTQSRVSHPRPKLHPYNQYEEERTPNLKGVFANFMAYHASSTANQNSMQNQEIQIGKSYSIENYQWEQELQPYNQIEEERISNLDNLLMQFKETTESTQRAFKSLEIQVGKLAKEMAKFVAIREENFVEVEAQEERPVKENDSREKDEEKIKDKAQQWEKYSQEERHGEQEKALSVLLSSITSTSLAMIWKVLPEYMSFMESLAKRRKYKKDVFYVTFMPLGRHLTHQANAVKKGSNTGNVAYQFYGNVGSMKASVSSSIGV

SEQ ID NO: 183079 - protein, 352 aa, Glycine max
  Coding DNA Sequence Number=SeqID_91394
  Gene Ontology: Mol. function=metal ion binding; Cellular component =intracellular; Biological process=regulation of transcription, DNA -dependent
  Homolog annotation: Hit_ID=A7PTY7; Match level="QueryCoverage=86%, HitCoverage=91%, E-value=1e-64, Identity=42%"; Hit description =Chromosome chr7 scaffold_31, whole genome shotgun sequence
  Pfam annotation: Domain name=zf-B_box; Domain location=56-97; Score =8.1; E_value=0.018; Accession=PF00643.15; Description=B-box zinc finger
  Pfam annotation: Domain name=zf-B_box; Domain location=8-55; Score =38.9; E_value=1.9e-08; Accession=PF00643.15; Description=B-box zinc finger
  Pfam module annotation: Pfam domain module=zf-B_box::zf-B_box; Domain location=56-97::8-55
MMNGSPNSKQRTCDYCGSFTALLYCRADSAKLCFFCDRKVHFPNQLFSKHKRAQLCDACGDSPASVLCSAENSVLCQNCDCGKQKHLVSEAHQRRPLEGFSGCPSVTELLTILGLSEKSLLSNEGTSQIDDDLSDLHVWSAPSINGLEDLITTTASSQKKRKGACGRHKEEILSQLRELIKLEPDLIHAERQGQFGNLPTDFERDVEANIFPSYEVGVFCWHGESSDPRNQIVPSDTSPLRDYGDIVSAEDGSFTITVTHANFNNQGKPSNSFNAENLSPTPKATPYELTSHERDSALLRYREKKKSRSATKTKDSSCMMVKELLCTANASEYYAEKPQLRAFYKEPKVQNR

SEQ ID NO: 183080 - protein, 391 aa, Glycine max
  Coding DNA Sequence Number=SeqID_91395
  Gene Ontology: Mol. function=serine-type endopeptidase activity; Cellular component=chloroplast thylakoid membrane; Biological process=proteolysis
  Homolog annotation: Hit_ID=O82261; Match level="QueryCoverage=79%, HitCoverage=53%, E-value=1e-136, Identity=77%"; Hit description =Protease Do-like 2, chloroplast precursor
  Pfam annotation: Domain name=Trypsin; Domain location=124-300; Score =67.9; E_value=3.4e-17; Accession=PF00089.17; Description=Trypsin
  Subcellular localization annotation: CTP_CleavageSite=75; ConfidenceScore=5.80e-01
MAVALSSCTSLSSVLFSTVKFRYSLRHRPIVASFHCNNHPLRVSSSSSSSSSSKSNRKKEGAGHKKQSKDERPARGNVLESQPTSSKPFGIQRKNKDLIFDSKDQQVEQSILQDSAFLNAVVKVYCTHTAPDYSLPWQKQRQYTSTGRQDFENLDCRVVKVKKRGDDSKYVAKVLARGVDCDIALLSVESEEFWRDVEPLRLGRLPHLQDSVTVVGYPLGGDTISVTKGVVSRIEVTSYAHGSSDLLGIQIDAAINPGNSGGPAFNDQGECIGVAFQVLRSEEAENIGYVIPTTVVSHFLTDYERNGRYTGFPCLGVLIQKLENPALRAWLKVQSNEGVLVRRVEPTSDANNVLKEGDVIVSFDDVRVGSEGTVPFRSNERIAFHFLISQK

SEQ ID NO: 183081 - protein, 409 aa, Glycine max
  Coding DNA Sequence Number=SeqID_91396
  Gene Ontology: Mol. function=nucleic acid binding; Cellular component= ribonucleoprotein complex; Biological process=mRNA processing
  Homolog annotation: Hit_ID=A7PU04; Match level="QueryCoverage=99%, HitCoverage=98%, E-value=1e-152, Identity=64%"; Hit description =Chromosome chr7 scaffold_31, whole genome shotgun sequence
  Pfam annotation: Domain name=RRM_1; Domain location=121-190; Score =49.9; E_value=9.2e-12; Accession=PF00076.13; Description=RNA recognition motif. (a.k.a. RRM, RB
  Pfam annotation: Domain name=RRM_1; Domain location=17-89; Score =50.4; E_value=6.3e-12; Accession=PF00076.13; Description=RNA recognition motif. (a.k.a. RRM, RB
  Pfam annotation: Domain name=RRM_1; Domain location=329-400; Score =86.5; E_value=8.4e-23; Accession=PF00076.13; Description=RNA recognition motif. (a.k.a. RRM, RB
  Pfam module annotation: Pfam domain module=RRM_1::RRM_1::RRM_1; Domain location=121-190::17-89::329-400
MAEGKEESKSSEESVKLFVGQVPKRMSEDEVLAMFKELALVDEVNIIRDKATRASRGCCFVICPSREEADKAVNACHNKKTLPGYYSPDWEASYFLCPIQASSPLQVKYADGELERLEHKLFIGMLPKNISEDEVSNLFSKYGTIKDLQILRGSQQTRCAFLKYETKEQAFTALEAINGKHTMEGSSVPLVVKWADTEKERLARRAQKTQSRVSNAPHADPQHPSLFGALPMGYVPPYNGYGYQAPGGYGLMPYRFPPVQNQPGFHNMNQANAVRPDLGHSMNPRNYPAPPASYIGSYPAVPGGNSNSSSSGASKSSSGQIEGPPGANLFIYHIPQEYGDQELTTAFQPFGRVLSAKIFVDKVTGVSKCFGFVSYDTPEAAQAAISTMNGCQLGGKKLKVQLKRDNKQS

SEQ ID NO: 183082 - protein, 531 aa, Glycine max
  Coding DNA Sequence Number=SeqID_91397
  Gene Ontology: Mol. function=snoRNA binding; Cellular component =nucleus; Biological process=rRNA processing
  Homolog annotation: Hit_ID=A7PU09; Match level="QueryCoverage=99%, HitCoverage=95%, E-value=1e-167, Identity=56%"; Hit description =Chromosome chr7 scaffold_31, whole genome shotgun sequence
  Pfam annotation: Domain name=U3_snoRNA_C; Domain location=377-525; Score=165.7; E_value=1.2e-46; Accession=PF09384.1; Description=U3 small nucleolar RNA C terminal
  Pfam annotation: Domain name=WD40; Domain location=117-156; Score =20.8; E_value=0.0052; Accession=PF00400.23; Description=WD domain, G- beta repeat
  Pfam annotation: Domain name=WD40; Domain location=160-199; Score =38.3; E_value=2.7e-08; Accession=PF00400.23; Description=WD domain, G-beta repeat
  Pfam annotation: Domain name=WD40; Domain location=204-241; Score =28.5; E_value=2.5e-05; Accession=PF00400.23; Description=WD domain, G-beta repeat
  Pfam annotation: Domain name=WD40; Domain location=246-294; Score =18.2; E_value=0.031; Accession=PF00400.23; Description=WD domain, G -beta repeat
  Pfam annotation: Domain name=WD40; Domain location=75-113; Score =12.2; E_value=0.97; Accession=PF00400.23; Description=WD domain, G -beta repeat
  Pfam module annotation: Pfam domain module=U3_snoRNA_C::WD40::WD40::WD 40::WD40::WD40; Domain location=377-525::117-156::160-199::204 -241::246-294::75-113
  Subcellular localization annotation: CTP_CleavageSite=17; ConfidenceScore=5.06e-01
MEEARVQKNFPVKPKLKSMARTPKQTPESKYWSSFKTQQIPNLISVPSLTFSPTPPHSFAAAHSASLTLYSSQTLSPAATISSFSDAVSCASFRSDSRLLAASDLSGLVQVFDVKSRTALRRLKSHFRPVRFVHFPRLDKLHLISAGDDALVKLWDVAEETPVSEFLGHKDYVRCGDSSPVNSEIFVTGSYDHVVRLWDARVRDSKSSVQVNHGAPVEDVVFLPSGGMVATAGGNSVKIWDLIGGGKLVYSMESHNKTVTSICVGRIGKDYGEESSNQFRIMSVGLDGYLKVFDYGSLKVTHSMRFPAPLLSVAYSPDCSTRVIGTSNGVIYASKRKMKEKEKEEEESEASLVWRTAPVENTEKKAVRPSHFRYFHRGQGTKPSEGDFLVMKPKKKKWAKHDTLLNKFEHGEALVSVLGTMNPGHVVAVMEELVARKKFLKCVSNLDVEKLELLLEFLHKYCTMPRYSSLLMGFAKKVLEMRADDIRASDSEAIKSHIINLKRAVAQEIQIQQSLQEIQGIISPLLKIAGR

SEQ ID NO: 183083 - protein, 109 aa, Glycine max
  Coding DNA Sequence Number=SeqID_91398
  Gene Ontology: Mol. function=signal transducer activity; Cellular component=cytoplasm; Biological process=signal transduction
  Homolog annotation: Hit_ID=A7PU25; Match level="QueryCoverage=85%, HitCoverage=61%, E-value=1e-33, Identity=70%"; Hit description =Chromosome chr7 scaffold_31, whole genome shotgun sequence
  Pfam annotation: Domain name=Hpt; Domain location=42-109; Score=34.6; E_value=3.7e-07; Accession=PF01627.14; Description=Hpt domain
MLFWGKCLICCFLLAGRKGFLDDQFSQLQKLQDESTPDFVIEVITMFFDDSENLLKNMARCLEQVPADFKQIDAHAHQYKGSSASIGAARVKNVCATFRAFCEAKNQEG

SEQ ID NO: 183084 - protein, 262 aa, Glycine max
  Coding DNA Sequence Number=SeqID_91399
  Gene Ontology: Mol. function=endonuclease activity
  Homolog annotation: Hit_ID=A7PU33; Match level="QueryCoverage=26%, HitCoverage=19%, E-value=1e-27, Identity=84%"; Hit description =Chromosome chr7 scaffold_31, whole genome shotgun sequence
  Subcellular localization annotation: CTP_CleavageSite=2; ConfidenceScore=5.37e-01
ARPSSAPHPLLHHAQAPQQEPPPPPPPSPVANSPPLKVQSSSDQQAREERPKSPNRSKHEFFLHGSSQRAIGYSETHSGRDLQRRPVLHGTGAPETQTHVRGPKRGRFEPRKPEFAIQVHEGASQKHTETIAIAIAVAVSEEQSKRQRHQRGEQTRGGEVGEIEDEGFHKFTRQRDIAAAKPTIELLGTRQGLLEVDADVLGLQDVKAEEENGMKPLSDLAAALGMNYVFAESWAPEYGNAVLSKWPIKRWNSHKIFDHTDF

SEQ ID NO: 183085 - protein, 135 aa, Glycine max
  Coding DNA Sequence Number=SeqID_91400
MEKIIVSVQMHERCDGTQEISGYRTYLYLFQHGLHWLGVMMVQAGASHIVGWVGWSTSNPIGKVLALKVVRYCSAVVLICGGACVSDMSKGGVSLGIAMHACLSKSTVIPGLVTWPGDHLSVVLTKWDKASVSAC

SEQ ID NO: 183086 - protein, 1270 aa, Glycine max
  Coding DNA Sequence Number=SeqID_91401
  Homolog annotation: Hit_ID=A7PU36; Match level="QueryCoverage=94%, HitCoverage=52%, E-value=0.0, Identity=60%"; Hit description =Chromosome chr7 scaffold_31, whole genome shotgun sequence
MVRPNCISFGYIFLLLLWIIGRQLVERTKRQLWLPLKVYAILVFIFIYSLSSFSSLEMWLSKLIDLYFYLGYDSKASSFDNVWESLAVLIVMQLYSYERRKNKQNRQDHLDQLEPGALGFIRRFIIWHSQKILFIALFYASLNSISAFGFLYLVGLIFCSILPKTSSIPSKSFLAYTGFLVTAEYVFQMWGKQAKMFPGQKYSDISLFLGFHVFQPGFWGLESGLRGKVLVIVACTLQYNVFRWLERMPNTVLSKGQWEEPCPLFVPTEDVFIDDAMCNEESKSSYNSNLPSAIKEGVSGKSLQIITSGLSQALDTPSSKTGDSSDSSSKKYSFGFIWGSSKESQKWNKKRIVALRKERFETQKTVLKVYLKFWMENTFNLFGLEINMISLLLVSFALLNAISMMYIALLAACVLLNRHIICKVWPIFVFLFASILILEYLAIWKDMLPLNSHASRLIVDDPRMLISYFVVFMLACFKLRADRLPSFSGSSTYRQIMSQRRNTFVWRDLSFETKSMWTFVDYLRLYCYCHLLDLVLILILITGTLEYDILHLGYLAFALIFFRMRLEILKKKNKIFKFLRIYNFAVIIISLAYQSPFIGGPSAGKCETANNIYEMIGFYKYDYGFRITARSAIVEIIIFVLVSLQSYMFSSQEFDYVCRYLEAEQIGAIVREQEKKAAWKTAQLQQIRESEEKKQQRNMQVEKMKSEMLNLQTQLHSMNTSTNCIDGFSHNNEGLRRRRSVSLASNNDIGIPDKEDQVLGRLDHTIREDSVYPINLHEPSVCTNVETPSTEEYMKHSVDSDFCEITEVDIDTTSSDSGKREKFKGQAKENPLKSAVQLIGDGVSQVQFIGNQAVNNLVSFLNISPEDSDSNEHSNIEDSIYDEMESQKTQHIYMDRSSSVQSDKSSDAARLQLGRIFRYIWHQMCSNNDVVCYCCFVLVFLWNFSLLSMMYLGALFLYALCVNTGPSYIFWIIMLIYTELYILLQYLYQIVIQHCGLSIDPHLLRELGFPTHKITSSFVVSSLPLFLVYLFTLIQISITPKDGEWMSSTDFKFKRTDLHAKDDRTSYNWQDRAWDLLNQVINMVKLIIISFFRYWKSLTQGAESPPYFVQVSMDVNFWPEDGIQPERIESGINQVLRIVHNDKCKAKNPNLCSFASRVNVQSIERKWNKSLTPASDVAKEILKAQRAGFVEEMGFPYRILSVIGGGKREIDLYAYIFCADLIVFFLVAIFYQSVIKNKSEFLEVYQLEDQFPKEYVFMLMGRKSFSIIYK

SEQ ID NO: 183087 - protein, 131 aa, Glycine max
  Coding DNA Sequence Number=SeqID_91402
  Homolog annotation: Hit_ID=Q9SJS1; Match level="QueryCoverage=42%, HitCoverage=7%, E-value=4e-07, Identity=50%"; Hit description =Putative Athila retroelement ORF1 protein
MGTASGEVVPINLEIEATCRRNNAARRRREQDTEGSSHTSPPLSPQHAEMDGEPARRVTLEDFSNTATPQFFTSIARPEVQAANISYPHSLIQLIQGNLFHGLPSEDPYAHLASYIEICNTVKIVEVPEDA

SEQ ID NO: 183088 - protein, 458 aa, Glycine max
  Coding DNA Sequence Number=SeqID_91403
  Homolog annotation: Hit_ID=A7PU44; Match level="QueryCoverage=71%, HitCoverage=94%, E-value=4e-55, Identity=40%"; Hit description =Chromosome chr7 scaffold_31, whole genome shotgun sequence
  Pfam annotation: Domain name=BSD; Domain location=169-234; Score =64.9; E_value=2.7e-16; Accession=PF03909.8; Description=BSD domain
MNIFKSVFSEDPDPPRPGSNHASPDKAPDPHSPPRSNATESAAGGGGGDGWNFGGLIKTLTSKSESIIETYRRDLQEFGTGLKKEIEVAQGSLGTVGHVIDEFGNTVVKGTAQIISQGKDAILAVNLDSDSDSNSANRKSLDSVRYSRFDAQVRAIQGDVSTYSEEPEDLNEFNEWKLGFSLEGKGEEMEGLFRENDAMESVYKKVVPNSVDNETFWYRYYYKVYKLKKAEDVRVRLVSGISGEDEDLSWDVEDDENDDGGIRCDAKPVIMNKEVGGENVDNTHLHVDGNEEGTKRLDVEEESKEQKKDNLLESEEVGNKVDKSVEESQVEKSESVGDRGGVDEASKSKADDGVSKNDSTSESDEKVVKDREVGDEKTSGKGNESFTVEIQQSANKEEEDLGWDDIEDLSSIDEKKTMQSGGTSKVDLRKRLSAAEEDEDLSWDIEDDDDEPAKASSV

SEQ ID NO: 183089 - protein, 414 aa, Glycine max
  Coding DNA Sequence Number=SeqID_91404
  Gene Ontology: Mol. function=metal ion binding
  Homolog annotation: Hit_ID=Q1RSJ8; Match level="QueryCoverage=63%, HitCoverage=77%, E-value=1e-113, Identity=78%"; Hit description=Zinc finger, RING-type
MIPWGGLSCCLSAAALYLLGRSSGRDAEILKSVTRVNQLKELGLCLFRELKPLLSPHLGVGELLRHELGVEFGPNSNSKMVSESMLAVVIKPYQASHYRTIIKPHACWASPSQLLDIPLDCFQGPNVVGFWLESSMWLWFLIMLGIPYFSAQLLDAEILPLIVTISGRVSSETPINCEFSGLRGVIVEETAEQHFLKHNDAGSWIQDSALMLSMSKEVPWYLDDGTDRVHVVGARGAAGFALPVGSEAFEESGRSLVRGTLDYLQGLKMLGVKRIERVLPVGTSLTVVGEAAKDDVGAFRIQRPHKGPFYVSPKTIDQLIANLGKWARWYKYASMGLTVFGAYLIAKHAIRYILERRRRSELQRRVLAAAAKKSGQNNDVEKADGLSDGVKKDRLMPDLCVICLEQEYNAVFVP

SEQ ID NO: 183090 - protein, 106 aa, Glycine max
  Coding DNA Sequence Number=SeqID_91405
  Homolog annotation: Hit_ID=A7PU70; Match level="QueryCoverage=100%, HitCoverage=40%, E-value=9e-35, Identity=64%"; Hit description =Chromosome chr7 scaffold_31, whole genome shotgun sequence
MRLLNDLLVMYDGYDFEEWLKKCKKVMIDTFPREDPFSILVPPGFESFDIDKVDELLQEVRSEESEVHNEPGFDAESVANRLKQQEKQQTIRQVEALLDLAIGLNW

SEQ ID NO: 183091 - protein, 109 aa, Glycine max
  Coding DNA Sequence Number=SeqID_91406
MAKKYGVKSKHEGDEDVSDLDQASREKEKRKIAWLPLRTLLLKNAPVTSFWIKPAVYRWRSQIVENAEVLLDVPLIIQRTLWKLLDEDFGSSTRSVQVKAENGLLALNH

SEQ ID NO: 183092 - protein, 42 aa, Glycine max
  Coding DNA Sequence Number=SeqID_91407
  Homolog annotation: Hit_ID=A7PWQ8; Match level="QueryCoverage=83%, HitCoverage=10%, E-value=2e-07, Identity=62%"; Hit description =Chromosome chr19 scaffold_35, whole genome shotgun sequence
MEVIDASVGDAYPRYRGCITQCQETGCVGQRCFPNSSAMCGG

SEQ ID NO: 183093 - protein, 492 aa, Glycine max
  Coding DNA Sequence Number=SeqID_91408
  Gene Ontology: Mol. function=transporter activity; Cellular component= integral to membrane; Biological process=transport
  Homolog annotation: Hit_ID=A7QMK9; Match level="QueryCoverage=94%, HitCoverage=95%, E-value=1e-133, Identity=50%"; Hit description =Chromosome chr19 scaffold_126, whole genome shotgun sequence
  Pfam annotation: Domain name=MFS_1; Domain location=54-464; Score =87.5; E_value=4.3e-23; Accession=PF07690.7; Description=Major Facilitator Superfamily
  Pfam annotation: Domain name=Sugar_tr; Domain location=93-491; Score =6.0; E_value=3.2e-09; Accession=PF00083.15; Description=Sugar (and other) transporter
  Pfam module annotation: Pfam domain module=MFS_1::Sugar_tr; Domain location=54-464::93-491
MADSTHLLLYHQNSSDSIVHHQDYDAHNLSSLSSTIDKCIGDKLNWTQFLQALLISCSWFFDGQQAFITIFTDAHPSWHCIDNPCNSATTNMCTLPKYSWAWDGPTHASIISEFGLECSSSFIMGLPASMFFAGCFVGGLVFSTLADSSFGRKNMLFFSCLIMSLSSFLATFSANVWVYSALKFLSGFGRGTIGTVTLVLVSELVAKGWRGKLGVMGFSFFSIGFLTLSPLAYINQGFSWRNLYLWTSLPSILYCGLVHFFVPESPRWLLIRGKKEEAMKILKNINTSITHSSLKFAISRLSLEEEVWNADLFSALKIMLQKKWSSRRILTITAMGLGIGLVYYGMPLGLGILSFNLYLSVTFNALSEILSAFLTYVLLDKFNRRSMIFILTIISGVSSVLATMEGVIIMRRLQIVFELISFSCACTACDVVLIYTTELFPTSIRNSALSLVRQTVALGGAFSPRPKAKHFVIPWMKKKAIATSVLVEMIFV

SEQ ID NO: 183094 - protein, 130 aa, Glycine max
  Coding DNA Sequence Number=SeqID_91409
  Homolog annotation: Hit_ID=A6FJQ2; Match level="QueryCoverage=29%, HitCoverage=84%, E-value=3e-11, Identity=92%"; Hit description=50S ribosomal protein L5
PFRLARFGDDGETSDTCSSRRRSQLVCKRMPGADKPVRARQRMRKEKIPHQAPFAIQAAQLLGRAIGAGLFAITPAGERGMCCKAIKLGNARGSAIGLNYGLVFGVGGGAFWTGDGFVRQMLKEKKIGEG

SEQ ID NO: 183095 - protein, 252 aa, Glycine max
  Coding DNA Sequence Number=SeqID_91410
  Gene Ontology: Mol. function=calcium ion binding; Cellular component =intracellular; Biological process=small GTPase mediated signal transduction
  Homolog annotation: Hit_ID=A7PU62; Match level="QueryCoverage=74%, HitCoverage=33%, E-value=4e-53, Identity=53%"; Hit description =Chromosome chr7 scaffold_31, whole genome shotgun sequence
  Pfam annotation: Domain name=EF_assoc_1; Domain location=10-76; Score= 90.8; E_value=4.3e-24; Accession=PF08355.3; Description=EF hand associated
  Pfam annotation: Domain name=Miro; Domain location=82-176; Score= -5.1; E_value=0.03; Accession=PF08477.4; Description=Miro-like protein
  Pfam module annotation: Pfam domain module=EF_assoc_1::Miro; Domain location=10-76::82-176
MESPIYEICPWNDAPYKDAAEKTDMGYISLNGFLSQTLLEPQRSLANLIDIGYNGNPTAALRVTHRRSVDHKKQTTEKNVFQCYVFGSKHAGKSALLYSLPGKVTRKILILHEIPEDGLLQFLSNQDCLAACDVAVFCGTYESSWKKSRDLLEKVVRQGELTGYRTPCLLIAAKDDLAPFPRTVLDSVKVTQALGVFTTPSFEHSRTQTAQRKKQHHQLLHHSLIFALVGAAMAVAGLTACRVRAVKKNTTA

SEQ ID NO: 183096 - protein, 542 aa, Glycine max
  Coding DNA Sequence Number=SeqID_91411
  Gene Ontology: Mol. function=catalytic activity; Cellular component =plastoglobule; Biological process=cellular metabolic process
  Homolog annotation: Hit_ID=A5AWW0; Match level="QueryCoverage=62%, HitCoverage=85%, E-value=1e-167, Identity=83%"; Hit description =Putative uncharacterized protein
  Pfam annotation: Domain name=Epimerase; Domain location=218-437; Score=-25.6; E_value=2.9e-05; Accession=PF01370.12; Description=NAD dependent epimerasedehydratase family
  Pfam annotation: Domain name=NmrA; Domain location=220-484; Score= -108.8; E_value=0.057; Accession=PF05368.4; Description=NmrA-like family
  Pfam module annotation: Pfam domain module=Epimerase::NmrA; Domain location=218-437::220-484
MGMDQVQEIFRSKLINVNQFGEQNSASGGGGGDINALSDKQIGAVLNQGLQRACSLVELAAAGFVASEDDDSDPFGDGPVDQSQGVGVGAENLGGIELEDESGDLELGPLVAAGEEGSGLRRVAGPEELLVELGGGAIGERVYGKSTCAAKGKRGRAREEVNGDEGDVTEQGTMDSGGREIGGWDWIAFSDSNVPPSTHFATHAAFSISASAAEKKKVLIVNTNSGGHAIIGFYFAKELLGAGHSVTILTVGEEGSDKMKKPPFNRFSEIVSAGGRTVWGNPAEVGSVVGGEVFDVVLDNNGKDLETVRPVIDWAKSSGVKQFLFVSSAGIYKPTDEPPHVEGDVVKADAGHVEVEKYIEETFGSWAVFRPQYMIGSGNNKDCEEWFFDRIVRDRPVPIPGSGLQLSNIAHVRDLSSMLTLAVENPEAANQTIFNCVSDRAVTLDGIAKLCAQAAGRPVNILHYDPKAVGVDAKKAFPFRTYHFYAEPRAAKAKLGWQSTTNLPEDLKERFEEYVKIGRDKKSIQFELDDKILEALKVPVTV

SEQ ID NO: 183097 - protein, 379 aa, Glycine max
  Coding DNA Sequence Number=SeqID_91412
  Gene Ontology: Mol. function=hydrolase activity; Cellular component =vacuole; Biological process=lipid catabolic process
  Homolog annotation: Hit_ID=A7PUA1; Match level="QueryCoverage=100%, HitCoverage=100%, E-value=1e-142, Identity=66%"; Hit description =Chromosome chr7 scaffold_31, whole genome shotgun sequence
  Pfam annotation: Domain name=Patatin; Domain location=31-233; Score =140.5; E_value=4.8e-39; Accession=PF01734.13; Description=Patatin -like phospholipase
MEFSKVTLEIFSKLEHKWLSHCKATNKTRILSIDGGGTTAIVAGEALIYLEDQIRLHTSDPHAQVADFFDIVAGTGIGAILAAMITAGDAFGRPLYTAREAVRLVSERNSELYKLKSGGIFRRRRRFSSSSMDNALKQVFRRKEDGRLLTLKDTCKPVLIPCFDLKSSAPFVFSRADASESPSFDFELWKVCRATSATPSRFKPFDLASVDGKTSCSAVDGGLVMNNPTAAAVTHVLHNKRDFPLVNGVEDLLVLSLGNGSSNAKACESRTCSTPSVVDIVLDGVSETIDQMLGNAFCWNRTNYVRIQAFGLGNEAMKKEEFLQERGLESLPFGGKRLLTETNGNRIDSFVQRLVATGKPSPPSSPCKDSAVNPLANGR

SEQ ID NO: 183098 - protein, 25 aa, Glycine max
  Coding DNA Sequence Number=SeqID_91413
MANLHPVFSMNYHISTTQKKHQQPK

SEQ ID NO: 183099 - protein, 527 aa, Glycine max
  Coding DNA Sequence Number=SeqID_91414
  Gene Ontology: Mol. function=inositol or phosphatidylinositol phosphatase activity; Cellular component=intracellular; Biological process=abscisic acid mediated signaling
  Homolog annotation: Hit_ID=A7NWR3; Match level="QueryCoverage=98%, HitCoverage=99%, E-value=0.0, Identity=65%"; Hit description =Chromosome chr5 scaffold_2, whole genome shotgun sequence
  Pfam annotation: Domain name=Exo_endo_phos; Domain location=93-484; Score=107.2; E_value=5.1e-29; Accession=PF03372.14; Description =EndonucleaseExonucleasephosphatase family
MRDENSKKSKLSWPKTLVMKWFNIKSKNEDFQADDVLYAGVNEEWRNNCSQRDEDAIKRTKTERAKKRHSDRMRRGKIDRDAAQVTDVHNYRIFAATWNVAGKSPPSYLSLEDWLHSSAPADIYVLGFQEIVPLNAGNILGTEDNGPARKWLALIRKTLNSLPGTSGECHTTSPLPDPIVELDADFEGSMRQKTTSFLHRRSFQSLSHSMRMDNEMSLPQACLDRRLSVCDRMMFGHRTSDYDPSYRWASSDDENGPSDSPVVTHYSPMTYRCCFSMEDRDRQTGKSRYCLVASKQMVGIFLTVWVKSDIRDDVLNMKVSCVGRGLMGYLGNKEGDELRRNSDVMEILRKTRFPRVQGMGDESSPQTILDHDRIIWLGDLNYRIALSYRAAKALVEMHNWKLHIERRQGRVFEGWNEGKIYFPPTYKYSNNSDRYAGDERQSKQKRRTPAWCDRILWYGRGLRQLSYVRGESRFSDHRPVYSMFLAEVESISRNRIKKCSSCSSSRIEVEELLPHSHGYSYTDLSFF

SEQ ID NO: 183100 - protein, 1894 aa, Glycine max
  Coding DNA Sequence Number=SeqID_91415
  Gene Ontology: Mol. function=DNA-directed RNA polymerase activity; Cellular component=membrane; Biological process=signal transduction
  Homolog annotation: Hit_ID=A5BPP1; Match level="QueryCoverage=100%, HitCoverage=100%, E-value=0.0, Identity=48%"; Hit description =Putative uncharacterized protein
  Pfam annotation: Domain name=Filament; Domain location=403-704; Score= -191.2; E_value=0.055; Accession=PF00038.12; Description=Intermediate filament protein
  Pfam annotation: Domain name=KIP1; Domain location=1-52; Score=88.8; E_value=1.8e-23; Accession=PF07765.3; Description=KIP1-like protein
  Pfam annotation: Domain name=M; Domain location=1073-1093; Score=4.5; E_value=33; Accession=PF02370.7; Description=M protein repeat
  Pfam annotation: Domain name=M; Domain location=1262-1282; Score=0.4; E_value=1.2e+02; Accession=PF02370.7; Description=M protein repeat
  Pfam annotation: Domain name=M; Domain location=1297-1317; Score=0.6; E_value=1.1e+02; Accession=PF02370.7; Description=M protein repeat
  Pfam annotation: Domain name=M; Domain location=235-255; Score=2.1; E_ value=69; Accession=PF02370.7; Description=M protein repeat
  Pfam annotation: Domain name=M; Domain location=515-535; Score=5.9; E_ value=22; Accession=PF02370.7; Description=M protein repeat
  Pfam annotation: Domain name=M; Domain location=651-671; Score=2.1; E_ value=69; Accession=PF02370.7; Description=M protein repeat
  Pfam annotation: Domain name=M; Domain location=693-713; Score=8.3; E_ value=11; Accession=PF02370.7; Description=M protein repeat
  Pfam module annotation: Pfam domain module=Filament::KIP1::M::M::M::M: :M::M::M; Domain location=403-704::1-52::1073-1093::1262-1282::1297 -1317::235-255::515-535::651-671::693-713
MDAKVKQMIKLIEEDADSFARRAEMYYKKRPELMKMVEEFYRAYRALAERYDHATGVIRHAHKTMAEAFPNQVPMMLTDDLPAISPTETEPHTPEMRHPSRAFLDPDEPQKDASAHFHAIKRNGGYTGEPDSPLNKTGLKQLNDLYIPGEQENLPKFARRGLNFFETQEESNEQNSGSNNTLSESECVTKAETEILALKKAIAKLEDEKEAGLLQYQQSLEKMSNLKLEVSTAQENSRRLDERASKAEAEVQALKEAQIKLQAESEASLLQYQECLEKISNLEKNISSLQKEAGELNERATKAETETESLKQELARVEAEKEATLVQYNQCLETISKLEERIKEAEENARRIKEHADIAEKEIEALELQVTKLNEEKEDAALHYQQCMEIISSLEYKLSCAEEEVHRLNSKIVDGVEKLQSSEQKCLLLETSNHTLQSELQSLAQKVGSQSEELNEKQQELGRLWGCIQEERLRFIEAETAFQTLQQLHSQSQEELRSLASELNSKVEILGNVESRKQALEDEVHRVSEENKILNEVKISSSLSIKNLQDEILNLRETIEKVEQEVELRIDERNALQQEIYCLKEELNDVNKKHEAMIEEVRSTDLDPQCFGSSVKKLQDENLKLKETCEADKGEKEALLVKLETMEKLLEKNTVLENSLSDLNAELDSVRGKVNVLEETCQSLLVEKSNLAAEKATLFSQLQSTTEKLEKLSEKSNLLENSLFDVNAELEGLRVKSKVLEDTCRSLDHEKSSICQEKETLVSQLNITHQTLKDLEKLHSELELKHLELKGERESALQKVEELLVSLYSEREENSRVLKLNEDELAEKELQILILQEDANCKKKEYEEELDRAIHAQLEIFILQKCIDDLEKKNLSLLVECQRLLEASKMSDKMISKLETENVQKQVDVNSLSEKIKILRIGLIQVLKTLDNNSGHFGEDMLEEDQMLLNHIYGKLQERQKSFDTIFNGSQQMAIENSILITFLEQLKLKVENLVTQRDTLDEEFNIQSKQFLALQIEVQKILQKNQELELTISKGEERMEVMTIETDNLRKQLSDLEKSHNNLQEDSCKILEEKKSLTRRFLDLGEEKSNLEEEICVMIHEAIAQSNLSLIYENIIFEKLMELKELGEDLDKHCSANNDLDERLRVMMCKLENAEMENSHLKESFVKSNVELHLVESINGQLSCQIRDEREMLHLKENELLEAAEMFHVLHTEKTELQRMVEDLKIKYDEARVMLEEQANQILKLSSDKDHQNEELLCLSEVNQKLESEMGYLRQELGETKLREKKLGDEVLKGTNEIEQWETQASTLFAELQISAVNETLFEGKVCELNEMFRVLHTEKTELQRMVEDLKTKYDEARVMLEEKASRILKLSSDKDRQNEELICLCEVNQKLESEIGYLRRELGDTKLREKKLGDEVLKGTNEIEQWETQASTLFAELQIFAVNETLFEGKVCELADACENLERRNYSKDMESEHLKERVSELEVENGRLCEQLIAYVPAVSALNDCITSLEMQTLAHEKPHDHEESKVNSLVNNECTENGQQTDEDRTVVAPDALPYFQDMQRRINAIAMAVKQLNESFKSKHVENMQASKHVTQADQARPDTPVTEIEVLPKDIMLDQISECSSYGISRRREILEADDQMLELWETADKDAAIGKQAEKTQKMVAEAAGNHQRGATMELRNKYPSTDSLVEKELSVDKLEVSRRLTLPREEGNQSKILERLDSDAQKLTNLQITVQDLMKKVEINERSTKGKGVEFDEVKGQLEAAQENITKLFDTNRKLMMNMEEGTLSSVGKDAAESGESGSVSRRRVSEQARRESEKIGQLHLEVQRLQFLLLKLGDGKEIKEKTKMTDRSPRVLLRDYIYGGMRTNNQKKKKKLPFCACVRPPTKGD

SEQ ID NO: 183101 - protein, 229 aa, Glycine max
  Coding DNA Sequence Number=SeqID_91416
  Gene Ontology: Mol. function=secondary active sulfate transmembrane transporter activity; Cellular component=integral to membrane; Biological process=response to stress
  Homolog annotation: Hit_ID=A7PUE5; Match level="QueryCoverage=94%, HitCoverage=33%, E-value=4e-96, Identity=77%"; Hit description =Chromosome chr7 scaffold_31, whole genome shotgun sequence
  Pfam annotation: Domain name=Sulfate_transp; Domain location=54-229; Score=9.7; E_value=3.6e-11; Accession=PF00916.11; Description =Sulfate transporter family
MGSSRDLAVGTVAVGSLLMGSMLSNAVDPNEDPKLYLHLAFTATLFAGVFQAALGLFRLGLIVDFLSHATIIGFMGGAATVVCLQQLKSILGLEHFTHGADIISVMRSVFTQTHEWRWESAVLGCVFIFFLLSTRYFSKKRPRFFWVSAMAPLTSVILGSLLVYFTHAEKHGVEVIGELKKGLNPPSLTNLVFVSPYMTTAVKTGIVVGIISLAVSVPLKLNYFVGMHA

SEQ ID NO: 183102 - protein, 81 aa, Glycine max
  Coding DNA Sequence Number=SeqID_91417
MAPQTPYKDKLLNHEGSIEKDGVVSDELADHYIIVQRWRPFFLINAEKVNKVVCGSESLGYLLNSAMIGSWGGLVQHSGPY

SEQ ID NO: 183103 - protein, 407 aa, Glycine max
  Coding DNA Sequence Number=SeqID_91418
  Gene Ontology: Mol. function=nucleic acid binding; Cellular component= intracellular; Biological process=regulation of transcription
  Homolog annotation: Hit_ID=A7PUH4; Match level="QueryCoverage=81%, HitCoverage=70%, E-value=2e-99, Identity=57%"; Hit description =Chromosome chr7 scaffold_31, whole genome shotgun sequence
  Pfam annotation: Domain name=RS4NT; Domain location=134-171; Score =15.5; E_value=0.023; Accession=PF08071.3; Description=RS4NT (NUC023) domain
  Pfam annotation: Domain name=zf-C2H2; Domain location=149-171; Score =20.2; E_value=0.008; Accession=PF00096.17; Description=Zinc finger, C2H2 type
  Pfam annotation: Domain name=zf-C2H2; Domain location=176-197; Score =16.9; E_value=0.078; Accession=PF00096.17; Description=Zinc finger, C2H2 type
  Pfam annotation: Domain name=zf-C2H2; Domain location=73-95; Score =26.4; E_value=0.0001; Accession=PF00096.17; Description=Zinc finger, C2H2 type
  Pfam module annotation: Pfam domain module=RS4NT::zf-C2H2::zf -C2H2::zf-C2H2; Domain location=134-171::149-171::176-197::73-95
MFPAVMSNSNSLSEEATVSCGTRIAGLNHVITTTISPEQPLKIKKKRNLPGNPDPDAEVIALSPKTLLATNRFVCEICNKGFQRDQNLQLHRRGHNLPWKLKQRSNKEVKKKAYVCPEPSCVHHNPSRALGDLTGIKKHYCRKHGEKKWKCEKCSKIYAVQSDWKAHSKTCGTREYRCGCGTLFSRKDNFITHRAFCDALAEESARLSANQLATNTTNPLVQSLFLFPTQQHNNNFINPWDPNPNPNPNPNPSNLTTLHNNIKPESHNFHIPNTTTTSTANNNISSSFLHHHQHPNKSMITSPFRDLHERTQPPSNAATSAHLSATALLQKAATVGAAAITGPTHVTQLSMAELGTETTHLDSVPLPPDQRYMSMRGINSNNDASRGTFSASPTAARLTLASTSRIC

SEQ ID NO: 183104 - protein, 415 aa, Glycine max
  Coding DNA Sequence Number=SeqID_91419
  Homolog annotation: Hit_ID=A7PUE8; Match level="QueryCoverage=95%, HitCoverage=83%, E-value=4e-74, Identity=45%"; Hit description =Chromosome chr7 scaffold_31, whole genome shotgun sequence
  Pfam annotation: Domain name=DUF828; Domain location=23-326; Score =104.5; E_value=3.2e-28; Accession=PF05703.2; Description=Plant protein of unknown function (DUF828)
  Pfam annotation: Domain name=PH_2; Domain location=366-415; Score =4.8; E_value=0.00035; Accession=PF08458.1; Description=Plant pleckstrin homology-like region
  Pfam module annotation: Pfam domain module=DUF828::PH_2; Domain location=23-326::366-415
MEHNLTMKCRRNENLLTSGTHLPESPRVPMEFLSRSWSASSLEVSKALTLPPPPPLSSYIPSKPPNAPSSVTNSISEETSEEFSTMCGNQFSFASSATSQLVLDRIMSQSAREEVSPLTSGRLSHSSEPLNGGASLTGTDSPPISPSDEFDDVVKFFRANNSIHPLFNGGRAMSGATGNATPCSGPKTVGRWLKDRREKKKEENRTHNAQLHASISVAAVAAAVAAVTAATAASSAADKDDKMAMAVASAATLVAAQCVEAAEAMGAERDHLASVVSSAVNVRSHDDITTLTAAAATALRGAATLKARALKEVWNITAVTPIESGIGIGICGKGNNSNSSTSDSGEIINGEIFLGACSQELLARGTALLKRTRKGDLHWKIVSVYLHRTGQVMLKMKSRHVAGTITKKKKSKLLA

SEQ ID NO: 183105 - protein, 1959 aa, Glycine max
  Coding DNA Sequence Number=SeqID_91420
  Gene Ontology: Mol. function=hydrolase activity; Cellular component =nucleus; Biological process=metabolic process
  Homolog annotation: Hit_ID=A7PUI0; Match level="QueryCoverage=44%, HitCoverage=91%, E-value=0.0, Identity=57%"; Hit description =Chromosome chr7 scaffold_31, whole genome shotgun sequence
  Pfam annotation: Domain name=PPR; Domain location=111-145; Score =37.2; E_value=5.8e-08; Accession=PF01535.11; Description=PPR repeat
  Pfam annotation: Domain name=PPR; Domain location=214-248; Score =37.1; E_value=6.4e-08; Accession=PF01535.11; Description=PPR repeat
  Pfam annotation: Domain name=PPR; Domain location=315-349; Score =40.2; E_value=7.6e-09; Accession=PF01535.11; Description=PPR repeat
  Pfam annotation: Domain name=PPR; Domain location=350-384; Score=1.9; E_value=4.7; Accession=PF01535.11; Description=PPR repeat
  Pfam annotation: Domain name=PPR; Domain location=416-450; Score =29.5; E_value=1.2e-05; Accession=PF01535.11; Description=PPR repeat
  Pfam annotation: Domain name=PPR; Domain location=516-550; Score =40.7; E_value=5.1e-09; Accession=PF01535.11; Description=PPR repeat
  Pfam annotation: Domain name=PPR; Domain location=617-651; Score =34.3; E_value=4.4e-07; Accession=PF01535.11; Description=PPR repeat
  Pfam annotation: Domain name=PPR; Domain location=652-686; Score=7.0; E_value=1.1; Accession=PF01535.11; Description=PPR repeat
  Pfam annotation: Domain name=PPR; Domain location=754-788; Score=0.7; E_value=6.5; Accession=PF01535.11; Description=PPR repeat
  Pfam module annotation: Pfam domain module=PPR::PPR::PPR::PPR::PPR::PP R::PPR::PPR::PPR; Domain location=111-145::214-248::315-349::350 -384::416-450::516-550::617-651::652-686::754-788
  Subcellular localization annotation: CTP_CleavageSite=58; ConfidenceScore=5.31e-01
MSTSILTPLPLKPISVNTLNKGTLKPAFQSLTLLSTHPLATPSRLEHAHSLLLDLCVAAKALPQGQQLHALLLKSHLSAFLATKLVLMYGKCGSLRDAVKVFDEMSERTIFSWNALMGAFVSSGKYLEAIELYKDMRVLGVAIDACTFPSVLKACGALGESRLGAEIHGVAVKCGYGEFVFVCNALIAMYGKCGDLGGARVLFDGIMMEKEDTVSWNSIISAHVAEGNCLEALSLFRRMQEVGVASNTYTFVAALQGVEDPSFVKLGMGIHGAVLKSNHFADVYVANALIAMYAKCGRMEDAGRVFESMLCRDYVSWNTLLSGLVQNELYSDALNYFRDMQNSGQKPDQVSVLNLIAASGRSGNLLKGKEVHAYAIRNGLDSNMQIGNTLVDMYAKCCCVKYMGHAFECMHEKDLISWTTIIAGYAQNEFHLEAINLFRKVQVKGMDVDPMMIGSVLRACSGLKSRNFIREIHGYVFKRDLADIMLQNAIVNVYGEVGHIDYARRAFESIRSKDIVSWTSMITCCVHNGLPVEALELFYSLKQTNIQPDSIAIISALSATANLSSLKKGKEIHGFLIRKGFFLEGPIASSLVDMYACCGTVENSRKMFHSVKQRDLILWTSMINANGMHGCGNKAIALFKKMTDQNVIPDHITFLALLYACSHSGLMVEGKRFFEIMKYGYQLEPWPEHYACMVDLLSRSNSLEEAYHFVRNMPIKPSSEIWCALLGACHIHSNKELGELAAKELLQSDTENSGKYALISNIFAADGRWNDVEEVRLRMKGNGLKKNPGCSWIEVDNKIHTFMARDKSHPQTDDIYLKLAQFTKLLEKKGGYIAQTKFVFHNVSEEEKTQMLYGHSERLALGYGLLVTPKGMPIGSIILKEDSVHVEISGEYLDYVKIDYSTLLWFLPVTGSLRWLEISCKMVNLLPVLQASLQESSEIHGGRGGETFRDWQMELSEEWKPFFPTGASTVSPILQSHSRNSLPLGPLVFNPNPNPNPNSLSLLFSSPSLLPSLHLPPHLLPSRFLLTSHPHSIPPSTASSVASLFSSPNQNDAASLLLCNRLHLLHYPNSPNAIVFFPTGANDDKLGFFILRVKDSRLDIQLEANGDVFCVYTGSAHRILNISVNPVAEFDRLDDSNVIGYLLASTLYSVHWFAVKHNSILDRPSVFYLGGKTFKTCPVAHACWSPHVMEESLVLLENGQLFLFDLESHDTTGTAFKGTRLKVPWNGLGFSGNNMVWLSCEFSWHPRVFVVAHSNAVFLVDLRLKECSVSCLMKIEMLRMYAPGANERFLALSRAGPDDLYFAVASTSLLLLCDVRKPLVPVLQWMHGIEGPCFVSVLSLSDLRSHSRDDAFKLASESGFCIMLGSFWNCEFNIFCYGSILPFRKGSITSKVNPNVCAWELPFEINLSGHECHCGSCLLRKEFSKDALPEWVDWQLKKEIVLGFGVLSNDLAALLCEPDENGGFTLIRLMSSGRFELQRYHACWTKARNMKDCHDQVFCLDRHLLYPESDEKYKFPKYFHYLKLNYLYAYARGDLSRFLVKKLEKNCMNAQDQEPFCDEVHELLCEKLNACGFSQSKSCPAVTSVFNDVKLPASLHEVALRRLWADLPMELLQLAFLSYVECHKVVGDLHQNKVALEFLAVPDLPQLPPFFLRKSSPHSNDDIVGPVIPFPVLLVLNEFRNGYSNLEGDEFSVEAELGLKYKEVMQVAGEIADSAYGPAHLDDHVVSLAEDGEETWVGSSKPKSFLLYHPVAFNSSATDLAQEKFVYSNTIYDTFISHVPEKKSNEKTESVGQEIFDDLCPVELRFDASVKKLEPQVMESGFGKLPIFEVEATIDIALDCMASLLKKVEANQASFCSASWVTMIFPFLVSDAHPEELGMLVEVLKSGMVTSASGSQYRLSLDAKCDYGNIGGSWDDGGDLDQSSFNVYIKVFTYLMHVVTAGVSDNAINTMKLHAIYLT

SEQ ID NO: 183106 - protein, 360 aa, Glycine max
  Coding DNA Sequence Number=SeqID_91421
  Gene Ontology: Mol. function=GTPase activity
  Homolog annotation: Hit_ID=A7PUJ8; Match level="QueryCoverage=64%, HitCoverage=49%, E-value=4e-72, Identity=80%"; Hit description =Chromosome chr7 scaffold_31, whole genome shotgun sequence
MKDVELDQLYVKRREQLKKLVASIITPKIVQGKTLNGKEFVSFLEQILEALNKGEIPSTGSLVEVFNKNILEKCLKLYSEKMAKLVLPLPEKSLQGAHDRSRDEVTKVFDQQHFGRHHAKKSFMQLDEEIQQVYKNVVLQNEYQSSRLCEALYTRCEDKMDQLQVLKLPSLAKFNADDGEVSVSVYKGVQSQALQLVGGLLPGYESLYYNPVWHFIVATWETVVYSPILDLDRTSRRQWAMLGFSYGEIFLSLGATAALIGPKDLPIICRTAGRLAGRAIGCVQLARGQFDTVMQQSQARRVHKELQDTMAQLDAIHHEIRSVSIINAGPLTRRLVDNPDQTSISDAIIYMICFGIWIIE

SEQ ID NO: 183107 - protein, 61 aa, Glycine max
  Coding DNA Sequence Number=SeqID_91422
MNEHSKSHTSEWKRIRVKRRRHFKEKMSQEEVHHHEVMDKNLKVGEDEWREKERSCASKEV

SEQ ID NO: 183108 - protein, 157 aa, Glycine max
  Coding DNA Sequence Number=SeqID_91423
MRGRERERERVRDRERRLDRGGERGNVSETETVRVRENTNRRETPRVSDSVRERNLANDRFVKYDEAPTRANVYEWQTVSHRKHRGAAKQTHGGNGRRQQYHRRNWRDDADITSFYFTNFSEEVTKMELWSHFNQWGEVKEVFIPNRRNKEGKRYGF

SEQ ID NO: 183109 - protein, 804 aa, Glycine max
  Coding DNA Sequence Number=SeqID_91424
  Gene Ontology: Mol. function=transporter activity; Cellular component= integral to membrane; Biological process=transport
  Homolog annotation: Hit_ID=Q84X27; Match level="QueryCoverage=62%, HitCoverage=97%, E-value=0.0, Identity=73%"; Hit description =Putative uncharacterized protein At2g30630/T11J7.2
  Pfam annotation: Domain name=MIP; Domain location=1-203; Score=112.0; E_value=1.8e-30; Accession=PF00230.11; Description=Major intrinsic protein
MAEVVGTFILMFCVCGITASTRFQNGAVGLLEYAATAGLTVVVIIFSIGPISCAHVNPAVTIAFATIGQFPWLKVPVYIIAQTVGSMSATYVGSLVYGIKSDAMMTMPLQGCNSAFWVEVIATFIIMFLVAALTSESQSVGHLSGFVAGMAIGLAVLITGPVSGGSMNPARSLGPAILSWKFKNIWIYMVAPSGGAIAGAAMFRFLRLRDQHSSTLSSPNIIDVGRSIPFCSKYNGKPTFTEIVVASSIGLIFAAAMHYRVKTNRDRQIMPRLRKSKANQTPKLEKFSHYVARQMGLKDRRSCPLLCKLASEYIRNSEDCEDDLYAFFENEPDADSLSVKLVEEFERCILSYFAFHWTHGDVLISQVFSSEVEPKAKLRHIVMAATREQRFERVTKNLKVARVFNTLVEEMKAMGLATNDDSQCTEVMAPVAHCDRSPVLLFMGGGMGAGKSTVLKDILKEPFWAGAAGNAVIIEADAFKESDVIYKALSARGHQDMIRTAELVHQSSTDAASSLLVTALNEGRDVVMDGTLSWLPFVVQTITMARNVHRRRYRMGPGYKVNEDGTVTENYWQRIEGEGPELVGGKMRKPYRIELVGVVCDAYLAVIRGIRRAIMCRRAVRVKSQLTSHKRFADAFLTYCQLVDNARLYSTNSLEGPPKLIGWKDRDKTLLVDPDEIDCLKRISTLNEKANNIYELYKHPNPTCEAGSIWKDIVLSPSRLNIQQELKYSIQKPYPCICKEAVFGFEPMTNKSPRHNFTAAPGLALKNFVPHCPEALRYAKVWGRDVVRSLTLAYAKRLFPDLNP

SEQ ID NO: 183110 - protein, 206 aa, Glycine max
  Coding DNA Sequence Number=SeqID_91425
  Gene Ontology: Mol. function=RNA binding; Biological process =gynoecium development
  Homolog annotation: Hit_ID=Q58T16; Match level="QueryCoverage=64%, HitCoverage=22%, E-value=2e-29, Identity=53%"; Hit description=FLK
  Pfam annotation: Domain name=KH_1; Domain location=150-199; Score =51.0; E_value=4.3e-12; Accession=PF00013.20; Description=KH domain
MLFHEFGFIAAGMSGEVFDGQDAGYVPENPEFPQNHSDEHDGGNVIDDSGFPQLQPDEHDAGGFPQLQLQPDEHEGGNLAEDANHPEHNFDGNDVEGLPGPDFPPQEHAEEQHVGGDVTENFASEEKQEPEEDLKGGEVKKWPGWPGENVFRMLVPVQKVGSIIGRKGEFIRKITEETKARIKILDGPPGTAERAVSILFSFLLFT

SEQ ID NO: 183111 - protein, 224 aa, Glycine max
  Coding DNA Sequence Number=SeqID_91426
  Gene Ontology: Mol. function=transcription regulator activity; Cellular component=nucleus; Biological process=regulation of transcription
  Homolog annotation: Hit_ID=A7P9Y6; Match level="QueryCoverage=79%, HitCoverage=65%, E-value=2e-49, Identity=60%"; Hit description =Chromosome chr14 scaffold_9, whole genome shotgun sequence
  Pfam annotation: Domain name=HLH; Domain location=72-121; Score=45.1; E_value=2.5e-10; Accession=PF00010.17; Description=Helix-loop-helix DNA-binding domain
MVYSFYDKTSSSSGSDISGLFNPTLHNLGACNDLSSSPHSLVFESDKGELVKCLAAAKVGKSEICEAKALAALKNHSEAERRRRERINGHLATLRGLVPSTEKMDKATLLAEVISQVKELKKNAAEVSKGFLIPKDADEVKVEPYNDHEGGEGSMSYSATICCDFRPEILSDLRQTLDSLPLHLVKAEISTLAGTMFCDGKGFCLTGFLTKNITCKQEEKTMLY

SEQ ID NO: 183112 - protein, 103 aa, Glycine max
  Coding DNA Sequence Number=SeqID_91427
MYMCVAIISNYHPHDYVRPSRLGRIGGRGWTLIAGVSLSEACALSENHALSEALSPLSKLGESGGEYEKHLRTQHVISSLSEAFVSSYVKRTQLAQRIFTNSC

SEQ ID NO: 183113 - protein, 376 aa, Glycine max
  Coding DNA Sequence Number=SeqID_91428
MDPPSKKSLDSRKTTTLTTFPMNFSKDLQEDIFSASRMTIEEQSTECVQNVRPDLESNLSPLISQATMDEMYVFFNNYSVPMSVYDDLMARLCNDNDILQLGENSFNEQIPLDDISLEVLKAVEGLTNDTNSTTLLTSNSLEEVEISIPPAAGVVVSEAFTPFQSPSFPLHPNGYASAGASPSVGVSALVAASAGANASVGGIACASVNTNASVSTTVRLATFDPQHPPQIGTSFGNFVFPNTMGNPFTQFQSCSSSASFPMLPYDSSSSSSSYQQSPRYLPFLMTGIGPQGIPATMPQFNQGNFWLRPPPLTDFPNFVHAWEGSLIGRIHSCRQFLSKARVVRKPTSLVMLTAQWKPRLEIVLFLPTNAVNYTMQ

SEQ ID NO: 183114 - protein, 56 aa, Glycine max
  Coding DNA Sequence Number=SeqID_91429
MPNSTTVDNRCIVIESRKMTPKNFNVKGINETLGLIRILVVDLKRANKIALTLVNF

SEQ ID NO: 183115 - protein, 96 aa, Glycine max
  Coding DNA Sequence Number=SeqID_91430
  Subcellular localization annotation: CTP_CleavageSite=86; ConfidenceScore=5.29e-01
MCIIDLILCISGFSISSLLVVMMRHLVPTDLTIGHFFMLSAKGLSSVQRRLFLFSSKQSASNCCFKCLSGELKVGLTRCWWLERLGSSAVKKHSMD

SEQ ID NO: 183116 - protein, 60 aa, Glycine max
  Coding DNA Sequence Number=SeqID_91431
MGAKFLEVRLIAVFKYLSNILPPPPPPTPFLGPGFMLAISSHISSTGPIGDQNPRAFSPK

SEQ ID NO: 183117 - protein, 76 aa, Glycine max
  Coding DNA Sequence Number=SeqID_91432
MSKNLSYCATTVKIRTLISFERSCYSIGQLAKTKGVKLRKHEDIETEDIEFYEAQTRTKDIEVFEMKMKTLSSLKA

SEQ ID NO: 183118 - protein, 64 aa, Glycine max
  Coding DNA Sequence Number=SeqID_91433
MGQKHLSPWEKTSGVTTNIYSWKTIEKPKRQTSAKFENKGSGVVYARGRVDKDIALAPTYPQVR

SEQ ID NO: 183119 - protein, 107 aa, Glycine max
  Coding DNA Sequence Number=SeqID_91434
  Homolog annotation: Hit_ID=A5B5T3; Match level="QueryCoverage=50%, HitCoverage=10%, E-value=7e-09, Identity=50%"; Hit description =Putative uncharacterized protein
MDNGDIENESSLEDCSVKVVEPLHGDVEQDEHIVNTRYTPTINEHTIVLTTLKPIEVYADQDGKHKADFVGEFHAKVRANIEKRNEQYAKQTNKDCVKVIFEPGDWV

SEQ ID NO: 183120 - protein, 59 aa, Glycine max
  Coding DNA Sequence Number=SeqID_91435
MNLLSEHVALSNCRNLPFGERATRGSRVRLPWEENARSRHQRLFEENIEKNGKGVVYKL

SEQ ID NO: 183121 - protein, 244 aa, Glycine max
  Coding DNA Sequence Number=SeqID_91436
  Homolog annotation: Hit_ID=A7PIT9; Match level="QueryCoverage=89%, HitCoverage=36%, E-value=7e-68, Identity=55%"; Hit description =Chromosome chr13 scaffold_17, whole genome shotgun sequence
  Pfam annotation: Domain name=XH; Domain location=162-244; Score=23.2; E_value=1.7e-08; Accession=PF03469.5; Description=XH domain
MELLEQYMQFKQEAEKDGKKNNLWKNASKNTSLQMAALEQMKADENVMKLAEDQKRQKEQLHAKIIQLQKQVDMKQELELEIQQLKGSLTVLKHMEDDKDAEILNKVDTLQKNLRDKEQSLQDLDALNQTLIIKKRESNDELQEARQALVDAIKELQSHGNIRFKRMGELDTRPFLEAMKQRYNEEDAEERASELCSLWKEYLKDPDWHPFKVIMVEGKEKMKTIASEMMYWGIIMFCLMAEGY

SEQ ID NO: 183122 - protein, 167 aa, Glycine max
  Coding DNA Sequence Number=SeqID_91437
  Homolog annotation: Hit_ID=A2Q4L4; Match level="QueryCoverage=95%, HitCoverage=16%, E-value=8e-10, Identity=29%"; Hit description=RNA -directed DNA polymerase
MFHQLDQLWSRNLNSKYRGWRVLEEGTPKQHFSHWWSDLRSINHHRSVADVSKQFIWKLGKGDQILFCEDSWVDGGITLKGKFPELYQISSEKLQTVADMGSFCETGWEWKFSWRRNMFDNEMGIASFFIDQTAAINLNASLKDTWVWGADPTGIFSTKSAYLCIKA

SEQ ID NO: 183123 - protein, 155 aa, Glycine max
  Coding DNA Sequence Number=SeqID_91438
  Subcellular localization annotation: CTP_CleavageSite=31; ConfidenceScore=5.14e-01
MAIARHSHCKCQYQLTTKKYTFNIAMLTSVSGKTDVNKSTVAYLLFVLLKLPFLFVFELEFAPVPIRVGVQVQVRGQTNFFLCFLVINRVIISPIVELTLDLSSSGPLRVCVYSDPGAHLSVKFPSKKNDLLKDTGWYYKELLEKCGWNGVVEVI

SEQ ID NO: 183124 - protein, 69 aa, Glycine max
  Coding DNA Sequence Number=SeqID_91439
MKKTHQWEAKNSRIEYLLVGRCSPLDQRREGVTIGRSRSYPPFASIPKYLQVGDKQYAANRDQSSSYLG

SEQ ID NO: 183125 - protein, 163 aa, Glycine max
  Coding DNA Sequence Number=SeqID_91440
MAPTRHPLGFPALITGLCQSFGVPVAPSKVIRPPITRAFIEKYCTQRQAQGDAPQAAGAPPPPHQADPTGSFDTERYLRHSMRQHAANHMELGQMQRQGFASFPCPTPDQFKAEVAWPEDWPEDWPEAQAGEALAEAPDDGEEADMDEEMSDLLGFLGGSGAT

SEQ ID NO: 183126 - protein, 56 aa, Glycine max
  Coding DNA Sequence Number=SeqID_91441
MTKSKGKDPPTEELGGLMTRARQGKPRKLFNKCCPYYLNTSPSFKEKSPRLLVGHY

SEQ ID NO: 183127 - protein, 89 aa, Glycine max
  Coding DNA Sequence Number=SeqID_91442
MVGYTSSSFADLVFVGERIKVGMERGKYDYLALMNAKIGANEEGENEGEAHAATAVPTWKLPHQLNNIITQPISALHITHHPVIHKGHP

SEQ ID NO: 183128 - protein, 67 aa, Glycine max
  Coding DNA Sequence Number=SeqID_91443
MAASDIAILRDRAHIPTKKILLELTSQDALLAQNKLLSKKLEALTETLSCMVCHLWWSSQFWLMYPQ

SEQ ID NO: 183129 - protein, 78 aa, Glycine max
  Coding DNA Sequence Number=SeqID_91444
MASLAKQMDKLQRNVERKMGERFDEIERSTQELSGRMEDIERRRHHRSPHSSQGSDDGYEEGRRHIHRRNRDGMNDVK

SEQ ID NO: 183130 - protein, 59 aa, Glycine max
  Coding DNA Sequence Number=SeqID_91445
MKITTFSLQFLLMEELSWAVTLSKNAWAMIIGYLWISHQSSWPGRLGESSLVCNHESRL

SEQ ID NO: 183131 - protein, 69 aa, Glycine max
  Coding DNA Sequence Number=SeqID_91446
MESGDGRGYPMVICTFRQPRRTNSTVFTLVIQRHSSPTTHEILLCWARAIECDGVGKFRGCPILSLSRH

SEQ ID NO: 183132 - protein, 149 aa, Glycine max
  Coding DNA Sequence Number=SeqID_91447
MKRGKLITLLGRMRKTGANKEDENEGETHAVITVPTWKLPTSQTMSLLSQYQSFSLPTTKSSTKAIPKSTTKPVYHTSNHEHHLLQEPKHQRRKEFRSEKAYRIHPNSAITPARFPQPPFFRGYDLKRNMCISWSSPGAFLGALYDPKV

SEQ ID NO: 183133 - protein, 53 aa, Glycine max
  Coding DNA Sequence Number=SeqID_91448
FDACREADLKDLIWEDIQVKFDILEASDSRTKRKLLQTVGERWRHLKSDLTRK

SEQ ID NO: 183134 - protein, 128 aa, Glycine max
  Coding DNA Sequence Number=SeqID_91449
MATGNTTIQKPRDQWSEEEKRLVQYNLKARNIITSALGMDEYFRVSNCKSAKYMWDTLQEHEMELLRLNQREENDKKKGIALKASSSNQEESDKEDTIEIDEDDDLSLFVKRFNKLAKSQRKSKETKL

SEQ ID NO: 183135 - protein, 75 aa, Glycine max
  Coding DNA Sequence Number=SeqID_91450
MSLSTLFGKLQEHEMELMRLNQHEENDKKKKGIVLKASSSTQEGSDKEDSIEIDEDDDLNLFVKRFNKFRRVRGN

SEQ ID NO: 183136 - protein, 153 aa, Glycine max
  Coding DNA Sequence Number=SeqID_91451
MRPYLYWEVDLSPYLSAAAMEGTDHHGTQPQVGGVKWQLLQHALGHHDFLFNESEVIVGCDVIAIPSKPSTDMSWATAHEKLQKGDSSRGLIELFNDFDLALLDNTEELASLLEPGGANMRPLRVMSFSPVMLVTLADNEPIWVASSFLPPRG

SEQ ID NO: 183137 - protein, 161 aa, Glycine max
  Coding DNA Sequence Number=SeqID_91452
MLGAPAIMLGAPSNTLTAIEEEARKRSFRARRSEIFGFYFGQLLGAPSNIAEWCKRFRFDPRNFLPAKTLQLRNKKTSSVESRGRRLPRDSTEKGFFHCLNYTREHSWKKLSSAVVMSTAEEGFFRGVIVIVCIKMVEDQWAYYSVMSEEVDMDFQDEEDC

SEQ ID NO: 183138 - protein, 103 aa, Glycine max
  Coding DNA Sequence Number=SeqID_91453
MSPPPLEPHNHSQTHLQLSGQLPLQALFSVGGLVGACLLNANLDHLARISEFWLNVCLLAQWMDSSGAHSRMSPRSGNMHNSSFFQILPRAHPREWCAQRMAR

SEQ ID NO: 183139 - protein, 141 aa, Glycine max
  Coding DNA Sequence Number=SeqID_91454
  Homolog annotation: Hit_ID=Q1J7G7; Match level="QueryCoverage=23%, HitCoverage=60%, E-value=8e-07, Identity=66%"; Hit description =Transposase
YIEQLTEMPQNVLYDAMGYINGVGTSYVPINVSFSPKVGPGLPAVPPVQLLTGWCVTAKAPPDISAGKCSGRVPFAIQAAQLLGRAIGAGLFAITPAGERGMCCKAIKLGNARVFPEFDVAHTPWYTFLGAEGIPEELGIL

SEQ ID NO: 183140 - protein, 314 aa, Glycine max
  Coding DNA Sequence Number=SeqID_91455
  Gene Ontology: Mol. function=methylmalonate-semialdehyde dehydrogenase (acylating) activity; Cellular component=integral to membrane; Biological process=valine metabolic process
  Homolog annotation: Hit_ID=A8ANK3; Match level="QueryCoverage=100%, HitCoverage=62%, E-value=1e-171, Identity=94%"; Hit description =Putative uncharacterized protein
  Pfam annotation: Domain name=Aldedh; Domain location=1-293; Score =81.6; E_value=2.6e-21; Accession=PF00171.13; Description=Aldehyde dehydrogenase family
LLKEAGLPDGVFNVVQGDKESVDVLLTDPRVQAVSFVGSTPIAEYIYQTASAHGKRCQALGGAKNHCILMPDADMEMATNAIMGAAYGAAGERCMALSVVLAVGDYTADDLCARLEKQIAALRVGPGLDQTPENEMGPLISSAHRSKVLGYIDSGEAQGATLRVDGRGFSVKGHEQGYFVGPTLFDNVTPEMTIYKEEIFGPVLSVVRVADYASAVDLINRHEYGNGSAIFTRDGGCARRFCEEVLAGMVGVNVPIPVPMAFHSFGGWKRSIFPALNVHGNDGVRFYTRMKTITARWPEMQQETGAAFSMPTLG

SEQ ID NO: 183141 - protein, 31 aa, Glycine max
  Coding DNA Sequence Number=SeqID_91456
MWVSNGREGDARLTGVSSKKGIRAESPPPFI

SEQ ID NO: 183142 - protein, 17 aa, Glycine max
  Coding DNA Sequence Number=SeqID_91457
TNFVVDLGMAFVDNWAV

SEQ ID NO: 183143 - protein, 100 aa, Glycine max
  Coding DNA Sequence Number=SeqID_91458
MVEKLQEEMKGSGLRLKGITRGLIRVVKEMDKENNVSVHIWSAARTFPQTRHLHRQQEVAPVAEDEPVVAADVHAPVADDENPETDQIQAKGPSGEGQRP

SEQ ID NO: 183144 - protein, 197 aa, Glycine max
  Coding DNA Sequence Number=SeqID_91459
  Gene Ontology: Mol. function=ligase activity; Biological process =response to auxin stimulus
  Homolog annotation: Hit_ID=Q9M1S0; Match level="QueryCoverage=34%, HitCoverage=9%, E-value=3e-21, Identity=76%"; Hit description =Putative uncharacterized protein T5N23_160
  Pfam annotation: Domain name=DUF1336; Domain location=32-149; Score= -25.3; E_value=6.5e-09; Accession=PF07059.3; Description=Protein of unknown function (DUF1336)
MGLCNVYYCHESDARKSYVFPWKMMLIGKLLWKTIPYCRALWMEMMLIGTQDLSSYHIFLRYISTKNVTWIMVFLMQSVGKKACLVGQALEMLYIRGKNYLEIDIDVGSSIVARGVPSLVLGYLNNLVVEMAFLVQGKPLSFIYGSKQFKMKGGLAARNAASNVFRSAGYKCAMRALQSQCYSPNEVIFGPDFLTAQ

SEQ ID NO: 183145 - protein, 106 aa, Glycine max
  Coding DNA Sequence Number=SeqID_91460
MACGGNPGSLNHNISFMTVFEGRLFYIGCLATTDVVWVGFYSGSKAKTDVEWVGFYIGYQPTDVENESFYIGLQSTDIEFEEFLYRLSPNRCRMRIFSTSFIIEPM

SEQ ID NO: 183146 - protein, 190 aa, Glycine max
  Coding DNA Sequence Number=SeqID_91461
MGTRASPRVLDDVEAEGDDIADVEGLDDTVALGSEREVQPLYGFSSVLSQSRTFEVKMSERRQRGASSVWDLMSVTVVPKGMKYSLLYYHFEDQMTSPTLHLLEIREQHDEQPKCCLKLKEKLEEGYLTPVATYPSVGGRRVTRGMRVPRKEYARSRHQRLFEENVGKTGKDAIYELLSERFGSCIYAQG

SEQ ID NO: 183147 - protein, 154 aa, Glycine max
  Coding DNA Sequence Number=SeqID_91462
  Subcellular localization annotation: CTP_CleavageSite=59; ConfidenceScore=5.71e-01
MWRNSLASSSDTSFLPQPSFFSEKPFIRIFSFGAGITLSFCSSAIFALPLAFAGCVGSRQRADVGGFFLPFAWRRIPPRNCVAVLGLVDKPYGGHHVFQRFGPTRLTLLDGINRSPSMISERVCFYVGPIFLKRQPSDFYQTLGFVFKGQALFG

SEQ ID NO: 183148 - protein, 247 aa, Glycine max
  Coding DNA Sequence Number=SeqID_91463
  Homolog annotation: Hit_ID=Q6WAY6; Match level="QueryCoverage=55%, HitCoverage=25%, E-value=5e-13, Identity=32%"; Hit description =Putative uncharacterized protein
EGNEGVLFSCGDYPNIPLIGMRGCINYNPALAIRQLGYTMKGAPAEESLSPFLVRDFGTQSFKLIQRVHKAWESPLRKDKELRGIRNGIIGGYHEWLKENFEAPEEDEETSGKSVPSYKKKIRLPQEPLNKKPRGLARKNMAETNSVELCGAATVQEKLVSAFMRDRDQHVSHHQQARGRVIDLLHQKATMWMDRFALTLNGSQELPRLLAKAKAMVDTYSAPEEIHRLLSYCQHMIDLMAQIIRNR

SEQ ID NO: 183149 - protein, 38 aa, Glycine max
  Coding DNA Sequence Number=SeqID_91464
MDHSLYLNSTSFQGLENQKTSESFWYKEEEEVQRESRL

SEQ ID NO: 183150 - protein, 38 aa, Glycine max
  Coding DNA Sequence Number=SeqID_91465
MNSSRVNQNHGHGVKCGIYGANSAEWIMSMQLDFCSPY

SEQ ID NO: 183151 - protein, 108 aa, Glycine max
  Coding DNA Sequence Number=SeqID_91466
MTQKLVARGDTLRLSAPRHSVTPSVIDERGPMWSSAPFPEVSAFSGGDFFKSHKLSRTTHSRVRWHAETNYGHSAPISSIAADKPVDTRRFTSSSALTRSVILTFESR

SEQ ID NO: 183152 - protein, 160 aa, Glycine max
  Coding DNA Sequence Number=SeqID_91467
TLASIATPLGLEVIPQVKELLDEGLVRKSLNPCALLVPKIGIIRHQIPMIGGMMNVLSGATLFCKITHAPNIFMISIHRDSLGRNNQHENKEKGMFYSITFLNFLNSDQGLPMDPKRIKVIPEWPTPPRRITEFQEPLDLRSNPFQGGGNDAILPPKGIG

SEQ ID NO: 183153 - protein, 212 aa, Glycine max
  Coding DNA Sequence Number=SeqID_91468
  Gene Ontology: Mol. function=xylose isomerase activity; Cellular component=cytoplasm; Biological process=carbohydrate metabolic process
  Homolog annotation: Hit_ID=A8G7W8; Match level="QueryCoverage=100%, HitCoverage=48%, E-value=1e-108, Identity=85%"; Hit description =Xylose isomerase
MAEHLRFAACYWHTFCWNGADMFGVGAFDRPWQKNGDALQLAKLKADVAFEFFYKLNVPYYCFHDVDVSPEGDSLRSYQENLAVMTDKLLEKQQETGVRLLWGTANCFTHPRYAAGAATSPDPEIFAWAASQVCSAMQATQTLGGENYVLWGGREGYETLLNTDLRQEREQIGRFMQMVVEHKHKIGFQGMLLIEPKPQEPTKHQYDFDVAT

SEQ ID NO: 183154 - protein, 59 aa, Glycine max
  Coding DNA Sequence Number=SeqID_91469
MEHLLVGDEQKRKTESKNAKNDDTGAANSSISWGWLAQASPARPGEPSSPRRAQLAQAS

SEQ ID NO: 183155 - protein, 104 aa, Glycine max
  Coding DNA Sequence Number=SeqID_91470
MSLPSAVHVSSTFESGAPRMSLPSTVRQFSILHFFSDPHECHCLALFMHPPPKEFGAMLYDCLRVDPLVQSSILHFFSEPRECHCLALFMCPPPSSLSPANVIA

SEQ ID NO: 183156 - protein, 59 aa, Glycine max
  Coding DNA Sequence Number=SeqID_91471
MKDGKRSSYIIGIGVNSGVGLGGKFLITLEPAPKWALPAGPRREPRSSGDVARTDGFRE

SEQ ID NO: 183157 - protein, 110 aa, Glycine max
  Coding DNA Sequence Number=SeqID_91472
MTRGNPSDLQPFDPEIDRTFHRLVRHHFIPFDHREHSITGESVHSVIGDFKHPNFEHYNFEHSNFEHSENIAQPPPYERTLREMVALISPTKACASNTLMRMSHMFVKLD

SEQ ID NO: 183158 - protein, 128 aa, Glycine max
  Coding DNA Sequence Number=SeqID_91473
  Subcellular localization annotation: CTP_CleavageSite=41; ConfidenceScore=5.22e-01
MTLVSHDMRGYHMVTRTFGQPGADVPVGARRLTSSFAPFVVLTREVTCGVTLWLPAPFVNKGQSPLTRKETNIVFCTFCHPDPSSQGICGGYLMVTRTFRQPVANKPVDARRLTSSSAPFVVLTREVR

SEQ ID NO: 183159 - protein, 66 aa, Glycine max
  Coding DNA Sequence Number=SeqID_91474
MVWRLQSSFFLLHFAAIDLQEAKDSIDEEDPRPTSSTWSYIMWYQEHLRLGDVLLLPLSFCSVNSL

SEQ ID NO: 183160 - protein, 79 aa, Glycine max
  Coding DNA Sequence Number=SeqID_91475
  Subcellular localization annotation: CTP_CleavageSite=37; ConfidenceScore=5.49e-01
MGVQIATRPTWAFHDVPPKGDFQPFFVVRRSFFVVLRSSTDKNNLTKHFVLKELRRSDFLITIEEYVGARETPSSTTKR

SEQ ID NO: 183161 - protein, 137 aa, Glycine max
  Coding DNA Sequence Number=SeqID_91476
  Homolog annotation: Hit_ID=Q6UUU1; Match level="QueryCoverage=63%, HitCoverage=55%, E-value=3e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRSLVRSPVPAFRFTGVIPAVMGR

SEQ ID NO: 183162 - protein, 160 aa, Glycine max
  Coding DNA Sequence Number=SeqID_91477
MWAFLIGRQIDWAHLVRYRMHKALRANAPLPYPQLVTLFLRHFQIPLDDEPFVQVKRYFAIGVGAVTSFGYRKDQNGQWLKKDALPPQDERTPSPPLQRDDSTHMTEVLSKLRGLRTYVGDRFDSLDNRFAGMDIRLTQLEEDVGYIRQSFDLPPPPPPS

SEQ ID NO: 183163 - protein, 40 aa, Glycine max
  Coding DNA Sequence Number=SeqID_91478
ALKGVDDTPQPKSKATSTRWIVVKCDKQKGSTECGYYVMH

SEQ ID NO: 183164 - protein, 94 aa, Glycine max
  Coding DNA Sequence Number=SeqID_91479
MNVLSGAPLFCKITRAPNIFMVCVHKDPLGSDQGVPMNPKRIKVIPEWPTPPSVEGRSPEYEEPRDLRSNPFQGGGNDVILSCKGIGKTPSRLS

SEQ ID NO: 183165 - protein, 323 aa, Glycine max
  Coding DNA Sequence Number=SeqID_91480
  Gene Ontology: Mol. function=motor activity; Cellular component=cell projection
  Homolog annotation: Hit_ID=UPI00016621D1; Match level="QueryCoverage =82%, HitCoverage=40%, E-value=1e-17, Identity=29%"; Hit description =UPI00016621D1 related cluster
RATRPHLKRAAHICLKRLHVLALKGLHVLAFSGLHVLDFRGLHVLALRGLHVLAFRGLHVLALRGLHILCFSGLHILAFRRLHILAFIWLHILAFRWLHVLDFKGLDVLIVKGLYVLAFRGLHTLAFRGLNVLAFRGLQVLALRRPHILAFKGLYVLAFRELHVLAFKGLYVLAFRRLHAVAFNGLHVLGFRGLYTHAFRGLHILAFRGLHVLTFRGLQALTIRGQHVLALRGLHPLAFRGLHVLTLRGPHVLTFRGQHAFAFRGLHILASRGQHVLSLRGLYILAFRGLHVLAFRGLHVLALRGLHVLSIRGLYVFAIRGLH

SEQ ID NO: 183166 - protein, 112 aa, Glycine max
  Coding DNA Sequence Number=SeqID_91481
MSLPSAVHVSRYQCEASGDWEARYSVVFQIGSFAKYKKKKEEVEMRVVIAKRAGRTKLVSYLCFPLISDERLACSVKFGNVAEVEKRKQPGSPGRAELAWASWAANISPILL

SEQ ID NO: 183167 - protein, 79 aa, Glycine max
  Coding DNA Sequence Number=SeqID_91482
MNESEYRTQGTNASEARLTGALSKGGKMRGVATNVYLWKTSKKPRKLVKMKILSSGVVFTFEEGISTSHICLKGQQPIF

SEQ ID NO: 183168 - protein, 38 aa, Glycine max
  Coding DNA Sequence Number=SeqID_91483
MGTTTGEELATQLAQASKVASSRSNRLLEEESGRPKWA

SEQ ID NO: 183169 - protein, 93 aa, Glycine max
  Coding DNA Sequence Number=SeqID_91484
MSSVDRTIDVRPRPTDRGEISFSFLHEKRHHPDRTEAIVITSPKTTIDWQDTAREQKESGGEAYASMPTAPTLYYWWLIGPFAYPVFWLASKE

SEQ ID NO: 183170 - protein, 208 aa, Glycine max
  Coding DNA Sequence Number=SeqID_91485
  Gene Ontology: Biological process=transposition, DNA-mediated
  Homolog annotation: Hit_ID=Q6UUU1; Match level="QueryCoverage=28%, HitCoverage=40%, E-value=2e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 183171 - protein, 314 aa, Glycine max
  Coding DNA Sequence Number=SeqID_91486
  Gene Ontology: Cellular component=viral envelope
  Homolog annotation: Hit_ID=Q84VI1; Match level="QueryCoverage=100%, HitCoverage=50%, E-value=1e-145, Identity=77%"; Hit description =Envelope-like protein
MAQKKSAPITPATSRRSKVAIPSKKRKEISSSDTDDDVELDVSTSKRAKTSGRKVPGNVPDAPLDNISFHSIGNVEKWKYVYQRRLALERELGRAAMDCKEIMDLIKAAGLLKTVSKLGDCYEGLVREFIVNIPSDISNRKSDDYQKSVCQRKIAKEITAKQVQHWPKKGKLSAGKLSVKYAILHRIGAANWVPTSHTSTVATGLGKFLYAVGTKSKFNFGNYIFDQTVKHSESFAVKLPIAFPTVLCGIMLSQHPNMLNYTDSVMKRESPLSLHYKLFEGTHVPDIVSTSGKAAASGAVSKDALIAELKDTCK

SEQ ID NO: 183172 - protein, 173 aa, Glycine max
  Coding DNA Sequence Number=SeqID_91487
MSVSGCYSGFFVLQIGKRMVYTDNHSGISARQRDSNVSMTDRFELPVEDEENEERTMNLLKNSRKPSRLLTEDRDSNVSMTDLVCAEDGFLQKQPPSGGISAQQKNVYTDNHSGISARQRDSNVKDDVSLCVLSGFSSYRQQKNVYTDNHSGISARQRDSNVSMTDLVSAEDD

SEQ ID NO: 183173 - protein, 291 aa, Glycine max
  Coding DNA Sequence Number=SeqID_91488
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=79%, HitCoverage=86%, E-value=5e-93, Identity=74%"; Hit description =Photosystem II 44 kDa reaction center protein precursor
  Pfam annotation: Domain name=PSII; Domain location=65-291; Score =194.5; E_value=2.6e-55; Accession=PF00421.10; Description =Photosystem II protein
ALGVVGLALNLRAYDFVSQEIRAAEDPEFETFYTKNILLNEGIRAWMAAQDQPHENLIFPEEETTGFAWWAGNARLINLSGKLLGAHVAHAGLIVFWAGAMNLFEVAHFVPEKPMYEQGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLEPLRGPNGLDLSRLKKDIQPWQERRSAEYMTHAPLGSLNSVGGVATEINAVNYVSPR

SEQ ID NO: 183174 - protein, 217 aa, Glycine max
  Coding DNA Sequence Number=SeqID_91489
  Homolog annotation: Hit_ID=A5B939; Match level="QueryCoverage=17%, HitCoverage=24%, E-value=9e-07, Identity=69%"; Hit description =Putative uncharacterized protein
GPKPEETLVEARSDTDVQIVQSDLVSLRIAGARGRVLSELAMRDEPEAGLRCPTARYLDPTKVLSIKTAGRCHGSRIRRGGRCKTQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVE

SEQ ID NO: 183175 - protein, 56 aa, Glycine max
  Coding DNA Sequence Number=SeqID_91490
MAFNLNKHKQTAKARVYVALHYNDINSMTSYGYPTFEVNPSPLGLTWANGVPTLGL

SEQ ID NO: 183176 - protein, 319 aa, Glycine max
  Coding DNA Sequence Number=SeqID_91491
MEEQGQYQQPAAVAHKDTNQEGGREAKIGRERQKYYITERKYEMVELVLDRENEGPEDGKVRLRYIREYVVLISSIDEDQLKRWTRQGKEIIGGVPLHVWNGHCFEQLVGMMGRAPKENEPNQKVDLSHNEESGGKKIDSARKINEGKGDMDSIYLKHTKQHLGVSYDVGSIRCTIIVLSGLKIRLSQASTSFLFLFDLELRGIRENDAILVVDNVYCPVDLGQIGRPRVASIDSSFLKSGSMYVIDWGPKPFRVLDCWHNDKSFEGVVEMCWRKMKVQGKYHEISRENNIHDVKEEDRCFALRDCVDAKSIGKCTGSS

SEQ ID NO: 183177 - protein, 129 aa, Glycine max
  Coding DNA Sequence Number=SeqID_91492
  Subcellular localization annotation: CTP_CleavageSite=31; ConfidenceScore=5.57e-01
MALKVVNYNKLPSPIVSSSSVSLCVAQRGSTASNGGSWWPPVVVGGGKGGVRISLISLSGSPLFSRSAQILTQRNFLCTMARSPSQFSLSAIPSRVGIDLSAPFALSETSIFFIFKIPTVRLFRNVLGS

SEQ ID NO: 183178 - protein, 173 aa, Glycine max
  Coding DNA Sequence Number=SeqID_91493
MSSKVTLMMPKNQDLSKLQRIKIQESSFKNQDSRIIKIKIQESREDSIKIRYILCGTSRGYIYLGCYTENKRGYISCGSIQVEGTSTWLFKENKGGYIPSGSLACKGFYKVERNLKNRWLLGDWMLIRQALKNVVFHFLAKPIHWLSERPLSARKNREEDELYMCSKCTASSY

SEQ ID NO: 183179 - protein, 61 aa, Glycine max
  Coding DNA Sequence Number=SeqID_91494
MGHLSDQGVPMNPKRIKVIPEWPTPPSVEEKSLEFQEPRDLRSNPFQGVGNDAILSHKGIG

SEQ ID NO: 183180 - protein, 141 aa, Glycine max
  Coding DNA Sequence Number=SeqID_91495
MVSGVRSIAFHPDGQILFAGLEDSLKLIEPYNGGLETEKKESTKQKLSLQGRQMEKVEAGVGPPFGLCSMSVDNESKEIKNIYIDLWTARSMSGANKKMIEALAARKKEEYLKKEEYLQQFKMNCHKFHFQSFHPIYACFQ

SEQ ID NO: 183181 - protein, 113 aa, Glycine max
  Coding DNA Sequence Number=SeqID_91496
MYEYPRRTRALTRKHSLQNSYGYSCSVGKREMAPKKLSTKRSRRDATGEGSSAAPEFDSHRFRSAEHQQRFEAIRGWLFHRERRVQLREDEYKDFQEEIARKLWTPLVTCVRG

SEQ ID NO: 183182 - protein, 98 aa, Glycine max
  Coding DNA Sequence Number=SeqID_91497
  Homolog annotation: Hit_ID=A5AK77; Match level="QueryCoverage=89%, HitCoverage=11%, E-value=3e-09, Identity=37%"; Hit description =Putative uncharacterized protein
MTQPPPRERTLREMAAPDFTYESLCIQYPDEDVPYVLKIGLIHLLTKFHGLVGEDSHKHLKEFHIVCSTMKPPDVQEDHIFLKAFPYSLKGVAKDWLQ

SEQ ID NO: 183183 - protein, 58 aa, Glycine max
  Coding DNA Sequence Number=SeqID_91498
  Gene Ontology: Mol. function=aspartic-type endopeptidase activity; Biological process=DNA integration
  Homolog annotation: Hit_ID=Q2HW00; Match level="QueryCoverage=96%, HitCoverage=52%, E-value=3e-13, Identity=55%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic, putative
FMEKPKTPHFLAAKRILRYMKGTLDLGILYPYSHKNIEGEVFGYSDSDWCGDKDEKAC

SEQ ID NO: 183184 - protein, 115 aa, Glycine max
  Coding DNA Sequence Number=SeqID_91499
GDDPGHLRANVFQEGGNDENHETGQIEAKGPSGEGRRPKWRRTKAQVEKDKAPEWRRTYQGNPCGVYPDLSSFIGSGVYPDLSSFTGSGVYPDLSSFTGSGVIQTFVAFIKRSAP

SEQ ID NO: 183185 - protein, 125 aa, Glycine max
  Coding DNA Sequence Number=SeqID_91500
  Pfam annotation: Domain name=Transposase_23; Domain location=51-113; Score=-14.9; E_value=0.051; Accession=PF03017.5; Description =TNP1ENSPM transposase
  Subcellular localization annotation: CTP_CleavageSite=34; ConfidenceScore=5.15e-01
MLSFSQMQSQFQSQMQSHILALPPELKVGPSAARVNTKESCVDPSRNDPNMSDSDKCRLYIEENPPRLVALGRVYDGSTTIHNIPLLHYQVKVGVEKVKDTDAPFPVPTDEGTVRPTKPANRSDH

SEQ ID NO: 183186 - protein, 104 aa, Glycine max
  Coding DNA Sequence Number=SeqID_91501
RSAPGSGQAADAIAEDPAGAAALSIVGSVPVPVCRRAGGNRAFGHLLAAGHAGLLLGRQGGHHRADEKVQPGAVARRVLFGMRAAVAAGRQHPKPAGGGGDHGR

SEQ ID NO: 183187 - protein, 84 aa, Glycine max
  Coding DNA Sequence Number=SeqID_91502
  Homolog annotation: Hit_ID=A1FRL5; Match level="QueryCoverage=100%, HitCoverage=18%, E-value=4e-44, Identity=100%"; Hit description =Putative uncharacterized protein
MTFKCTGCGAEVTVNTESTMTARCHWCRHVFGVNEQIANGAVPDAVLPFHIKKDDAVARIRQFVDKRRMFALKAFKDQFTPENV

SEQ ID NO: 183188 - protein, 124 aa, Glycine max
  Coding DNA Sequence Number=SeqID_91503
  Gene Ontology: Mol. function=nucleic acid binding; Biological process= DNA integration
  Homolog annotation: Hit_ID=Q9ZQK1; Match level="QueryCoverage=76%, HitCoverage=24%, E-value=7e-09, Identity=35%"; Hit description =Putative retroelement pol polyprotein
MEHKAYWALKFLNFDEKASREHKKIQLLDLEEIKLKSKWFEPFVIKEVQSYGAIELCDPQSQNPDRTWVVNGQSEEGTEKWLRKHFLKNSPFAKRMPRAKCTFGHALSRDSQALSDKPWHLRLI

SEQ ID NO: 183189 - protein, 107 aa, Glycine max
  Coding DNA Sequence Number=SeqID_91504
  Homolog annotation: Hit_ID=A5B612; Match level="QueryCoverage=86%, HitCoverage=33%, E-value=5e-15, Identity=45%"; Hit description =Putative uncharacterized protein
MEIFIQSIDPGAWNAIVKGPFIPIKNVNGELVCKEWDEMKYDEKRKVQDDQKAKNILTSGLSSDEFFHTARCKSAKEIWKILEVTHEGTSDVRARNHTLYPNMKLSE

SEQ ID NO: 183190 - protein, 18 aa, Glycine max
  Coding DNA Sequence Number=SeqID_91505
MEGSGNRLLGSVIDYQKT

SEQ ID NO: 183191 - protein, 92 aa, Glycine max
  Coding DNA Sequence Number=SeqID_91506
MVAITLAKVHQPPFLREYDSNATCACHGEAPGRSIEHCRALKRKVQVQAIGLFAQATCAPEFGLPRPFNQRLLVLHVGGAAVKQQREVSYQE

SEQ ID NO: 183192 - protein, 74 aa, Glycine max
  Coding DNA Sequence Number=SeqID_91507
MVCASCVRVIPLWEKRLVDIPGRYHSHLVGDEGRQKVFVRHWDQGEFWNWPRGKVLHRVGIDAKGGIAGRASRG

SEQ ID NO: 183193 - protein, 86 aa, Glycine max
  Coding DNA Sequence Number=SeqID_91508
MKEGIGHILDLTPIGEKRKESLKENVEAYLDWRIRIEQQLKRKSTSKSYGPHSYPKKDKGQGILGMTSSKPKDDKGKTIEKQPPKA

SEQ ID NO: 183194 - protein, 200 aa, Glycine max
  Coding DNA Sequence Number=SeqID_91509
  Homolog annotation: Hit_ID=Q84VH5; Match level="QueryCoverage=82%, HitCoverage=28%, E-value=3e-78, Identity=80%"; Hit description =Envelope-like protein
MSIRKCLSEENVLDSPPAVINKYLGRPTEGVVDIAVSEHQIAKEITAKQVQHWPKKGKLSAGKLSVKYAILHRIGTANWVPTNHTSTVATESFAVKLPIAFPTVLCGIMLSQHPNLLNNIDSVKKRESPLSLHYKLFEGTHVPDIVSTLGKAAASGAVSKDDLIAELKDTCKVLEATIKAKHREENGAGTPDQKTLRQWH

SEQ ID NO: 183195 - protein, 160 aa, Glycine max
  Coding DNA Sequence Number=SeqID_91510
MQFKDTVDSMQQAFTRTATQISKLVDDMANTAARQEEEWAEIETHEERIFKVTSIHHQMTTEEKTFEVSSTPKYSCPASADYVGGTEKGRLELSEEEVEQEIVLSASTMIQQIPLEKELGDEIDSLVDNEKCDDPKDNCVDHVVFEELEKMRPPEKPIIN

SEQ ID NO: 183196 - protein, 160 aa, Glycine max
  Coding DNA Sequence Number=SeqID_91511
MTPRINHVSRFALLRPDPQELATKLCIPGRGFELNANGQPLKILRKKMTTLAQTWSVLSFSKLIPTSHTSYVTLDRAKLIYGIIMKMDMNVGYLISHQISLIAQHDTSRLGFAALITTLCKARGVQSDSRSLENLSLAINLAYIKKNYWNLDDPIVSFRY

SEQ ID NO: 183197 - protein, 190 aa, Glycine max
  Coding DNA Sequence Number=SeqID_91512
  Homolog annotation: Hit_ID=A5BQX5; Match level="QueryCoverage=61%, HitCoverage=35%, E-value=4e-11, Identity=34%"; Hit description =Putative uncharacterized protein
MTRGNPSDLQPFDPEIDRTFHRLVRHHFIPFDHSEHSITGESVHSVIGDFEHLDLEHYNFEHSDSEHSDFAHSKNMAQPPPRERTLREMAAPDFTYESLCIQYPDEDVPYVLKTGLIHLLPKFHGLAGEDPHKHLKEFHIVCSTMKPPDVQEDHIFLNAFPHSLEGVAKDWLYYLAQSPSRAGMTLREYS

SEQ ID NO: 183198 - protein, 201 aa, Glycine max
  Coding DNA Sequence Number=SeqID_91513
  Homolog annotation: Hit_ID=A5AZ88; Match level="QueryCoverage=34%, HitCoverage=6%, E-value=2e-07, Identity=41%"; Hit description =Putative uncharacterized protein
MEDGFSQGSVPIILGRPFMKIARTKIDVYAGTLSMEFGDITVHFNILDAMKYPSEDLFVFRAEIIDHVVDEYMTDLYSNLHASHSSCIEFEIVLDHMSEFDAESESESDIDCMSGGGVLPLEIDFIESDRTNHVSGSTHTSDFLYEVNLTTVSLMVFLVICKLLLLLRIRKRPHSPAPLALLPIGGCLSACAMPLVPSSGA

SEQ ID NO: 183199 - protein, 55 aa, Glycine max
  Coding DNA Sequence Number=SeqID_91514
MEFSSKLENGGHMNDNAIHSWGSEKGWGGILLVENDFEWQSGLKYILLRCGYGAH

SEQ ID NO: 183200 - protein, 118 aa, Glycine max
  Coding DNA Sequence Number=SeqID_91515
MAPRKLSAKRSRKDAVAKGTSAAPEFDSHRFRSAEHQQRFEAIKGWSFHQERHEEIARRRWTSLVTPMAKFDPDVVLEFYANAWPTEEGVRDMRSWVRGQWIPFDADALSQFLGDPLV

SEQ ID NO: 183201 - protein, 48 aa, Glycine max
  Coding DNA Sequence Number=SeqID_91516
MDERQSRSRRAWVMVLDRVMIPPPFGLTMVWGGGAESCEDDCEVGGGD

SEQ ID NO: 183202 - protein, 147 aa, Glycine max
  Coding DNA Sequence Number=SeqID_91517
MQSLEEKEHEIRIMTENVSQFVRLSVKECVNRNPVKESIIHRKNLGSRQIPNLFQIWGSYVSSQICPKFGGVMFQVKFVPKLGELLGESVKCDPEALGNDHSLISTMLMQSYPVKALARRLQVDWARDPRKGPRVLMNLRVDFKPMG

SEQ ID NO: 183203 - protein, 108 aa, Glycine max
  Coding DNA Sequence Number=SeqID_91518
MSEIEEVQEQMKADLEAMKEQMTAMMEAMMSMRRMMEVNMAIVVAASTATKVDLTHPFGLNQVPQPMGETHKVPRDHTLAAFEPPLGYATEGQAFGGIPLPNTLEGPQ

SEQ ID NO: 183204 - protein, 152 aa, Glycine max
  Coding DNA Sequence Number=SeqID_91519
MRYQMMEKVIHISQEVNDKVDELARLATSPKPGQLKMFILHSVPEPSVLEKECLQVEENPSGWKNKIVKYLKHKALPIDKRKSKKLRMQASRLTMCFKNYMKVSAACILGENNGHKSVEGRVLLTNFEDRLFKLCREMAPMPKAWEFDTSAD

SEQ ID NO: 183205 - protein, 69 aa, Glycine max
  Coding DNA Sequence Number=SeqID_91520
MAYQIALPSSLSNLYNVFHVSQLCKYLHDPSHANKALKRKRDFVGQGDLGRCIRRRRHVGARVKCEKPI

SEQ ID NO: 183206 - protein, 269 aa, Glycine max
  Coding DNA Sequence Number=SeqID_91521
MVMYVKSTQYRIWLIITNRDILIPRHEDEWTDVDLATMEHNTKARYTLTCALSKKEKAETLTKHYESFTMKDEESVDDIFKHSSKCKDSRFKKKNMEKINEIIYFVCRKLGNMKDDLDNEKSSSSYNEQANIYLMADTNDKVEVKTFSKSNTCALSDDEKDMPYDEESEGNLSRRHALSTSSARSASRLSPSRLSASLALSENSLTRAKRDVKELPCYGRLNPQLGILACRNLPFGERATRGSWVHLPREEGAQSRHQRLFEENVGKTG

SEQ ID NO: 183207 - protein, 66 aa, Glycine max
  Coding DNA Sequence Number=SeqID_91522
MWLRKRVRMEDCLEGPHLGNHETQLKLGSGGHMNSPNAITFMWLQKRMRMEDCLEGPLLGNHETQL

SEQ ID NO: 183208 - protein, 108 aa, Glycine max
  Coding DNA Sequence Number=SeqID_91523
MGMRGCISYNPVLAIRQLGYPMRGALLEEGLTPFITRGFNSTNTGVHQRVCKAWEMVEKKDEELRGSSNGPIGDYHRWLKAYAQGLDWLLNLRTTQEVEGEAPEEDEE

SEQ ID NO: 183209 - protein, 103 aa, Glycine max
  Coding DNA Sequence Number=SeqID_91524
GSSQYGVATENNGGLWWPMVAVGDGESAWDVRNGFGRKKEEEMMFFLSYTKAKAENAQVRNGLGHGNVAHTPDIFSKIPTTAHVASSRSFIKRLPQEASSWLL

SEQ ID NO: 183210 - protein, 137 aa, Glycine max
  Coding DNA Sequence Number=SeqID_91525
MAYTPSENVNNSTHILIESRQPQTDDAHVSQTMGETHEIPHHNLVDFKPCLGYATKGKVVGGKNPHAMTEMGELDHLEERLKDIEGGEDYAFANLEELFLVPNIITPPKFKVSDLDKYKGITCPKNHLKMYCRKDLM

SEQ ID NO: 183211 - protein, 141 aa, Glycine max
  Coding DNA Sequence Number=SeqID_91526
  Homolog annotation: Hit_ID=Q6UUU1; Match level="QueryCoverage=75%, HitCoverage=94%, E-value=4e-23, Identity=51%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPWRLPRALSVPAFGYRCHSAVMA

SEQ ID NO: 183212 - protein, 92 aa, Glycine max
  Coding DNA Sequence Number=SeqID_91527
MQPTRYPLDPDKSNRALWFLALITGLSQLFGVLVTLSKVIRPPITRAFIEKYCMPRQAQGDAHQAVDAPPPPHQTDPAGSLGMERYLQHLVH

SEQ ID NO: 183213 - protein, 100 aa, Glycine max
  Coding DNA Sequence Number=SeqID_91528
  Homolog annotation: Hit_ID=A5AEB7; Match level="QueryCoverage=100%, HitCoverage=7%, E-value=4e-20, Identity=56%"; Hit description =Putative uncharacterized protein
MIENPQIIGNNHTYQVIDEEYQGNVEQPVEQQVPQEIDEVTLGRSTKVKRSAIPSDYVVYLQESDYNIGAANDLETFSQAMSSKESNLWHNDMKDEMDSM

SEQ ID NO: 183214 - protein, 68 aa, Glycine max
  Coding DNA Sequence Number=SeqID_91529
MENSPGNQFNKDQGGPSNRPQQQGPSLYDRMMKLEETLSQFMQVSISNQKSTESAIKCDILEISTRNF

SEQ ID NO: 183215 - protein, 64 aa, Glycine max
  Coding DNA Sequence Number=SeqID_91530
MWTTTVEDRRKRRMNDGCRRTVENLRVITHGNITDTLRKRLGLDFLHGNNFPQQFRENTKCQEG

SEQ ID NO: 183216 - protein, 196 aa, Glycine max
  Coding DNA Sequence Number=SeqID_91531
MGDQEETQEQMKADMSALKEQMASMMEAMLGMRQLMEKNMATAAGVSSAAEADPTLLATAHYAPPNAVGRERSTLGHTSNPHLGYNRVAYPYGLPPNYTPPVMHDDPDEVHEDHREYAQGDVDFYPSIPVEGSAPNTLPQHNLTAQPIFLSTKGPPPAAEERRKLDLLEERLRAVEGFGDYPFTDMTNLCLVPGIL

SEQ ID NO: 183217 - protein, 157 aa, Glycine max
  Coding DNA Sequence Number=SeqID_91532
MAPRKLASKRSRKDKAAEGTSSAPEYDSHRFRSAEQQERFEAIKGWSFLRERRVQLRDDEYTDFQEIVRWRWASLVTPMAKFDPDIVLKFYANAWPTKEGVRDMRSWVRGQWIPFDADAIGQLLGYPLVLEEGQECQYGQRRNRSDGFDEEAIAQLL

SEQ ID NO: 183218 - protein, 288 aa, Glycine max
  Coding DNA Sequence Number=SeqID_91533
MAPKKLSTKRSRRDATGEGSSAALEFDCHRFWSAEHQQRFEAIKGWSFHRERRVHLREDEYPDFQGEIDRRHWAQLVTPMAKFDPEIVIEFYANAWPTEEGEDQQCEFSQRRSQADNFDEEAIAQLLCIPGQDFTRTAAGRQVWIMRTNMTTLTQIWMTLLLSNVLPRMAPTRHPLDPEKSNRALGFPALITGLCQSYGVLGDAHQDAGTPPPPRPADLAGPLGVEHYLQHLVRQQVANHCGQVAWPGDWPNAQAGEEPAGSPGEADESCMDEDMTDLLGFLGGTGAI

SEQ ID NO: 183219 - protein, 202 aa, Glycine max
  Coding DNA Sequence Number=SeqID_91534
  Pfam annotation: Domain name=Transposase_23; Domain location=87-157; Score=5.2; E_value=0.00032; Accession=PF03017.5; Description =TNP1ENSPM transposase
MSRSSSSLPPEELQQLTQQIRDQLEESIIEKVTRQLMASFSQMQSQFQSQMQSQGLALPPVPQVGPSGPRVSTKESCVDPSGNDLETGDSDRCGLYIKANPAHLVALGRVYEGATVVHNTPLLPGQVKVGVEEVKDPDVAVPVPTDEVFLVGQTIHTFLAWSTHLVKSLSQQVTWDATVFGVFNPDFPLYIKHEDLSEIAHD

SEQ ID NO: 183220 - protein, 96 aa, Glycine max
  Coding DNA Sequence Number=SeqID_91535
MAPKKLSAKRSRRDAATERTSATPEFDSHHFRSAEHQRRFEAIKGWSFHRERRVQLREDEYTDFQEEIAGRHWTSLVTPMAKFDPERRECETCVHG

SEQ ID NO: 183221 - protein, 283 aa, Glycine max
  Coding DNA Sequence Number=SeqID_91536
  Gene Ontology: Mol. function=carbamoyl-phosphate synthase (glutamine -hydrolyzing) activity; Biological process=pyrimidine nucleotide biosynthetic process
  Homolog annotation: Hit_ID=Q6UUU1; Match level="QueryCoverage=21%, HitCoverage=40%, E-value=4e-18, Identity=78%"; Hit description =Putative uncharacterized protein
GPALPGINRDTRIYLVCRSDLPSQWLLFLSAVPPVQLLTGWCVTAKAPPDISAGKCSGHGRVPFAIQAAQLLGRAIAAGLFDITPAGERGMCCKAIKLGIGLQNLENGTVMITSQNHGFAVDESTLPSNLKVTHRSLFDGTNHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 183222 - protein, 38 aa, Glycine max
  Coding DNA Sequence Number=SeqID_91537
DRAHKTLSGLGEVQQGPGVSSSDYGPLSVLRSEKPARF

SEQ ID NO: 183223 - protein, 224 aa, Glycine max
  Coding DNA Sequence Number=SeqID_91538
LHVLAFRGLRVLAFRGLHALAFRGLHVLPFGGVHVLAIRGLHVLAFRGLHALTFRGLHALTFRGLHVLAFRGLHILTFRGLHRTTRPHVQRATRPRLQRTTRPHLHRAARPRLHRTPHLRLQRTQGPGPPPNIGGRPTVRAQPEREAIVQLLCIPGQDFTQPLQGDECGSCTPPQLRSPFAKVLVGLCRHDIGIAPTRHPVDPEKSNRDLGFPALDMGLCQSYG

SEQ ID NO: 183224 - protein, 140 aa, Glycine max
  Coding DNA Sequence Number=SeqID_91539
NGELVPKEWDEMKDDEKRKVQDDQKAKSILTFFILQGAKVKRKYGKCLMSLIQALRISSKEDCKESSSDDEDAKNLSLMMKKFGKFLKRSKDIKFAKPSKKIESNNNTFTCLECGKQGHIKFVFLMVDLMDDSSTIEETE

SEQ ID NO: 183225 - protein, 147 aa, Glycine max
  Coding DNA Sequence Number=SeqID_91540
  Gene Ontology: Biological process=transposition, DNA-mediated
  Homolog annotation: Hit_ID=Q1J7G7; Match level="QueryCoverage=23%, HitCoverage=48%, E-value=7e-12, Identity=97%"; Hit description =Transposase
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMSMSAGSQIP

SEQ ID NO: 183226 - protein, 226 aa, Glycine max
  Coding DNA Sequence Number=SeqID_91541
  Homolog annotation: Hit_ID=Q6WAY6; Match level="QueryCoverage=53%, HitCoverage=20%, E-value=2e-13, Identity=32%"; Hit description =Putative uncharacterized protein
PPLMLSSYITIARKVQWWLSWQICLTPLTGGVRKTVHGLSVVYPLSVCGWFHTYSNKTQDTRVRFKVIAHAPEKGRVDWDQHLAGIGGSAINWFPRWKEGKEGVLFSCGDYPNVPLIGTRGCINYNPALTIRQLGYPMRGAPTKESLSPFLVRDLGAQSLKVIQRVHKAWRSLLRKDKELRGIRNGVIGAPEDDEEVRALKLELGKARLAKEKFKSAATHIRKECT

SEQ ID NO: 183227 - protein, 172 aa, Glycine max
  Coding DNA Sequence Number=SeqID_91542
MPISPAEVSVGLCRHDIGIAPTRHPVDSEVSNRPRGFPALVTSLGHSYRVPVPPPPNKDRARKTPSGPGEVQQGHGVSSSDYGPLSVLRGARRRQQGVGRDTTTAWRWPAAGNRCTATTSKAPQLIYKGWSVAYDSWSTSRRPSPKSKVRKSTRSVTNKSSRVQLKTLKKRY

SEQ ID NO: 183228 - protein, 197 aa, Glycine max
  Coding DNA Sequence Number=SeqID_91543
  Pfam annotation: Domain name=zf-CCHC; Domain location=160-177; Score =14.8; E_value=0.0086; Accession=PF00098.14; Description=Zinc knuckle
MVKKFRKFLKRSKDKRFSKPSKKTESNNNTFRCFECGKQDLMDDSSTIEEIEVNSEFEKVLEAFNEMHEKAQRLAVSNNKLRKDLKLHISNWLQHKKMNKGKSDHSHLLSVQKPTTNKIGLGYNKQTTFSKKTKFASSKKMNPNKVSKKKNLVHSKPKTKTCHYCMKIGHISYKCYVRRFYIPRGVTKSKRLAIVLG

SEQ ID NO: 183229 - protein, 178 aa, Glycine max
  Coding DNA Sequence Number=SeqID_91544
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=50%, E-value=7e-24, Identity=100%"; Hit description=LacZ protein
MPFRMRVRRGSRVRFPKEERCAESPPTFICGKRRKNRRKSVKTKILSSGVVFTFEEGGHFKALNLKNGPFTCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 183230 - protein, 243 aa, Glycine max
  Coding DNA Sequence Number=SeqID_91545
  Subcellular localization annotation: CTP_CleavageSite=67; ConfidenceScore=5.81e-01
MFTYGTSFHRQTWSSPQACSMNFTESSNGCTGTGFSPNSQRSKSTSLWSKNSTPTFMTQRTAIVAALCTTGGGFVLNASGSPWKLLRKDLNSLAQTWSVLSCFNLVPTSHTSNLNVERARLIYGLVMKMDMDLGSFILGQITQIVQSSTSWLGFPGVIFDTPTFESLSLVINLAYIKKNCWNLADPSITFVGPRRARARATAPDAPPLAQPPPPPASRRQSPSTSFHLLGSAGYCLARSPVLY

SEQ ID NO: 183231 - protein, 79 aa, Glycine max
  Coding DNA Sequence Number=SeqID_91546
  Homolog annotation: Hit_ID=A7R8H9; Match level="QueryCoverage=94%, HitCoverage=21%, E-value=2e-08, Identity=40%"; Hit description =Chromosome undetermined scaffold_2575, whole genome shotgun sequence
MLMRAKLEELQNDLITIENYDFGESLSLLQLSMAECHNLCPRCMDMFYNEKLLMHSDLDMAFAKLDMHTKKINEIYKTR

SEQ ID NO: 183232 - protein, 416 aa, Glycine max
  Coding DNA Sequence Number=SeqID_91547
MAPKKLSAKRSRRDATAEGTSAAPDFDSHHFRSAEHQQRFEAIKGWSFHRERHVQLKDDEYADFQEEIAHRHGTSLVTPMAKFDPDIVLEFYANAWPTKEGVRDIRSWVRGQWIPFDADALSQFLGDPLVLEEGQECEFNQRRNRADGFDEEAIAQLLCTPGPDFARIAAGRRVRIMRTSMTTLTQMWMKLLLSNILPSDHNSDLPLPKCQLVYAILTWMSVHVAQLIVDTIYLFAGMPPTMHPLDPDKSNRALGFRALITGLCQSFRVPVTPGKVIRPPITRAFIEKYCMPRQAQGDAPQAADAPPPPHQADPAGSLGMERYLQHLARQQAANHRGQVQIQECLYQLSLSQQVQGFAPFASPTSDQFRAEAAWLEDWPEAQAGEAPAGAPGDAEEARMDEEMTDLLGFLGGSGAT

SEQ ID NO: 183233 - protein, 161 aa, Glycine max
  Coding DNA Sequence Number=SeqID_91548
MASRKRARTKDIPSSSNPFTSTTVMEPDAQQAHSLIPMLQNLFRGQLMIVYNQQELAHNKPIISMDQFLEKVAWPEAQLPLERAHKVVPPRPIPARTEPTAAEPQPPVVDPPASLELETLSPPAPPLIIIPDDSADEAAAPLDSPSCNIDNGSDFSDWMDC

SEQ ID NO: 183234 - protein, 61 aa, Glycine max
  Coding DNA Sequence Number=SeqID_91549
MELNTKIVKSPMAAHPHYSNVIIPIKRLMGRDWNCIVQHVSHEENQSVNVLAKMGAESGDL

SEQ ID NO: 183235 - protein, 214 aa, Glycine max
  Coding DNA Sequence Number=SeqID_91550
MVFHLRLVMSFKTKKGEHRLKGAIKGINSRKHQQESSQGYCASNQWGETHQKIMMMDGSNSHKGNRGIAQAERHPPIGKSAEGAGECGLFLILRSNSDLHITRKIIKETIVRFTSQAFKHLVNEWQRKMVLFGNLVQPPIVDADSPTVLHPSRNQLFLLIFYHGEAGFLWDYLDGTHPLAVRERINDSSLQKLGYLLLHYIKNHWVESSLWLSY

SEQ ID NO: 183236 - protein, 49 aa, Glycine max
  Coding DNA Sequence Number=SeqID_91551
MEEKGWKKGTENDERKNSLRESSQVWVVGVDLGLRAHAWRECLYSRATR

SEQ ID NO: 183237 - protein, 153 aa, Glycine max
  Coding DNA Sequence Number=SeqID_91552
MTETLNKLPQHLQAVSPSHSSLMQIRGCHICDGAHEPGKSIAQVDSYREVNYMGAQKPPQIPRLQPRRTAGIQSREEFHTGLKLEESFGEPTNKLEGTLNQFMHIFMSKYRSTELSIKKLEIQVGQLAKQMAERPTSSFGANTEKNPKEECMA

SEQ ID NO: 183238 - protein, 81 aa, Glycine max
  Coding DNA Sequence Number=SeqID_91553
  Subcellular localization annotation: CTP_CleavageSite=63; ConfidenceScore=5.34e-01
MWVQIATRPTWAFQDIPPEGSCFWRKQPGSPGRAGKFKPRRFRNVSVGDFAKIFNRSSTFFVRSSSFFGLQLISKKPKINM

SEQ ID NO: 183239 - protein, 52 aa, Glycine max
  Coding DNA Sequence Number=SeqID_91554
  Homolog annotation: Hit_ID=Q2HW89; Match level="QueryCoverage=75%, HitCoverage=3%, E-value=5e-09, Identity=74%"; Hit description =Integrase, catalytic region; Ribonuclease H
MEAVLPFEVEIPSLRILAESGLEESEWAQTRYEQLNLIEGIPVRCNCLVAVI

SEQ ID NO: 183240 - protein, 274 aa, Glycine max
  Coding DNA Sequence Number=SeqID_91555
  Homolog annotation: Hit_ID=Q84VI1; Match level="QueryCoverage=100%, HitCoverage=40%, E-value=1e-105, Identity=75%"; Hit description =Envelope-like protein
MATSPKETSAPGSPAVRSSPHQEQPEFNIQPIQIIPGQASVPEKLVPRRQQGVKIAENPSLATSPREVDTEMDKKIRGIVSSILKDASVPDAEKDVPTSSTPDVSVPDVNKDVPTSSAPNAEAIPSPSEEESTEEEDQASEETPAPRAPEPTPGDLIDLEEVESDEEPIANRLAPGVAERLQSRKGKTPIKRSGRIKTMAQKKSTPVTPATSRRSKVAIPSKKRKEISSSDSDDDVELDVSTSKRAKKSGRKVPGNVPDAPLDNISFHSIGNAE

SEQ ID NO: 183241 - protein, 234 aa, Glycine max
  Coding DNA Sequence Number=SeqID_91556
MEGLVDLAVIDAFLAFHHGKESPVVAILAMYDTFDRGCEKSDARIFCCALALYVWLVSHPFLSATRSPLEGRIRILSSCEGCPNVLLMGTRGCINYNPVLAIRQLGYPMRECHQTKASRLSSHGGFSDHNARDRELRGSSNGIIGGYHKWLRVRTQGLDWLPNLKTVRDDEVKASEESDEVQALKAELERAWVVEEKFKSIAIKAAIVSSSSEEVKGIITGQRHDLEGRAKGLP

SEQ ID NO: 183242 - protein, 68 aa, Glycine max
  Coding DNA Sequence Number=SeqID_91557
MEREMILDTLPVLYYEKMVDYMPSIFADLVFVGERIEVGLGRGKFDYSALMNRKPGENGENKKEFYTN

SEQ ID NO: 183243 - protein, 130 aa, Glycine max
  Coding DNA Sequence Number=SeqID_91558
  Homolog annotation: Hit_ID=A6H5B3; Match level="QueryCoverage=51%, HitCoverage=84%, E-value=7e-28, Identity=88%"; Hit description =Putative ribosomal protein S3
ELRDHPKDAFGIQGSRTDHRTLFKKRNALAIRSQVGQGKESKSDSRSSGERNGSSLNRENGVVGELYKCRAARRSSRECCTLDGESPVAESITSLRSDPSSMGHVESRVNQQGPPCKAKYSWVTDSEVVP

SEQ ID NO: 183244 - protein, 156 aa, Glycine max
  Coding DNA Sequence Number=SeqID_91559
MTPTIPQLFLKSLQVMWDAIVFGLFNENFSLYIKHEDLSEITHGGQCLNISLIQLWILHMIETSMRAGKANVYGFLESQSIRRSGQSSSRAQRTIWAQRTSDAKHNFSALSVTRESRRAQESRPRAKREISLLSETFVSCQAQHTTSAQPKSTYSH

SEQ ID NO: 183245 - protein, 84 aa, Glycine max
  Coding DNA Sequence Number=SeqID_91560
MVLHLRLVVSFKTRKGKQGSKGLSKELIQGKSIWLEAYKNKIASIISKYACELGSINKNQAKAIVQAINGAKHIMMMDGSNSHK

SEQ ID NO: 183246 - protein, 95 aa, Glycine max
  Coding DNA Sequence Number=SeqID_91561
  Pfam annotation: Domain name=zf-CCHC; Domain location=8-25; Score =21.5; E_value=0.00084; Accession=PF00098.14; Description=Zinc knuckle
MQEKTSSMKCFKCLGRGHITSQCPTKKTMIMRGQDIYSSQDEATTSPSSSKSEEAKGEESSEEIYPQEEGQPLMVKEECKEVLRKKAQSFKNPGI

SEQ ID NO: 183247 - protein, 76 aa, Glycine max
  Coding DNA Sequence Number=SeqID_91562
MPFAGERGRGSRVRFPKEERCAESPPFICGKCQENRRKPVKMRILSSGVVFTLEEGRQKRGFCSYVPSFGEEIRPT

SEQ ID NO: 183248 - protein, 50 aa, Glycine max
  Coding DNA Sequence Number=SeqID_91563
MRPAQDVKEALLGGNLVEGYLGYACSKIPWTRMYVAKYLMKKERERARKE

SEQ ID NO: 183249 - protein, 168 aa, Glycine max
  Coding DNA Sequence Number=SeqID_91564
YPKHWSGPVAGKGPRSAYYYTTLHSALHIYRAPVQSLAELRGLPSLFPIPSPRLTGPYSGGESGAPRSTVERKILGPSSFSTGGMEKVDKTDSHFPVEKMEASEVGEPYDGQLSPAVRRGLSCSKKGWAEVRLPREETGDSWHLWLLRAIQLLAYESRKLNGAERPYA

SEQ ID NO: 183250 - protein, 423 aa, Glycine max
  Coding DNA Sequence Number=SeqID_91565
  Homolog annotation: Hit_ID=Q3JKP5; Match level="QueryCoverage=36%, HitCoverage=9%, E-value=2e-17, Identity=37%"; Hit description =Putative uncharacterized protein
RHVARQDHHRDAAVEDRLAHGDLQHARQLFRVGNQLAIVAAFAKQLLRMRFLEVAAADFAGRNVCGDRQHRHMVAVAVEQAVDQVQVAGAAGTGAHRQLAGELGFGAGGEGGHLFMAGAQPFDGAHAVQAVAKAVERIAGHAPNAFYAGLIQRFGDQCGYDAVRKGKERRTGESVTGRGGGNLPINAPSQRWGQGRHGAGGDVVALEDAGFARAAHPGTAGGVDRQGIGLHRRQQRAADRHAEFAQRAGGAAAGHHRAFGDIRRRLPQRLLIDAAAEVAGLQIPLGHQRQAQLRMGGAQRTPLIGENRVGGGAHVKDHGDIAGRTVGGQPAAHRDDRRHAAAGGQHQITIGRVALAAELALRVGQPQRVAGLDLLRQPARSDAVRQAAHADAEKAALAGRGGERIGAQRLLAVADADQRGDPL

SEQ ID NO: 183251 - protein, 50 aa, Glycine max
  Coding DNA Sequence Number=SeqID_91566
MAENLHGITHGNVSDALQKRLGVDFLHGNDFFTNFKKMREELATQLAQAS

SEQ ID NO: 183252 - protein, 128 aa, Glycine max
  Coding DNA Sequence Number=SeqID_91567
MAAQLIHDRVEMECLEGAWETLEGNVKCRFWGTIRFTATSLVHPDEPVRTLQLEPVQVIEVTSSEEDPEEDLEELPLEPAGDALDFLEGDEDPLPEVDSPEEVMSAYEADSTEDSGPREMATSGGSSS

SEQ ID NO: 183253 - protein, 39 aa, Glycine max
  Coding DNA Sequence Number=SeqID_91568
MEIIDRAGMSSYPVQQVCLFMHDPKDEHMQALKCILRYI

SEQ ID NO: 183254 - protein, 123 aa, Glycine max
  Coding DNA Sequence Number=SeqID_91569
  Homolog annotation: Hit_ID=A0PAV3; Match level="QueryCoverage=30%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVRNGKSTARTSALASVAVTLRVTTTPAALNAPLQGASHSPFRLRNCWEGRSVRASSLLRQLAKGDVLQGD

SEQ ID NO: 183255 - protein, 82 aa, Glycine max
  Coding DNA Sequence Number=SeqID_91570
  Subcellular localization annotation: CTP_CleavageSite=46; ConfidenceScore=5.29e-01
NRCGVYPDLSSFTGSGVYPDLSSFTGSGVYPDLSSFTGSGVYPDLSSFTGSGVIQKTLQPVSNDPLLLRFTSFGIRALVLDT

SEQ ID NO: 183256 - protein, 64 aa, Glycine max
  Coding DNA Sequence Number=SeqID_91571
MTKVNRGAISRLGRIDGDPVLRETRIWATWEYVSSVGGGQQGIVGLCAICGCGKLVVHHRPTAT

SEQ ID NO: 183257 - protein, 85 aa, Glycine max
  Coding DNA Sequence Number=SeqID_91572
EISILGSLEPIYMSYPNFVQVPLFDGMQPLFDHFEDVPPEGGCFWRKQPISPGRAGRFRNVFVGDFAKIFNRSSSFVLRRSSIFN

SEQ ID NO: 183258 - protein, 227 aa, Glycine max
  Coding DNA Sequence Number=SeqID_91573
  Gene Ontology: Mol. function=succinyl-diaminopimelate desuccinylase activity; Biological process=lysine biosynthetic process via diaminopimelate
  Homolog annotation: Hit_ID=P0AED7; Match level="QueryCoverage=100%, HitCoverage=60%, E-value=1e-120, Identity=93%"; Hit description =Succinyl-diaminopimelate desuccinylase
  Pfam annotation: Domain name=M20_dimer; Domain location=27-135; Score= 114.6; E_value=2.9e-31; Accession=PF07687.5; Description=Peptidase dimerisation domain
  Pfam annotation: Domain name=Peptidase_M20; Domain location=23-224; Score=-21.8; E_value=0.037; Accession=PF01546.19; Description =Peptidase family M20M25M40
  Pfam module annotation: Pfam domain module=M20_dimer::Peptidase_M20; Domain location=27-135::23-224
MARNERLDYCLVGEPSSTEVVGDVVKNGRRGSLTCNLTIHGVQGHVAYPHLADNPVHRAAPMLSELVAIEWDKGNEFFPPTSMQIANVKAGTGSNNVIPGDYFVQFNFRFSTELTDEMIKARVIALLEKYNLRYTVDWWLSGQPFLTQRGKLVDAVVNAIEHYNEIKPQLLTTGGTSDGRFIARMGAQVVELGPVNATIHKINECVNAADLQLLARMYQRIMEQLVA

SEQ ID NO: 183259 - protein, 130 aa, Glycine max
  Coding DNA Sequence Number=SeqID_91574
MVLSAVLPVQSERGGVIRPIRTQAYRAGPAHRQSGTVATVKNGNAGIECGPLRYYASWRKGGCELQGDYSWVTGRVSEFPSHDVVKRRPVNCNTTHYRANWSSAVAAALELVDPPGCRNSIHAGTKSMFG

SEQ ID NO: 183260 - protein, 395 aa, Glycine max
  Coding DNA Sequence Number=SeqID_91575
  Homolog annotation: Hit_ID=A7PI75; Match level="QueryCoverage=83%, HitCoverage=20%, E-value=5e-28, Identity=30%"; Hit description =Chromosome chr13 scaffold_17, whole genome shotgun sequence
MQQSGEVNLIYCKSKDQLADMFTKSLPINKLELKELEFAVPKARRSVEDILLCLNVLYVGDTLCVKTQTTDNDVCELGGSPGPVSPKNHQLKSPLSSHRKASISLNRLRSSIAELLHSDKPVSVDSNPEGFTAMTKLHIWKNVISQVLEQTETKICSLENELEPLQFEFGDGMPCYNTKSCDKEIGDYHKVTHRPELSQIGPSNDDNNIEKMMPLSANLHGMHDTTKENDINSPGTTTPKFVEAQPLIKMVSSLGGGSSFSSLMGIEDGMKAHTSISFYSSIHDDTLPNTIISSNRETAQSAYIIFKKFSHNKTGKIISNVGVSSSSLSHVGAFIKDKLAEKNRFAGFKEKVLTIMYKALDHLWKRDMCLRYPRKCTRTSPRNLKLRLKAVTNRC

SEQ ID NO: 183261 - protein, 239 aa, Glycine max
  Coding DNA Sequence Number=SeqID_91576
  Gene Ontology: Mol. function=structural constituent of ribosome; Cellular component=ribonucleoprotein complex; Biological process =translation
  Homolog annotation: Hit_ID=O81363; Match level="QueryCoverage=74%, HitCoverage=68%, E-value=2e-50, Identity=58%"; Hit description=40S ribosomal protein S4
  Pfam annotation: Domain name=KOW; Domain location=115-146; Score =32.8; E_value=1.2e-06; Accession=PF00467.20; Description=KOW motif
  Pfam annotation: Domain name=Melittin; Domain location=82-107; Score =15.1; E_value=0.07; Accession=PF01372.8; Description=Melittin
  Pfam annotation: Domain name=Ribosomal_S4e; Domain location=32-119; Score=84.3; E_value=3.8e-22; Accession=PF00900.11; Description =Ribosomal family S4e
  Pfam module annotation: Pfam domain module=KOW::Melittin::Ribosomal _S4e; Domain location=115-146::82-107::32-119
MRMREAQTIIQGKCPIRVKITAIIKNAVSIPKTNENFRLLYDTKGRFRLHSIRDDEAKFKLCKVRSVQFGPKGIPYLNTYDGRTSITRTLSSGLMTLLSWIWRKTRLSIFIKFDVGNVVMVTGGRNRGRVGVIKNREKHKGSFHVQDATGHEFATCMGNVFTIGKGTKPWISLPKGKGIKLGSNSVNIHVPIDCSPKGMLVEMNTQCAHADNGCGSCSCEDNAMNEPILNSKLEAVTYV

SEQ ID NO: 183262 - protein, 89 aa, Glycine max
  Coding DNA Sequence Number=SeqID_91577
MIPSVRGLGVATYPSAGGRRETRGMRIPRKEYARSRHQRLFEENVGKTGKDAIYELLSERFGSCIYARGRVFPFAPTYSSIWDEKIRPT

SEQ ID NO: 183263 - protein, 58 aa, Glycine max
  Coding DNA Sequence Number=SeqID_91578
MTKSKGKDPLEGLGGPMTRARARKAKEALQQVLSILFEYKPKFQGEKSKVLHSAIKFF

SEQ ID NO: 183264 - protein, 130 aa, Glycine max
  Coding DNA Sequence Number=SeqID_91579
MGQPKFEQKLSQASPNFHAFLILKPNFGFLAMSMFSCIKAEKFVFLSLKLHSHHPNFAKPYSYIVGAFHRALGGCTFGHKLQENGGNVACPIASEHNIGLRPSHSNPQLKKSSIKNNPKLPHKYKHVLTI

SEQ ID NO: 183265 - protein, 155 aa, Glycine max
  Coding DNA Sequence Number=SeqID_91580
  Gene Ontology: Mol. function=protein kinase activity; Cellular component=cytoplasm; Biological process=protein amino acid phosphorylation
  Homolog annotation: Hit_ID=A7Q345; Match level="QueryCoverage=43%, HitCoverage=29%, E-value=2e-23, Identity=75%"; Hit description =Chromosome chr12 scaffold_47, whole genome shotgun sequence
MVRYWCLEMVSTATQELQHLRSERDRIENEMHHLNKFLRPIWGSISSNFSKLGFGSNCGQEPLCTHDSWHTKIYGSKMVTVEIPYSEYDNVAKIYKKVSSGVRPAALNKVKDPEVKAFIEKCLAQPRARPSATKLVRDPFFDEIVDDDDCSCSYQ

SEQ ID NO: 183266 - protein, 281 aa, Glycine max
  Coding DNA Sequence Number=SeqID_91581
EKDSFGLEEHSGIDLSGNTDPEHDISNNTQGSSEGVEHQTSSVGDIHRTHVNESIGDIQKNASKKQVESPNKNIEAEDVKEISHVVFKETGKASEVEVKDVKLNHPEEGSNAAKTKNKSMLPTSKASPISTPKSSKPASKTPNKTVTPASSTRKGSSPSLTMRQITSVEDKSMIKKQGLSVSFCNQTMTMAVRSKTMAVRSKTMARRLEAFLVPRSETKKKKKKKKKKKKTTKTKVLVVTKKKKKKKTTKTKVLAVTKKKNKKKLYLGNVATCHGRKEAVQ

SEQ ID NO: 183267 - protein, 181 aa, Glycine max
  Coding DNA Sequence Number=SeqID_91582
  Gene Ontology: Mol. function=DNA binding; Cellular component=nucleus; Biological process=regulation of transcription
  Homolog annotation: Hit_ID=A7PI75; Match level="QueryCoverage=97%, HitCoverage=9%, E-value=1e-40, Identity=52%"; Hit description =Chromosome chr13 scaffold_17, whole genome shotgun sequence
  Pfam annotation: Domain name=Myb_DNA-binding; Domain location=91-136; Score=32.2; E_value=1.9e-06; Accession=PF00249.22; Description=Myb -like DNA-binding domain
MWFAGYAQALSHLSGQYNVSKAGDQLSLVPTSEMINYTSQLLSKPQDEVNRKILKMPALILDQKDKMFSMFNSSNELVEDPLAVERERAMINCWTSEERKIFSEKFSAFGKDFRRIASFIDHKTTADCVEFYYKDHKPNCLEKDKKKKNKKKGCNSQKSKTLKTIVKGLGKKGNRKANVDS

SEQ ID NO: 183268 - protein, 160 aa, Glycine max
  Coding DNA Sequence Number=SeqID_91583
MWAFLTGRQIDWAHLVRYRMHKALRANAHLPYPRLVTLFLRHFQIPLDDEPFVQVKRSFAIGAGAVTSFSYRKDRNGQWLKKDALPPQDEHTPSLPPQRDDSALMTEVLLELWGLRTYVGEHFDSLDNRFAGMDICLTQLEEDVGYIRQSFDLPPPPPPS

SEQ ID NO: 183269 - protein, 136 aa, Glycine max
  Coding DNA Sequence Number=SeqID_91584
  Homolog annotation: Hit_ID=UPI00006A17C9; Match level="QueryCoverage =66%, HitCoverage=71%, E-value=3e-08, Identity=32%"; Hit description =UPI00006A17C9 related cluster
  Subcellular localization annotation: CTP_CleavageSite=64; ConfidenceScore=5.57e-01
MHSSSVIASLSSCARTVGPPPISGGGPGTVKRKLLVWIWSPLKVRTRSPLKARACSPLKFRTCRLSKARECSPMMARTCNPLKVRACPPFENGGTCSPLMARTCSPLKVRTCSPLKVRACSPTKVKAHDPFDGEDV

SEQ ID NO: 183270 - protein, 163 aa, Glycine max
  Coding DNA Sequence Number=SeqID_91585
MVKEECKEVSVSSKRLAKKERHFEIKTNIKEISLLRQPPHFLLCKKTLVSIATSLRLEFIPQVKELLDEGLVRKRLNPCALLVPKIGIIRHQIPKIGGVMNALGGATLFCKITHAPNIFMICVHRDSLGRVPMNPKRIKVIPEWPAPPSVLREGAQSIKNLRI

SEQ ID NO: 183271 - protein, 165 aa, Glycine max
  Coding DNA Sequence Number=SeqID_91586
MVKEDCQEVSVSSKRLAKKGIHFEIKTNIQETSPLRQPPNLLLCKKTLVSTASPLGLDIIPQVKELLDEGLIRKNLNPFALLVPKIGIIRHQITKIGDMMNVLSYATLFCKITHAPNIFKIHVDRDSLGSNQGIPINTKRIKVILEWPTPPSIRKFWCFHELTNL

SEQ ID NO: 183272 - protein, 124 aa, Glycine max
  Coding DNA Sequence Number=SeqID_91587
  Homolog annotation: Hit_ID=Q5QJQ3; Match level="QueryCoverage=61%, HitCoverage=89%, E-value=5e-28, Identity=59%"; Hit description =Putative uncharacterized protein
MAYERGGDFLEEARKRLNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDLEELVLKSCAG

SEQ ID NO: 183273 - protein, 17 aa, Glycine max
  Coding DNA Sequence Number=SeqID_91588
MADQQATKSKAKGREIP

SEQ ID NO: 183274 - protein, 82 aa, Glycine max
  Coding DNA Sequence Number=SeqID_91589
  Gene Ontology: Mol. function=structural constituent of ribosome; Cellular component=ribonucleoprotein complex; Biological process =translation
  Homolog annotation: Hit_ID=Q06FM3; Match level="QueryCoverage=67%, HitCoverage=20%, E-value=1e-23, Identity=94%"; Hit description =Chloroplast 50S ribosomal protein L2
MAIHLYKTSTPSTRNGAVDSQVKSNPRNHLIYGQHRCGKGRNARGIITAGHRGGGFTAKPRNRSLIQLEYLYRDRPQQKTEE

SEQ ID NO: 183275 - protein, 115 aa, Glycine max
  Coding DNA Sequence Number=SeqID_91590
MGEYAKDEELLIHSFQESLTGYQYNFDMVPDRMQLQNICKKGDGSFKEHAQKVEGSGGPGGTPNDGKGDDDRDGKFDHPTRTTEKTGANEEGEKEGETHAVTAIPIRPSFPPNPT

SEQ ID NO: 183276 - protein, 112 aa, Glycine max
  Coding DNA Sequence Number=SeqID_91591
  Subcellular localization annotation: CTP_CleavageSite=54; ConfidenceScore=5.15e-01
MALSLSLSLSLSLSLSLSLSLSLSLSLMHSCKIWFVLIDRTSPTRTYWHNRGTCCTNLTAGNTDEDVDDLGGVELRQHCEVVIIKEEAQCNRKRHSRKRRNTIGREGYTYWD

SEQ ID NO: 183277 - protein, 69 aa, Glycine max
  Coding DNA Sequence Number=SeqID_91592
  Subcellular localization annotation: CTP_CleavageSite=42; ConfidenceScore=5.34e-01
MNPSFPNKGSPPIEGIPLKAKGSQWNFSLFANMMVSYPNFVRQPSVVGMRPSFDHFEKIPPEGGCFWRK

SEQ ID NO: 183278 - protein, 83 aa, Glycine max
  Coding DNA Sequence Number=SeqID_91593
MTSKIILMMPKNQELSKFQRIRLQESKNKRGYISCGSVQVEGTSTWFFKENKGGYIPCGSLACKGFYKVERNLKNRWLLEDWM

SEQ ID NO: 183279 - protein, 255 aa, Glycine max
  Coding DNA Sequence Number=SeqID_91594
MDRSMIDAASGGALGDMTPAEARNLIEKMASNSQQFSARNDAIVIRGVHEVATNSSSAVETKKLEGKLDALVNLVTQLALNQKSISVTRVCGLCSSVDHHTDLCPSVQQSEAIKQPEAYAANIYNRPPPPQPQQQNQPQQNNYDLSSNRWSNPSQEQPQQQPYFQNVAGPSKPYVPPPIQQQQPQKQPTIETPPQPSLEELVRQMTMQNMQFQQETRVSIQSMTNQMRQLATQLNQQQSQNSGRLPSQSVQNPKN

SEQ ID NO: 183280 - protein, 79 aa, Glycine max
  Coding DNA Sequence Number=SeqID_91595
LEDYFPKLFDEIEIQTIQARTFISLASPNCRLDFQLSESINKAFLLPLIKGRELDPFQGYHRLLLIDIVVEGRSGYSNS

SEQ ID NO: 183281 - protein, 90 aa, Glycine max
  Coding DNA Sequence Number=SeqID_91596
  Subcellular localization annotation: CTP_CleavageSite=58; ConfidenceScore=5.10e-01
MKSLTETSRKRYGSASAWIFFTKTIFLTNFKRILNTRRAERNYSALFPLFIGKKREVVAAQLAQASAAHPGELGCFHQKAPPSVGTACKA

SEQ ID NO: 183282 - protein, 215 aa, Glycine max
  Coding DNA Sequence Number=SeqID_91597
  Homolog annotation: Hit_ID=Q2HW90; Match level="QueryCoverage=39%, HitCoverage=16%, E-value=1e-09, Identity=43%"; Hit description =Putative uncharacterized protein
ELDHRKQVENGVVGVPRKCLEAKARVLAGKGEWAPFMDILALLIFGGVLFPNVDGLVDEAAIDAFLAFHDRKESLVVTILADLYDTFDRRCEKNSTRIVCCTSALYVWLVLHLLCQEQANKEHLTTGSLDGKKEESGFLFRAEDFQISTNAEALQKVRKAWEMVQNKDQELRGSSNGPIGGCHRWLKAYTQGLDWLPNLRTTKGVEVEVTKEDEE

SEQ ID NO: 183283 - protein, 256 aa, Glycine max
  Coding DNA Sequence Number=SeqID_91598
  Homolog annotation: Hit_ID=Q6WAY6; Match level="QueryCoverage=46%, HitCoverage=20%, E-value=1e-12, Identity=32%"; Hit description =Putative uncharacterized protein
MDWDQLLVGIGGRTISWFPRWKEGKEGVLFSCGRYPNIPLVGTRGCINYNPTLAIRQLGYPMRGAPTEESMSPFLVRDLGAQNSKTIQRIHKAWETPLRKDQELRGVRNGIIGGYHEWAEIVSEENFEAPEEDEGSPSSQKRVRKGKTRQGEVQVGCYTRSEGVCRVTGRECNYRKRPLNERPRGLARKSMAGTNFAELYGVAIVNSSCEGKKGTETNMLAIIAKYEEELGLATAHEHRIADEYAQVYAEKEARGR

SEQ ID NO: 183284 - protein, 141 aa, Glycine max
  Coding DNA Sequence Number=SeqID_91599
  Homolog annotation: Hit_ID=A5AZG1; Match level="QueryCoverage=34%, HitCoverage=14%, E-value=8e-10, Identity=56%"; Hit description =Putative uncharacterized protein
MSLHFSSSVNGEGSTPKNPLYKILDELRSLKLWKEKQERKEKDNVEAYLDWEMKVEQLFACHHISEERKVPLATLSFQGYALYWWTSLVRCHTLISSGDLCLMTCDLSLVLVRCEILIPIPDVVQDVTTSCFRTCRLYLSV

SEQ ID NO: 183285 - protein, 76 aa, Glycine max
  Coding DNA Sequence Number=SeqID_91600
MLAAQLAQASRVASSRSNSLLEEYSGGPKWAWVLFAPPFLLSVEERIPEFQEPMDLRSNPFQGGGNDAILPPKGIG

SEQ ID NO: 183286 - protein, 282 aa, Glycine max
  Coding DNA Sequence Number=SeqID_91601
  Subcellular localization annotation: CTP_CleavageSite=48; ConfidenceScore=5.05e-01
MDRARLIFGLVSHMDMNIGALISGQMTSIAQSNSCRLAFPTLITVLCRARRVVSDSLTFECLSPAINLAYIRKNCCNIDDLIVAFRGARRARARPTDIPSTFAASAPTLASTSVAPSVPAHVDTQRFEAMLQTIHQGRILLLHSLQVVAPPRSILSMAQFLEREGEGSTAQVPQQVQDASSETTIPEPFTLHHEAGEEQVRLETAATPERSLEGTSQPPTLVADLSSPQPTADPSTHLLDIPEDPTTPVLALNTSPPATPVLHLTDEEDAQTQDTQDRSQEF

SEQ ID NO: 183287 - protein, 34 aa, Glycine max
  Coding DNA Sequence Number=SeqID_91602
MNVENEEDAGVKVEHIDCSYAFNTSQLFASRDEV

SEQ ID NO: 183288 - protein, 157 aa, Glycine max
  Coding DNA Sequence Number=SeqID_91603
DPTQLVYAILTRMSIHVAQLIADAIYLFAVPVAPSKAQGDAPQAADAPPPHQADPAGSFDTEQYLWHLVRQQAANHRAHVQTHDCLYQLSLSLQSQGFTSFPCPTLDQFRAEVAWPGDWPEARAGEAPAEAPDEANEAREDEEMTDLLDFLGGSEAT

SEQ ID NO: 183289 - protein, 15 aa, Glycine max
  Coding DNA Sequence Number=SeqID_91604
MTCRKRDLKPETGPG

SEQ ID NO: 183290 - protein, 188 aa, Glycine max
  Coding DNA Sequence Number=SeqID_91605
MSRGQCGHLRLFRRCQHFPMETFKVSQVIQNYVEAAGPMIRGDTLRLSAPFCHPEAAGPMTSRDQVWSFCTLVSSRGGGPDDTRRYLTVIRTLLSSRGGGPDDKQRPKFGHSAPLYHPEAAGPMIRGDTLRLSAPFCHPEAAGPMTSRDQVWSFCTLVSSRGGGPDDTRKYLTGYPHTSFAISRGGGR

SEQ ID NO: 183291 - protein, 61 aa, Glycine max
  Coding DNA Sequence Number=SeqID_91606
MGHLSDQGVSTNPKRIKVIPEWPTPPSVEGRSPKFQEPLDLRSNPFQGGATDAILPPKGIG

SEQ ID NO: 183292 - protein, 87 aa, Glycine max
  Coding DNA Sequence Number=SeqID_91607
MESQFESKDYIKKWMHNSQRDVYLGAYLNGALKRFNDSQASISKAAARWIVVKYSTSQRPLEPKRMKDICIQWAKYYLKVKNQTLGV

SEQ ID NO: 183293 - protein, 224 aa, Glycine max
  Coding DNA Sequence Number=SeqID_91608
  Homolog annotation: Hit_ID=Q6UUU1; Match level="QueryCoverage=38%, HitCoverage=55%, E-value=2e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMGRVCLISTPDTQFRGGQFAPSWTVCTNPPFSPTAAPLSGVSLEVMPPVKAKLKGQVLVTALLQAIEFLQPGGSTSSRAAATAVELQFAL

SEQ ID NO: 183294 - protein, 254 aa, Glycine max
  Coding DNA Sequence Number=SeqID_91609
  Gene Ontology: Cellular component=mitochondrion
  Homolog annotation: Hit_ID=Q6R9L5; Match level="QueryCoverage=33%, HitCoverage=71%, E-value=2e-31, Identity=76%"; Hit description =Putative uncharacterized protein orf121-a-ct
MLHSARGDIAQLVELRSCNWVVAITGWMSNCPGGNDRILYLNRWLTFSKNGKEDRNMPLKDSTETKTGCQERRGGRMGSWADLELRDHPKDAFGIQGSRTDHRTLFKKRNALAIRSQVGQISRGLRGGGLPCGGCQRFESAYLQLVNLVDTKLYDSTSIFPIRQFDLCYDLSFMDVDKILPSSSTLGWHSLKVKGEVQTKKGLWWIPRHPETRKGVVSDEMLRGVENKRRSGDSRYRSTFRTAAESTGRQETTW

SEQ ID NO: 183295 - protein, 85 aa, Glycine max
  Coding DNA Sequence Number=SeqID_91610
  Homolog annotation: Hit_ID=Q2AA51; Match level="QueryCoverage=69%, HitCoverage=18%, E-value=1e-07, Identity=47%"; Hit description =Retrotransposon gag protein
  Pfam annotation: Domain name=Retrotrans_gag; Domain location=17-83; Score=-0.6; E_value=0.061; Accession=PF03732.8; Description =Retrotransposon gag protein
MAEEHQHRVTLEDYSSSFVLQFFTRKAKKWLHLFKGNSLKTWEEVVEKFLKKYFPESKTAKGKAAISSFHQFPDESLSEALERFH

SEQ ID NO: 183296 - protein, 309 aa, Glycine max
  Coding DNA Sequence Number=SeqID_91611
  Gene Ontology: Mol. function=signal transducer activity; Cellular component=membrane; Biological process=signal transduction
  Homolog annotation: Hit_ID=A7MRM1; Match level="QueryCoverage=97%, HitCoverage=55%, E-value=8e-62, Identity=44%"; Hit description =Putative uncharacterized protein
  Pfam annotation: Domain name=DUF948; Domain location=103-183; Score= -24.5; E_value=0.049; Accession=PF06103.2; Description=Bacterial protein of unknown function (DUF948)
  Pfam annotation: Domain name=HAMP; Domain location=102-172; Score =36.2; E_value=1.2e-07; Accession=PF00672.16; Description=HAMP domain
  Pfam annotation: Domain name=MCPsignal; Domain location=203-309; Score=-8.0; E_value=1.8e-06; Accession=PF00015.12; Description =Methyl-accepting chemotaxis protein (MCP) signaling domain
  Pfam module annotation: Pfam domain module=DUF948::HAMP::MCPsignal; Domain location=103-183::102-172::203-309
GLKSLTDYYLTHNLSSDEDKRLTELAFANIQRVRERLPAFLTASRAHQNAISLDLIEGQNGIGAAIRQLVTNYQQQLMLNISIGDELRATNLSTFHEVLWTTITGVIATVIIFGLFALFTVLRIRRSLSDVGKVMMHASENLDLTLSADESLRDEVGNMARSFNQLMRSVAGSLSAVRSASHSVSSASVQIAAGNEDLSARTEQQAASLEQTAASMTELSETVRQTADNTRQASQLAANASSLSEKSGTSLSTMLSTMDDIRGSSRKVTDIVSMIEGIAFQTNILALNAAVEAARAGEHGKGFAVVAGE

SEQ ID NO: 183297 - protein, 75 aa, Glycine max
  Coding DNA Sequence Number=SeqID_91612
  Homolog annotation: Hit_ID=A5AEE4; Match level="QueryCoverage=89%, HitCoverage=6%, E-value=1e-07, Identity=41%"; Hit description =Putative uncharacterized protein
MSPLERDMISTTIHSTQSHRMIEVACRTVSASDNNPIRESMPYFGVIKEIWELDYSEYRVFVFKCQWANRNIDVR

SEQ ID NO: 183298 - protein, 57 aa, Glycine max
  Coding DNA Sequence Number=SeqID_91613
MGPKSTLRLMRTLGIASVAWHGDRPSFQAGAGPAEAPGDEDGAQEDDDMADVMNFFL

SEQ ID NO: 183299 - protein, 136 aa, Glycine max
  Coding DNA Sequence Number=SeqID_91614
MVKEECKEVSVSSKRLAKKERHFEIKTNIKEISLLRQPPHFLHCKKTLVSIATSLRLEFIPQVKELLDEGLLRKRLNPCALLVPKIGVPMNPKRIKVIPEWPASTKCKKNLGLPRLNKLLQKVLRKKAQSFKNLGI

SEQ ID NO: 183300 - protein, 356 aa, Glycine max
  Coding DNA Sequence Number=SeqID_91615
  Homolog annotation: Hit_ID=UPI00016621D1; Match level="QueryCoverage =98%, HitCoverage=42%, E-value=3e-13, Identity=28%"; Hit description =UPI00016621D1 related cluster
VLTFIGLHALAISGAHVLAFTGLHILAFRELHVLTLRGLHTLALIGLHTHAIRRAHVLAFRGLHALAFRRLHVLSFRKLHVLAIRGIHILTFRGLHVLAIRGLHVLAFRGLHALAIKRLHILAFRGLHALAFRGLRVLTIRGLHTLAFIGLDSLAFIGLDMLAFCRQYASPLEEYTTSTSEGYTPSPLEDYTATRPNLSLRGQHALAFIGLHVLTLSGLDVLTFRAQHVLNFRGLHVLTLRGLHALSFRGLHEILHLLAISGLDVLSFRGLNALAFRGLDVLTFRGLHVLAFRVLHVVAFRGLHVLLHVLAFRGLHALAFRGVHALTFIGLHTLVIRGVHVLAFRGLHALAFRGLH

SEQ ID NO: 183301 - protein, 45 aa, Glycine max
  Coding DNA Sequence Number=SeqID_91616
MVIFIHGVAAQDKGEKPNIWEASLRSKEESFLEKLERGCLYPSNS

SEQ ID NO: 183302 - protein, 356 aa, Glycine max
  Coding DNA Sequence Number=SeqID_91617
  Homolog annotation: Hit_ID=A1FSJ1; Match level="QueryCoverage=41%, HitCoverage=46%, E-value=7e-48, Identity=72%"; Hit description =Putative uncharacterized protein
MRLVEIGSSAEVGSSSSSTDGRRATARAMHRRCCWPTGQAQCALPQLVLHFVPQRALAQRLLDAVGHVGLAQFLVVADAVGDILEDGHRERHRLLEHHADLAAQAVHRVLRRQDVLAVQQHFTARFQLRVQRVDAVEDAQQRGLAATGGTDQRGHALFRNLQVDALQGVELVVVEVQSTRSQLPDGVCRLSCEDGTAMRCIGTALERSFMALSTERSVMGDTVAQQDAAGGKADQQHEDSQHQGTGPGQHLPGFIRAAGELVHHHRHRGHRLEDVVVPVLVAEGSEQQRRGLAGNAGQRQQDAGDDAGRCTAVQHLHDHLPLRDTQRQGRLTHLRGHQAQHLVGGTHHHRQHDEGQ

SEQ ID NO: 183303 - protein, 98 aa, Glycine max
  Coding DNA Sequence Number=SeqID_91618
  Subcellular localization annotation: CTP_CleavageSite=75; ConfidenceScore=5.54e-01
MSPPPLEPHNHSQTQLKLLGRLPLQAPFSASGLVGACTLSATLARLACISEFRLSARLFAQRMDSSGALSGISPRSTNMQNSFFFQVLPRAQPKECCA

SEQ ID NO: 183304 - protein, 270 aa, Glycine max
  Coding DNA Sequence Number=SeqID_91619
SAPSYERKTRPLQEPLNKKPKGPARRNMAERNSEEHCGVATMSSSSEERKETGHGSKRSLAQHLEDTEQSMLAIIGQYKEELNQSVTHEQKLVEDFAQVYAEKEARGREQMKADLSALKDQMASISEVMLKLQKTIKDKAITTASSIVREAEPVLQPALNLGRDRNMTVFGQRYSPQAYPYGLPLDFTPRVALEDLSQAHTFEGQLPPYDDYPGQDDEEGDTYLDKGKIEALEERLRAVEGLGNYPFSDLADLCLVLNIVIPPQVQSTGL

SEQ ID NO: 183305 - protein, 336 aa, Glycine max
  Coding DNA Sequence Number=SeqID_91620
  Gene Ontology: Mol. function=unfolded protein binding; Cellular component=endoplasmic reticulum lumen; Biological process=iron -sulfur cluster assembly
  Homolog annotation: Hit_ID=Q1H365; Match level="QueryCoverage=99%, HitCoverage=52%, E-value=1e-124, Identity=68%"; Hit description =Chaperone protein hscA homolog
  Pfam annotation: Domain name=HSP70; Domain location=16-336; Score= -16.7; E_value=2.7e-13; Accession=PF00012.11; Description=Hsp70 protein
  Pfam annotation: Domain name=MreB_Mbl; Domain location=14-332; Score=- 266.1; E_value=0.0092; Accession=PF06723.4; Description=MreBMbl protein
  Pfam module annotation: Pfam domain module=HSP70::MreB_Mbl; Domain location=16-336::14-332
FPNPGHSPAPHQHKLAVGIDLGTTNSLVATVRSGMSTVLHDEHGHALLPSVVRYLDGAIVVGHEAQAAQSQDPVNTIVSVKRFMGRALHDITDRAHIPYHFVENDSSQGMLELKTRAGLKSPVEISAEILKTLKIRAEKALGGELTGAVITVPAYFDDAQRQATKDAARLAGLHVLRLLNEPTAAAVAYGLDNAAEGVYVIYDLGGGTFDISILRLSKGVFEVLATNGDSALGGDDFDHRIYCWVLDQVRGKTKHFKPLTEEDTRLLLTKSRQAKEWLTDNHEANIVCKLSNGALVDETLTVNQFVSLTEHLVIKTLSPTRKAMRDAGLTVADIKG

SEQ ID NO: 183306 - protein, 106 aa, Glycine max
  Coding DNA Sequence Number=SeqID_91621
MKAQVEKDEGLEAETLSRLLIVAEGPSNPCGVYPDLSSFTGSGVYPDLSSSTGSGVYPDLSSFTGSGVYPDLSSFIGSGVYPDLSSFTGSGVNQKLYSLYQAIRAP

SEQ ID NO: 183307 - protein, 72 aa, Glycine max
  Coding DNA Sequence Number=SeqID_91622
MHQHSPELSGSPCCSIVYKRTHSQAKLMDKFEERNEKLRSDVDQLKQQMTQIQEILQALLKKMMELNKPRGG

SEQ ID NO: 183308 - protein, 253 aa, Glycine max
  Coding DNA Sequence Number=SeqID_91623
MAENKNKNKRMKSIWHKPIAPRMKKEKEPTKNVKASEVWITELSFQRLMVYQLGLKEVGITFNKVDMYKSLMKNSSTYIVVVTKAKGSECFGIGHLMLEHKLLGYVVAWIITLKGSNHAQLIEEDLLLSCLMHGKLKINWVNIIIDNMMKTKMIRSFMCPYAMLISRILDYFGVDTQEEVFAFVEVEFKKNKEDQTTQQDLEEKPMSPLEQMMLAKRDKLLRMHKEDYIELKECFETIYGRLDVIGAPYVDDI

SEQ ID NO: 183309 - protein, 251 aa, Glycine max
  Coding DNA Sequence Number=SeqID_91624
  Homolog annotation: Hit_ID=A5BTG4; Match level="QueryCoverage=70%, HitCoverage=75%, E-value=4e-10, Identity=26%"; Hit description =Putative uncharacterized protein
  Pfam annotation: Domain name=zf-CCHC; Domain location=76-93; Score =26.7; E_value=8.4e-05; Accession=PF00098.14; Description=Zinc knuckle
MFEDEELDIKILNCLTRTWEPKITTIKESKNLATMTMEALFCKLLAYEHELTQQKTKDIKFSKSSKTENNNNNNSYTCFKCGKQGHIKSECPIYLRKHGEKKGKKDIKQKKAYIAWEDSASTTSDSSSDEEIANVCLMAMSMNDPSTNEEIEVNHDFEEIQEAFNEMHEEAQRLVVLNKKPKSKLKVHITKLASTQGKLNELKKENEKLVSRCKATACDDISTSFNMDDYNFLHKGLGGSIMWKQCFPRLF

SEQ ID NO: 183310 - protein, 252 aa, Glycine max
  Coding DNA Sequence Number=SeqID_91625
MAANDHAILHDRTHISTKRSLLELTSQDALLAHARDTKKEGQKGLFHGFLDPSSPGLAFGSPRPLKDFNVNKPARLATIAPSAYFPINRHAREAEEGFHGSKVERIERIKKEEEERSGNEAEALPNRDRDHSLHRVEAKLHGESKNQEEFKTQEESLESRIKIQGSRSQESRSRFKTQDSRIKRRLNQEKGYILCGTSRGYIYLGLTENKRGYISCGSVLVEGTSTRFKENKGGPLDPTHRSLFGVLRATVG

SEQ ID NO: 183311 - protein, 127 aa, Glycine max
  Coding DNA Sequence Number=SeqID_91626
MTRGNPSDLQPFDPEIDRTFHRLVRHHFTPFDHSEHSITGESVHSVIGDFEHPDLEHYNFEHSDFEHSVFAHSENMAQPPPRERTLREMAAPDITYESLCIQYPDEDVPYVLKTGLIHLLPKFHGHA

SEQ ID NO: 183312 - protein, 177 aa, Glycine max
  Coding DNA Sequence Number=SeqID_91627
MEAIKEQMATMMKAMMSMKKIMEANAVIVAAISAVAKVNPMLPSGLKQMNHPTSNMVGKDLGSTDDPMMCKFKTSTPSPHMACLPTYTPPNTHEIPHHHLADFEPWLGYATEGQAVGGIPFENALESPQFRPQPQPLHFAVGRSPPAMAEKRKANHLKERLRAIEGGEDYAFAKSCS

SEQ ID NO: 183313 - protein, 80 aa, Glycine max
  Coding DNA Sequence Number=SeqID_91628
  Subcellular localization annotation: CTP_CleavageSite=45; ConfidenceScore=5.29e-01
MSPVESPTVATCPSRASGGGGHGCAFQRRKDARSRHQRLFVENVRKTEGNRSTKAGLLLLRTLLWRGNQTYVVLPYAWIK

SEQ ID NO: 183314 - protein, 59 aa, Glycine max
  Coding DNA Sequence Number=SeqID_91629
MKNVPDSGVIFTFEEGSTKAGLLLLRTLQRRGNQTYVVLFKGESSDSFYLEGDHLRRGP

SEQ ID NO: 183315 - protein, 145 aa, Glycine max
  Coding DNA Sequence Number=SeqID_91630
MPISPCRCIGWDRAHKSPSGPEEVQQGPGVSSSGYGPLSVLQGARSPSEESHPQRHPMDPEKSNMALGFPALVTGLCSPTGCPFPPARSHHHSSTKYLLPPARASGPLLIKLSSRSTASPGRRRAKHHSSLGMASSGQQTHRHHL

SEQ ID NO: 183316 - protein, 88 aa, Glycine max
  Coding DNA Sequence Number=SeqID_91631
MLLSSNVIYICVRVVMLVCMIHTHLFAVARVKSCPGMHSSYAIASSSGCAHIVGRPSISGGGPGTDKRKLWPLNRECKSWLSIKGRGP

SEQ ID NO: 183317 - protein, 104 aa, Glycine max
  Coding DNA Sequence Number=SeqID_91632
  Subcellular localization annotation: CTP_CleavageSite=73; ConfidenceScore=5.29e-01
MKNGGKPSRNRPQKCLGSVTKALQLGFSSRKQFFSLIISDSQIAGGFNIFVLPSFPYLYGTRGRWLPPSSPRRAGMLPPEGTAFCWKILEGPSGPNCYLYPPVY

SEQ ID NO: 183318 - protein, 65 aa, Glycine max
  Coding DNA Sequence Number=SeqID_91633
  Subcellular localization annotation: CTP_CleavageSite=52; ConfidenceScore=5.30e-01
MGVQIATRPTWAFQILPPEGGCFWRKQPGLPGRARKSMSRRFRNVSVGDFVKIFYRSSTFFGLQP

SEQ ID NO: 183319 - protein, 53 aa, Glycine max
  Coding DNA Sequence Number=SeqID_91634
MVKGFGYFGQKTCFREEKSSRSASVTLSQAIMWKFFIVLRRSSPFFVRSSFFN

SEQ ID NO: 183320 - protein, 136 aa, Glycine max
  Coding DNA Sequence Number=SeqID_91635
  Homolog annotation: Hit_ID=A5BKA4; Match level="QueryCoverage=92%, HitCoverage=23%, E-value=2e-13, Identity=38%"; Hit description =Putative uncharacterized protein
MAQPLPRERTLREMAAPDFTYESLCIQYPDEGVPYVLKTGLIHLLPKFHGLAGEDPLKHLKEFHIVCSTMKPPDVQEDHIFLKAFPHSLEGVAKDWLYYLAPRSIFICMSTGKDSRNCVQAVLTTRFLRTPSAGML

SEQ ID NO: 183321 - protein, 74 aa, Glycine max
  Coding DNA Sequence Number=SeqID_91636
MTAWVPFEQQRNELETRIEEQEARFSHEKALAQQLMTRRKDISQQADVADLQQQLEQAQQGDVLVQVDVTPGIL

SEQ ID NO: 183322 - protein, 106 aa, Glycine max
  Coding DNA Sequence Number=SeqID_91637
HAGNKFRGALWASNSELKLQREERDQSRVDGLILKDDLKTNMLAIVSKYQEELNLAMAHEHKVADEYARVYVEKEARGKVIDSLHQEATMWMDQFALTLNGSQELP

SEQ ID NO: 183323 - protein, 115 aa, Glycine max
  Coding DNA Sequence Number=SeqID_91638
  Homolog annotation: Hit_ID=A5AZ88; Match level="QueryCoverage=56%, HitCoverage=6%, E-value=8e-08, Identity=35%"; Hit description =Putative uncharacterized protein
MAIQDDESRADEKEVVEDEDDQQERETPIKEMIDIEEDADIPLILGRTFMSTASCVVEMGKKKLQMAIEDQQISFDMFHEEKALLDQNVCLKVNVIEEKRLEKKVLEVGTLLDPG

SEQ ID NO: 183324 - protein, 164 aa, Glycine max
  Coding DNA Sequence Number=SeqID_91639
MTQELVARGDTLRLSAPRHSVTPSVIDEQRPIWSSAPFPEMSAFSDGDFPSLTSYPELRRSEFLIGGYVGARASLLSTTPPFVAMTQELVARGDTLRLSAPRHSVTPSVIHEQRPIWSSAPFPEMSAFSDGDFSSLTSYQELRRSEFLIGGYVGARALLLSAAP

SEQ ID NO: 183325 - protein, 44 aa, Glycine max
  Coding DNA Sequence Number=SeqID_91640
MVHPFWIFSGKGFYKVERNLKNRCLLGDWMLIVKECISRTPVRV

SEQ ID NO: 183326 - protein, 310 aa, Glycine max
  Coding DNA Sequence Number=SeqID_91641
  Subcellular localization annotation: CTP_CleavageSite=88; ConfidenceScore=5.76e-01
MRRNSPASSSNTSFLPHPSFFSERPFTGIFSFGVGIILSFCSSAIFAFPLTFAGCVGRSGGANTRPLRVTPLSPVILVTLADNELMSVASSFLSLGGTYLHGTAWLFWYENEIGLTTEGYRGVWGAASLINLLGVVTSFKGLNNAWPTRLDDINYSPSMISERVRFHVGLVLLKRQPSDVYQMLDLVFKGQTTFGGVARGFPMVCAGCVRVIPLWERRLVDLPGRYHNHLVGDEGRQEVFVRHWDWGEFWSWPRGKVPYRLEPAPKWALPAGRVGVGAGTWGASLWMGVGALACMGAELGESPARAEKLG

SEQ ID NO: 183327 - protein, 143 aa, Glycine max
  Coding DNA Sequence Number=SeqID_91642
  Subcellular localization annotation: CTP_CleavageSite=75; ConfidenceScore=5.16e-01
MNCVFVHVSSTFEFGAMRSDCLVQFSILTIFRSPMNCVFVHVFSTFEFGAMRSDCLVQFSILTIFRSPMNCIFVHVSSTFEFGAMRSDCLVQFSILTLLRSPMNCVFVHVSSTFEFGAMRSDCLVQFSILTIFQSPMKCVFVH

SEQ ID NO: 183328 - protein, 88 aa, Glycine max
  Coding DNA Sequence Number=SeqID_91643
  Homolog annotation: Hit_ID=UPI0000ECBAF8; Match level="QueryCoverage =40%, HitCoverage=42%, E-value=2e-12, Identity=100%"; Hit description= UPI0000ECBAF8 related cluster
  Subcellular localization annotation: CTP_CleavageSite=45; ConfidenceScore=5.01e-01
MSTVSISLISNSCSPGDPLVLERPPPRWSSNSPYSESYYNSLAVVYNVVTGKTLALPNLIALQHIPLSPAGVIAKRPAPIALPNSCAA

SEQ ID NO: 183329 - protein, 159 aa, Glycine max
  Coding DNA Sequence Number=SeqID_91644
MDNLSMQYKEVTESTQRAFKSLEIQVGKLAEKVTKFVARKEENFVEVEAHKESLIEEDDSKEKDEEKSEEKAQQWEKYPQVKIQQESILQVNTPPHQLIVKEERHREHEKALSVILSLIATTSLAIMWKLLPQYMSFVVSLAKRQKYKEDVFYVTFMPP

SEQ ID NO: 183330 - protein, 67 aa, Glycine max
  Coding DNA Sequence Number=SeqID_91645
MHGVATNVYLRKTLEKPERCGLRTLSVKGSGVVFTHGEGSMFIDKSKEDRLKRWTLKRFLVIFADKA

SEQ ID NO: 183331 - protein, 32 aa, Glycine max
  Coding DNA Sequence Number=SeqID_91646
MGKNNDNIYFDEDESAIDKWNEPEDGVLEKDV

SEQ ID NO: 183332 - protein, 93 aa, Glycine max
  Coding DNA Sequence Number=SeqID_91647
MEKYDKRNFKEKKAYITWEDNDINSSSDSENKIINLGLMAKDYESGEELEVGSGSWKLEVKIGNWKQKLEVGNGSWKLEVEIGNWKRKLEVGS

SEQ ID NO: 183333 - protein, 74 aa, Glycine max
  Coding DNA Sequence Number=SeqID_91648
MILSQTYLNKTMIPDSLSRIHPDVASCRACRPWISFINGVIFFLQINDSGMEKEERLLEMPLQAEDESRTSSPP

SEQ ID NO: 183334 - protein, 82 aa, Glycine max
  Coding DNA Sequence Number=SeqID_91649
MTDSLDESISCFLIRMDPRRTACPHLQRATRPRHQRTVCPHLQRATRPRHQRTACPHLQRVTRPRHQRTACPHLRRATRPHL

SEQ ID NO: 183335 - protein, 227 aa, Glycine max
  Coding DNA Sequence Number=SeqID_91650
ELAKCAYCAKRVHLLWMNIHLPDEIPVANPRLSGQSLAKPIIGPCLAKPLMASRKHKSIGARPIAQCDTRWFHSLDAWNRYIDNVLGRRILPERKVEIYHAEFDDFKTELERRNLHKRLTNLADGTIDVALVKEFYTNLYSSEDPSPKQAKVRGHVVKIDVDDLNTFLETPVVLEEGETLPTYSRYCRLPSDHREIEAALCIPGRGFILNAKGHPGRILRKDLTTLT

SEQ ID NO: 183336 - protein, 105 aa, Glycine max
  Coding DNA Sequence Number=SeqID_91651
  Subcellular localization annotation: CTP_CleavageSite=30; ConfidenceScore=5.42e-01
IGVAGGKVFSASTGVVWSSGMSSKGVEGLAASYGESGRASASKPRAKREISALSVASVFSQAQRMTDTKPESTYSWHKIPQQPQCPFREKSPGSSKEEQLLQRYL

SEQ ID NO: 183337 - protein, 196 aa, Glycine max
  Coding DNA Sequence Number=SeqID_91652
  Homolog annotation: Hit_ID=UPI00016621D1; Match level="QueryCoverage =69%, HitCoverage=40%, E-value=7e-12, Identity=35%"; Hit description =UPI00016621D1 related cluster
MSKSCEFGMTGPLDESISCFLIRLDPWVLVPITFRGLGIHALTVRGLQVLAFRGLHVLTFRGIHAFAFVGLDVLKFRGLHVLAFKGLYALAFRGQHVLTVRGLYVLTFRGIHALTFRGLHVLHFRGLQVLNFRGLHVLTFRGLDDLKFRGLHVLTIRGLRVLAFKGLYALAFRGLHAFALRGLRALAFRGLYVLTF

SEQ ID NO: 183338 - protein, 98 aa, Glycine max
  Coding DNA Sequence Number=SeqID_91653
  Subcellular localization annotation: CTP_CleavageSite=44; ConfidenceScore=5.45e-01
MATQLNQAQSQNSDKLPSQTMQNPKNMSAITLRSSNQIQVPPPVAAPAPEPVKLYSKPEKEDEIVAQKRKLPDQGANKNFHAGCHTLISSGDHLFGGM

SEQ ID NO: 183339 - protein, 75 aa, Glycine max
  Coding DNA Sequence Number=SeqID_91654
MAMIISMHTIAINLQEIQSKSTKGVEKASHRAKEPSTPPLIHFILATSLDREYVVLQTSWALIRLHKMNKTKNAS

SEQ ID NO: 183340 - protein, 168 aa, Glycine max
  Coding DNA Sequence Number=SeqID_91655
  Homolog annotation: Hit_ID=Q84VH5; Match level="QueryCoverage=100%, HitCoverage=24%, E-value=2e-54, Identity=69%"; Hit description =Envelope-like protein
MDKKIRGIVSSILKDASVPDAEKDVPTSSTPNVFVPDVNKDVPTASGPNAEVLSSPSKERSTEEDDQAAEETPTPRAPEPAPGDLIDLEEVESDEEPIANKLAPGIAERLQSRKGKTPLKRSGRIKTMAQKKSTPITPTTSRRSKVVIPSKKRKEISSSDSDDDVELD

SEQ ID NO: 183341 - protein, 54 aa, Glycine max
  Coding DNA Sequence Number=SeqID_91656
MGAKYLEVVKRGSHPNNGWSPDKIRQMSVCGLPYRASPRADGLTGRDSKRWGGR

SEQ ID NO: 183342 - protein, 91 aa, Glycine max
  Coding DNA Sequence Number=SeqID_91657
MSCKSREIINYDKSITCRNVPFCGRARARLTGALSKGGKMRGVATNVYLGKRRENRRKLVKMKILSSGVVFTLEEGIGTSHVCLQGQQSIF

SEQ ID NO: 183343 - protein, 99 aa, Glycine max
  Coding DNA Sequence Number=SeqID_91658
MTYEHGPKQVPKTLEGQCTSPPTNIHNIQRMNVAQIKCQRPSKGQTIILIARFPDPNYGVKTVNFIINSPHLIVKSYLNVLESMNRLHMACQIDYLQRL

SEQ ID NO: 183344 - protein, 269 aa, Glycine max
  Coding DNA Sequence Number=SeqID_91659
EEEIHSLPTRELYDTTRFGFEVAWECYSQNIHSGNILPERNINLFVTEYDEFRRELIRRNWHKALTQHMDGHIDVALVKEFYLNLYDPEDKSPKQIRVRGKLINFEAALLNAFWETPPVILPGEQYPSYSIFCRAWTHPQELASKLCILGHGFVLNVEGAPWRLLRKDLTTLAKTWSVLSYSNLAPTSHTSDFNMDRARLVYGPVMKMDMDVGFLISHQMSQMAKFNSCRLGFPALISALCIARGVISDSLTFEFLSLAINLAYIKKNC

SEQ ID NO: 183345 - protein, 52 aa, Glycine max
  Coding DNA Sequence Number=SeqID_91660
MASYGVASPIILPLLHSAAIKLYKAKDSIDEEDPRQTSSTGATSCGIKSIFI

SEQ ID NO: 183346 - protein, 78 aa, Glycine max
  Coding DNA Sequence Number=SeqID_91661
  Homolog annotation: Hit_ID=A7Q5G5; Match level="QueryCoverage=70%, HitCoverage=28%, E-value=9e-09, Identity=47%"; Hit description =Chromosome undetermined scaffold_53, whole genome shotgun sequence
MESSSSCPSHIKIKSASIDGIRVDGLPLIGPTNLDWADLCEKLLGVRPQEGEIKGSVVKLSWLAHHFAQINNDDVEEQ

SEQ ID NO: 183347 - protein, 121 aa, Glycine max
  Coding DNA Sequence Number=SeqID_91662
MEISEDTDIPVILGTPFMLTASCIVDMGKKKLELGNGGRSRGSESKNQNIRLPSEGFNFLEKGLKNNLENFFLKNSPFAKRKPRAKRISVHALNFESQALSTQPLHLRLIWFAKLAKVELS

SEQ ID NO: 183348 - protein, 108 aa, Glycine max
  Coding DNA Sequence Number=SeqID_91663
WFFRKHSGRRGSSGKVFQNFESSSGILPDEPLLLESSRKRFSGSLPEEVFFRKTLNYFRKNTSSGNFPEKVLPEDSVVSLLRHFFQRPLVFSPLVFYPNVPSSTLRFH

SEQ ID NO: 183349 - protein, 71 aa, Glycine max
  Coding DNA Sequence Number=SeqID_91664
  Homolog annotation: Hit_ID=A5BPP4; Match level="QueryCoverage=56%, HitCoverage=7%, E-value=3e-07, Identity=57%"; Hit description =Putative uncharacterized protein
MTKKRVLKEPNKTFLNWFKDSIFGDDNAYETCKWVDSNINVQIDDFGFTLVDLKKLAYQIKPFIMAKQAKQ

SEQ ID NO: 183350 - protein, 82 aa, Glycine max
  Coding DNA Sequence Number=SeqID_91665
MATTTMDEAPEDAHADVDQFRHVVEACQAITERLERLLNLSIVTEGIKAYTITEECPRIARGVTTQQNVYIRSRRRRRIEDT

SEQ ID NO: 183351 - protein, 63 aa, Glycine max
  Coding DNA Sequence Number=SeqID_91666
  Subcellular localization annotation: CTP_CleavageSite=17; ConfidenceScore=5.12e-01
MTSSGSGGVSSSSPSVTAAAGSLGAGSWAVEAPPPPEGEGWALGQATCASNSSMLIMDGKPKP

SEQ ID NO: 183352 - protein, 103 aa, Glycine max
  Coding DNA Sequence Number=SeqID_91667
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=69%, HitCoverage=11%, E-value=1e-22, Identity=73%"; Hit description =Chromosome chr13 scaffold_17, whole genome shotgun sequence
TKPIHIVVEVIRTGSPRNRENVAAVLWSLCTGDPLQLKLAKEHGAEAALQELSENGIDRAKIKAGSILELLQKPRLYLVEGPAIKSAATTEPGSQNGKKLEGG

SEQ ID NO: 183353 - protein, 84 aa, Glycine max
  Coding DNA Sequence Number=SeqID_91668
MRDIFKDIASISSDDVVFRIGHGDDGGNGIRESRICCVLERTQSKRIWLKQKMKWKSSIEGVMCLFMAVDDESDGQRHTWFDSP

SEQ ID NO: 183354 - protein, 291 aa, Glycine max
  Coding DNA Sequence Number=SeqID_91669
  Gene Ontology: Mol. function=inositol oxygenase activity; Cellular component=cytoplasm; Biological process=L-ascorbic acid biosynthetic process
  Homolog annotation: Hit_ID=A7P6Y7; Match level="QueryCoverage=95%, HitCoverage=84%, E-value=1e-128, Identity=78%"; Hit description =Chromosome chr9 scaffold_7, whole genome shotgun sequence
  Pfam annotation: Domain name=DUF706; Domain location=14-291; Score =673.7; E_value=1.5e-199; Accession=PF05153.6; Description=Family of unknown function (DUF706)
MLGNISNSYWAYNDAESERHEGVENFYRKNHTYQSIDFVKKMREEYAKLNRVEMSIWECCELLNEVVDESDPDLDEPQIEHLLQTAEAIRRDYPDEDWLHLTGLIHDRKLQENFHLYHKHLPICFNADLGKVLNLPSFGGLPQWAVVGDIFPVGCRFDESIVHHKYFKENPDYNNPAYNTKYGIYSERCGLNNVMMSWGHDDYMYLVAKENDTTLPSAALFIIRYHSFYALHKEGAYKHLMNDEDFENLKWLHIFNKYDLYSKSKIRIDVERVRPYYLSLIEKYFPAKLKW

SEQ ID NO: 183355 - protein, 252 aa, Glycine max
  Coding DNA Sequence Number=SeqID_91670
MRSWVRGQWIPFDADALGQFLGDPLVLEEGQECEFSQRRNRADGFDEEAIAQLLCTPGQDFARTAVGRRVRIMRTSMTTLTQMWMTLLLSNVLPSDHNSDLPLSKCQLVYAILTRMSIHVAQLIADAIYLFAGMPPTRHPLDPNKSNRALGFLALITPSKVIRLPITRVFIEKYCMPRQAQGDAPQAADASPPPHQVDPAGSLGMKRYLQHLVCQQAANHQGQVQIHVSLPAQPQSTGPGFRSFCVPYSRSF

SEQ ID NO: 183356 - protein, 159 aa, Glycine max
  Coding DNA Sequence Number=SeqID_91671
MRHQIPMIGGMMNVLSGATLFCKITHASNTFMIDIHRDSLGRNNQHENTKKAPLIQLVRNHVTSWEDAQEMGFQTLPYSNIPNTTNIYVFILFTCVEGRSLEFQEPMDLRSNPFQGVGNDAILPPPKALDRRLQEDWARDAKEDPRVLMSLRVDFEPMS

SEQ ID NO: 183357 - protein, 80 aa, Glycine max
  Coding DNA Sequence Number=SeqID_91672
MAILIANTLTHFIEMKDSGIRMLCMENVIMRLRCPKKHHFLVSHVSQPTLLQASEVRLTGRQKRGSCSYVPSIEEKIRPT

SEQ ID NO: 183358 - protein, 134 aa, Glycine max
  Coding DNA Sequence Number=SeqID_91673
LILKDEFRICLRSKRSLSQQLCEIETNMLAIINKYQEELNLATAHEHKVADEYARVYTEKEARGRVIDSFHQEATIWMEQFALTLNGSQELPRLLAKAKAKAMADAYSAPEEIHGLLNYCQHMIDLMAHIIRNR

SEQ ID NO: 183359 - protein, 96 aa, Glycine max
  Coding DNA Sequence Number=SeqID_91674
AKRKLNLAATHEQRLEDEYAKISAEREARERVIDSLHQETTMWMDQFSLTLNRSKELPRLLAKAKAMADTYSAPEEIHRLLSYCQHMIDLYMIRNR

SEQ ID NO: 183360 - protein, 216 aa, Glycine max
  Coding DNA Sequence Number=SeqID_91675
  Pfam annotation: Domain name=Transposase_23; Domain location=51-121; Score=8.8; E_value=0.00013; Accession=PF03017.5; Description =TNP1ENSPM transposase
  Subcellular localization annotation: CTP_CleavageSite=34; ConfidenceScore=5.29e-01
MASFSHMQSQLQSQMQSQGLAVPPEPLLGTFGPRVSTKGSCVDPSRNDPEMGDSDRCGLYIEADPARLVAMGRVYEGSAVVHNTPLLPGQVKVSVEEVTDADAPVPVPTDEVSLAGQALHTFLAWSTHLVKSLSQQVVVSPAKPPPKPDPEVDDPLYLMTLTIPELFLRPYQVRWDATVFGVFNPDFPLYIKHEDLFEIAHGGQCLSILVLQLWIL

SEQ ID NO: 183361 - protein, 71 aa, Glycine max
  Coding DNA Sequence Number=SeqID_91676
MPKIKGKYCYAIQKESQKSKGGVFSKKGVQIATRPTWTFEDVPPEGGCFWRKQPGSPGRAGWQAPPLFSYK

SEQ ID NO: 183362 - protein, 118 aa, Glycine max
  Coding DNA Sequence Number=SeqID_91677
  Homolog annotation: Hit_ID=A5AIL4; Match level="QueryCoverage=98%, HitCoverage=9%, E-value=1e-11, Identity=33%"; Hit description =Putative uncharacterized protein
NEKGELDPRAVKDVTFNEQESYFKQPHLQGENVIEEDEPLMLPNMTFGPEIGTTSAAVPETERSPDSAEQSPDSTARSIPQPETNGGKFGKNLVYSRREKVIPDSIHVQEFDPPSLHE

SEQ ID NO: 183363 - protein, 369 aa, Glycine max
  Coding DNA Sequence Number=SeqID_91678
HGRRAARPAPEQARLAGLAAGIAGRDPGHARCPGLGRDAAMDLRPAVAGHAVAGAGHPVAEAGRFPRVHGAAVQSVGAMRDFGGGLRRAGGQGRQPAAGCQRRVRAQRAVDSGAVDAGRLRPVLDLPAALVSHPCRQRAVPEPGGYPGVGLGHVRRAAVLADAGGHGRVGVRHLDGRAERTALALASRADKKAGPGGAGHSRAAPGALQRIRLRNSARVDGLSWNSPSITDVTMDEFCFSTPRIIMHMCWASMTTATPAAPAAGVHLDDARHLGQAQHLAVGQVGHMRLADEGQHVVLTERIQLDVLDQHDLARVGGEQGAVDDLFQVLVVAAAQVAHGLGRARRRVREAFAGWVFPQCFENGGVVIFQ

SEQ ID NO: 183364 - protein, 81 aa, Glycine max
  Coding DNA Sequence Number=SeqID_91679
MGEVEKVQEQMKADMEAMKGQMATMMEAIISMKKIMEANAVIVAATSVVAKVNPMLPSGLKQMNHPTSNMVAKIWEVRMTP

SEQ ID NO: 183365 - protein, 58 aa, Glycine max
  Coding DNA Sequence Number=SeqID_91680
MALRFDGLQTFVGERFDALELQVDMRFDEMDSRITKVEGDVSYIRTCFDLPPPPPPSS

SEQ ID NO: 183366 - protein, 111 aa, Glycine max
  Coding DNA Sequence Number=SeqID_91681
MVAVGDGERAWNIGNGFGRKKGEGMAFFLSYLDYKAQNKQVSNALGNRNVAHTPDIFSKIPLTKFREDPMVNEGWASFLPRQLHVASLRGFLKKLPRGFFEKLSQEASLSS

SEQ ID NO: 183367 - protein, 133 aa, Glycine max
  Coding DNA Sequence Number=SeqID_91682
VVIIKKGEIVEANFMMMNQEVLMMTKMMTKSPKNDFKIKFKIKIHQEDSRFKNNQDQDSRLKDSRIKRRLNQNKVHLLGDCYTKNKRGYISCGSVQVEGTSTWVFKENKGGYIPCGSLACKGFYKVERNLKNR

SEQ ID NO: 183368 - protein, 186 aa, Glycine max
  Coding DNA Sequence Number=SeqID_91683
DRELRGSSNGIIGGYHKWLRVRTQGLDWLPNLKTVRDDEVKASEESDEVQALKAELERARVVEEKFKSIAIKESSRVKGMILKDELKAYLRSKRNLSQQLSETEGNMWAVIDECKEKLNLAATHEQRLEDEYAKISTEREARERESRTSPIASQGQSNGGHLLRPQEDPRTSQLLSTYDRLNGPYD

SEQ ID NO: 183369 - protein, 63 aa, Glycine max
  Coding DNA Sequence Number=SeqID_91684
MSKATTRFEGLVIFVLGIRQIHAQEIPKHMARNFRDIRVIQICHHEQVRAITGFEEIITLSGI

SEQ ID NO: 183370 - protein, 158 aa, Glycine max
  Coding DNA Sequence Number=SeqID_91685
  Homolog annotation: Hit_ID=A5AK77; Match level="QueryCoverage=37%, HitCoverage=7%, E-value=7e-07, Identity=44%"; Hit description =Putative uncharacterized protein
CMTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLAGEDPHKHLKEFHIVCSNHETPKMSKRITYF
